United States Patent 6,812,339 (POLYMORPHISMS IN KNOWN GENES ASSOCIATED WITH HUMAN DISEASE, METHODS OF DETECTION AND USES THEREOF) - sequence listing, part 64

SEQ ID NO: 16104 - DNA, 24043 bp, Human
gctctgctattgaatggctatgtcactttgagatcacttaacttctctaagactcagttttcccaggtatgaaatggagaacattaatctagattaactcaaagggttattgtgaggtttcactggaaacgagaactttggaatcatacatatctaacttgagatgctggctcttctacctattagctgagtatctcagggaaggcaattaaaatgagcttcagtttcctcctctgtgaaaaggatgaataaaggattaaataagctaatatttaaaacctcagggacagtgacatagcgcttcatccaaaacccaaaggctaatatttaataacgcagataaaatgctttgaaaattaccaagtgctatccaacacaaaccattatttgccaaacattaatttgctctcaaaaactgctaatagcagaaggctgctgaatgctaaacatcatcaaaacatgtatggaacatctatgtgaaaggtattatattaaatgctagggttaacagggaggttactacaggagatgtattttctatagaatagctccagcccaatgccagcaatttattctactcatattaaaaggaggttagtgcttagcaagaatttaattgctctgcaattcatcctgtttctaaacaaacctaaactttaagatctttctaggggcagaaagcccatgagaaatacaatggaaggtaaagacaatgggacggcggaagtggttgcaccccgtgcaaccagctgcagaatgaatagggaagacagcaaagctgtactagcctctggtttatcaactccagaccatgagaaagataactgtagatacagttacactatgacaaggctaagcacgaatcaccaacatgtttcccaaagtgggtggtggccctgaaagtgtgtttgcttgttagatggaatcaagagctaaaatcaaaggctactcctgaaccgttttagtaagacccgaggtaggagttcagaagcctcagtctcagtcccccgttaaggaagcagtgaatctcagaccgaaacatcctggctacagctcttggccctcgtggtctgtcatccctcttattcctcgaccctgccactcgaggttcctcagcaaaccttgccggcacagccggtcgctacacgtccccgtttccccccaacttgggtctgggcgccctcagcccatcaagggtccgctcctccgcccgcctgccccctccgtctccctctatcgccggggcccagggcccgtctgctcggcgctcacttcttcgtgtagagctcctccagacggtgccacacagcgggctgcccgggcccggagctctggctctgctgtaggaagcccggtacgtccttcatgacagcaggaagacccccggcacagaagaacaaccgggatgtcagcaccgcggggatggctgccggaaatgctcactcacttccggcgccgagcggcgcggggcaggctgggagcgccgtagcaggccgggggcgggccccgctggttgctcggttacagcgcgtctctgcgctccgggcaaaactctccggcgtttgcagcccacttcccgcgcacttggctgtgccattgaggcgttaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaaggtgtgagcgcagggtacagaaatgctggctccaggtttgacctccggggcgagagatgagacaccagactagggaacttcctctactcgcctctacgtctacctgggcgcgccggaggcgtcggcaaggaggcgggggcgggacgcggaggcgggaccggggcgccgggggcgggggcggtaggcggaggcggggctggggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgaggtattttgggcaaggacaagcacttcttgcgtgttcgttgtcgacacctcgcccactctttctcaccttgccgtgtttcctttgcggcatgtctgggagtttacgtgcgttccaacaccggggcctccgtctttatgctgatctgtggacgtcccttatgggggttttgtcgtttatttcaccattccctcattgaaatacgttctaacctttagttattgtgcatcatgctgtggtgaataaccttgttggcacctcactgtttgcataaattcctagtactgggattgctaggtccaaaagtatatgcatttaacgctttaatgatccctcataaatgttgtgcggttaatactcccactggcatgtgatcgtacccgtctccatagtaattgcatctaagaactgaggctacataggaaaaaatcttaaggtccatggttgttaggtatcagatgccctataatggatgaatatttaagtaaataatggcacattgacttgctgtctgacacaactgctgaaaatgttggtgaaaagtgagtctcgaagtggtagctcacacttgtaataccagcactttcggaggctgagacggggatcgctcgaggccaggagttcaagagcagcctgggcaacataacgagacccccatctctaccaaaaatttaaaaattagccgggcatggtggcgcaagcctgttgtcccagttactcctgagactaaggcaagaggatcccttgagtccaggagttcaaggctgcagtgagctatgattgagccactgcactccagcctgggtgacagagcaagactcttatctacctgtgggaaaaaaaaagaaaaaagtttaatagatcctgaagagttggccgggcgcggtagctcacgcctgtaatcccagcactttgggaggatgagacgggtggataacgaggtcaggagttcgagaccagctgggccaacatggtgaaaccccatttctactgaaattacaaaaattagccgggcgtggtggcgggcgcctgtaatcctagctactcaggaggcggaggcaggagaatcacttgaacccggaaggcagaggttgcagtgagccgagatggcaccattgcactccagcccgggcgaaagagcaaaaactccgtctcaaaaaaaaacaaagatcccgaagagtcagtcgttcatccaagaagccctgactgagctcttattctgtgccagactctgttctaggtgctatggatggagcagggaccaggacctacaaacacgtggagcgcattctaatatctgtgatactctgcaaaactgttaaaacaaatccttgcggccgggcgcggtggctcacgcctgtaattccagcactttggaaggccgagacgggcggatcacgaggtcaggagatcgagaccatcctggctaacacagtgaaaccccgtctttactaaaaatacaaggaaattagccaggcgtggtggcgggtgcctgtagtcccagctactcgggaggctgaggcaggagaatggcgtgaacctgggaggcggagcttgcagtgagccgagatcgcgacactgcactccagcctgggcaaaagagcgagactccgtctcaaaacaaaacaaaacaaaacaaaacaaaacaaaacaaaacaaaacaaaacaaaaatccttgctaccactggccctaaagcaggaggcatagggctgcgtgtgaggagtagtccattgcatgggcttcctccagtttggctttggatttttgagctctctgaatttgttgtttgtgtcctttgcacagtgtccctcccaggttgcacccatgcctgcccctcagggtcccccactcccagtgaatttcacaccatgcagcatgtactttaagccatacatcttacgtatgttccagacatttggtaaaacgccgtttatgtgtttttcagtgactcacaaacattttatttacgtagatgaggaatgtactcaggcacccttcgtgataccttgccctcagcaggcactcaacagcaataataactttcattccttttgtgcttctcttaacagttcgtgtttagtaggagcacagtagctgtttggggaacgaccttaagtgaatagatgtctgaaatgctgtgtgaagtggggcgcttaataggtggtgagatggttttagaaccagggttttccctctttgcttcttgactccttaaccagttttcattaggagacccctttggaggtttgcagtcagtcagagttgagtgcctactgagtgtactgaattatgaaatgagcacagttcccattaacctgaattttttgctcccaagtaagtcttgatttctgatttatgactgctttttgttgtaccccaatagtcgtctaagaaaggtgattattttgagaggcctggggagacacacatgctcattctcgagggtggcggtggtgcagagggcagagccatgctcgttcttgctatcctgagattggttgctatctgtttcctttgctgctgtgtttttttctgtcagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcaggtactgcccacagtcccacctgccttctgcgctcccctcccctgactcctgccctccccactgcccagtttattccacttccctgtcctcttccaaaggcctcagagcctttcttctctccctgcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggtgagccctctgtgagtcgcacacattctttttctcccacggaggctcgggtgcctgtttctcccagggaggctcgggtgcctgtttctcacaggggatgctcgggtgcctgtttctggggacggccaaaacctatcgcttatgcttcttccttgggactttttttgagccaactagttagggctttgttcccaaggaaaatgtcctctgggtgtttaaaggccactgcttgttctcctgcatacctgcagagctgtgtattttgggcagaagttgacattgttttgccaatctggtgtgatgatctctttttttcttctctcttttaagaagtgtattatggaatttttttgagcacacacaaagagagcaatgtaacgaaccgtcctgtcctcatcaccagcacacagccagttcttcctgcgtcctcaccaccttcttccaaatccccagattattttgaagcaaatctctcacatcatgaatttaatctagaaataatctataaacacatgaatggatagctctagagaatactttaaaaacaactccggccgggtgccggattacaggtgtgggatcacacctgtaatcccagcattttgggaggccgaggcaggtagatcacctgaggtcgggagttcgagaccagcctggccaacgtggcaaaaccccgtctctactaaaaatacaaaaaattagccaggcgtggtggtgtgtgcctgtaatcccaggtactcgggaggctgagacaggagaatctcttgaacccagcaggcggaggttgcagtgagccgagatcgtgccacttcactccagcctgggcgacagagggagattctgtctcaaaaaaataaataaaaataaaaataattaaaaaataaaaacaactctgatagtgattcacactgaagaatcactagtaattccttaatatggtcacacttagtctgtggtgatttcttgaccgtatccatatggtgcccaaaccagcgattcacaggttgtgccaacttctggccgtgcacctaacggaagcacttggtggggccttttccttacgtgcagtgatgcagacaggtgctgggacagtcagctctccgggagccaggagcagtctcctggctcccggagagactgctgatgtgttgtcagttaaaaagaggtggcaccttggctccaggaatgtgtttccttgccagaaggatcccctgacttggaaccacagaggcagcagtggatgccccatgttggtgggctcttctcccagaggtgcagcagggcaggccttgtgggaaggtgggagctcctggctgtgagattcagcactgctgagttagggcagcgacagggacttgggaagcctcctgcagctgggaccctggctgtgccaccgcagcctttcagaaccagttaatactaacacaactttcataagaagtcactttttgtctgtttctaccaagcaattcttttggaatttatgatatttatatcctcattttaacttggtatctgtagaatagaagatatgttcctggatattagatataaatttttgagacagggtcttggctctgttgcccaggctagagtgcagtggcatgatcatagctcactatagcctgaactcttgggccgaagtgatccttttgcctcagcctctggaatagctgggactacgggcatgcactaccatgcctggctaattaaaaaaattttttaagacaagtctcactatgttgctgaggctggtctcaaactcctggcctcaagtgatcctcctgccttggccttccaaagcactgggattacaggcatgagccactgcacccagcctggtattaggtgtaattttttttttttttttttgagacagaatctcgctctcttacccaaactggagtgcggtggcacgacctcagctcactgcaacttccacctcccgggttcaagcgattctcctgtctcagcctccccgagtagctggcactacaggtgcctgccaccacatctggctaatttttgtatttttagtagaggtacggtttcaccatgatggccaggccggtcttgaactcctagcctcaaatgatctgcccacctcggcctcccaaagtgctgggattacaggcgtgggccactgtgcccggctggatataattttatttgagcttttatcaaatggtttttcgtactgagttttgacaggctttgttttaaccgtgatttggctccagctaggcgcccctttgctcccctgccttattctggttgatggcgcatgtaggtgatacgggcatgaaaaccaggcttgaggacatcacaaccccaaggggctgtgcctccttccaggagtcctgccaagcccagaagttgtgctcttggccttgcgtgctcatctcggaggcggcagcaacacttcgctttggcttgaatttcagtgtcgggcatccctgcctcaaagctggttgaagctcatggaacctttgcctctgccacctgcacagtctgccaaagacccttcccaggggaggacattcgggtgagttatcctgctgttggttgtccttctgcagtttgctgttggggtgatctggaaaagtggtattttataagcattgtctcgaaaggacagttgaacaataatagtgtgaaacattttatttgtaaattagaaaatcaatacatgcttgtaaaaaaatttaagacaatatagaaatatgtagggaaaatgaatctcccttcagccaattccagctgcccacttttttttttttttttttttgagattgagtctcactctgtcgcccaggctggagtgcagtgggcgatctcggctcactgcaacctccgtctcccgggttcaaggaattcttctgcctcagcctcctaagtagctgggattacaggcgtgagccaccacgcccggcaatcagatggccttttgtgccgagcttatttcctgaaaatgtttctcgctccttcgccttgtagcttgtgttagtatttcatcctgttttatggctaaatgttccactgatgtatgcaccacagttggtttgtttgtacatggatgggtgtttgggttgtcccacctttctgctcttgtgtatagttctgctgtggagcatatgcaagtattcgtttgagagtccttgttttttattcttttgagtatgatacctacaagtattgctgggtaactccacgtttagctatatttatttatttattttttgagacacagtcttacactgtcacccaggctggagtgcaatggcgcgatttcggctcaatacaacctctgcctcccgggttcaagcgattctcctgcctcagcctcctgagaagctgggattacaggtgcctgccaccatgcccagctaatgttttttgtatttctagtagagatggggtttcaccatgttggccaggctgctcttgcattcctgacctcaggtggttcacccgcctcggcctcccaaagtgctaagattacaggcgtgagccaccatgccctgcccatgtttaacttttttgtttgtttgttttgagacggagtctagctcttatcaccaggctggagtgcagtggcgcaatctcggctcactgtaccatccgcctcctgggttcaagcgattctcctgcctcagcttcctgagtagctgggactacaggcacacaccaccacgcccggctaatttttgtattttagtagagacggggtttcaccatgttggccaggatgtctcgatctcttgacctcgtgatccgcctgcctctttctcccaaagtgtgggattacaggcgagagccactgcgcccggcccgttttaactttttgaggaacgaatatactgttatctgcagaagctggaccattttacattccaccaacagtgggcaagggtttcatcttttccacatcccaacacttactttccattttttaattacagctatcccagtgggtgggaggtgtaacccactgtagcactgattggcattttcctaatgattcatgatatcaaacatctttccatgtgctttttggccatttgtatatctttggagattgaagtcctttgcgcattgtttaattgtgttgtcttttttattgttaagagagtcctttatatattctggaagctagatccttatcagagacatgatttgcaaatattttctgtcattctgtaggttgtcttttttactttgttgatgtcttttgatgcatagaagttttgattttgatgaaatctagtttgtctatttattttctcactcttttggaatcatatctgagaaatggtattgttttactcctgttttcttataagagttttatagtttaaagcttttacatttagttctttgatccattttgagttaatttttgtgtgcgctgtaaggtagggatccagcttcattttcttttatgtggatatgtaattgttccagcaccatttgtttaaaaaaactgtggtcttggcattgttgttgaaaatcagttggccataggtgtatgggttatttctagagtctcaattctattccattgttatctgtatatccttgtgcctgcactataatgttttggttactgtagctttgtagtaagttttgaaattaggaagtgtgagtccagcacatagtagaaacttgatatatacgtattattgttttggtcaactcattcattgaatgaccaatttattcaacaaatagtttagtctcctcagtgccaggccctttgctgggttctgtggatgtgaatagaaattaaaataaggtggagtcatccaacagttacaactgggtgccatacgaattttactataaatatgtactggacactacactgactcagctgtaggaacagagtaggctgggaagcacctttgagatgaggccgtctggatgtaagagtctgtttctggcagcagagacctggagtgtgggaggcctgcttgctctgttagggtttgaactgtatcctgacgatcatgggaggcattggaggatttttaggcaggaaaatgatgtgaagggatttgcatttaaaagagattatttgggactgggcacagtggctcacgcctgtaattccagcactttgggaggcctagacaggcgggtcacctgaggtgggaagcttgagagcagcctgccaaaatggtgaaatcccatctctactaaaaatacaaaaattagccaggtgtggtggtgcacctgtaatcccagctactcaggaggctgaggcagaagaattgcttgaacctgggaggggaggttgctgtgagctgagatcgcaccactgcactccagcctgggtgacagagtgagactccatctcaaaacaaaataaataaataaataagagaataaaatagataatttgggcaacaggttgatgttaattccccacctttgttcttctccttcagtactgtgttggctggtctgaatcttttggcttttcatataaatttctgaaactgttgctatctgttctctgcctgttttatttttgttgttgttgtttggattttttgtttttttgagatagagtcttgctctgttgcccaggctggagtgcagtggtatgatctcagctcattgcaacctccccctctcaggttcaagcgattctcttgcctcatcctcctgagtagctgggattgcaggcatgcgccaccatgcccagctaatttttgtatttttagtagagatggggtttcactatgttggtgaggctggtgtcgaactcctgacctcatgatccacccgcctcggcctcccaaagtgctgggatgacaggcatgagccaccgtgtctggcctctctgcctgttttttaagacttttgtctttggagttttgcggtttctccactgtggttttccatatgaattttcttttatttcttctgcttaaaatttgtaggccagttggtcatggtggctcacgcccgtaatcccagtactttgggaggccgggtgggtggatcgcctgaggtcaggagtttgagaccagcctgaccaacatggagaaaccccatatctactaaaaatacaaaattagccgggcgtgatggtgcatgcctataatctcagatactcgggaggctgaggcaggcgaattgcttgaaccagggaggcggaggttgcggtgagctgagattaggccattgcactccagcctgggaaacaagagcgaaactccatctcaaaaaaaaaaaaataataataataattgtaggccttccttaagaaaaataaaataaaattctaggctgggcgcggtggctcctgcctgtaatcccagtactttgggaagctgaggcgggtggatcacctgagttaggagtttgagaccagcctggccaacatggtgaaaccccgtctctactaaaaatacaaagatgagccatttgtggtggcacccatctgtaatcccagctactcgggaggctgaggcaggagaattgctggaacccaggaggcagaagttgtagtgaaccgagatcatgccactgcactccagcctgggtgacagagcgagatgccatctcaaaaaaataaaatataaaataaaattctaagccctgcaaccaactgaatggagccctccccttggtcaagggaaccccagagaaaccttggaagcttgagttcctggccgtagcaggagaggaggtcagacgcgcctcactgtacccctccctccccagccaccattaggcttcttcactaagggctaaacagaaaccagcccttttcaaagactctacactgctaatgtggattactggtttatcttcccagatacagattaaagacaagatgagattaatggttccttcacccttccctgagaggtctgcttagttctcttcctctgtttccttctatcttaggtaaaatgtacatttactgggcacttactgaagtctcacaagtacgtaaccactcacctcacagccaccctccctctttgaaggaccacatgtaattactaaacctcctgagaacctcttgggacagaaacaagcacagatgtgccgtgactcatgtttttcctgtgggcaccctcaggctggctcagtagccctcacttgcttgagatcctgaatctgcgggttggcgtctttcatggttgctggatcatactctgccgttatctcttcggatatgagttgcccctagcccactatctggcccctctctttagggacctctgattgaacatacattagaccttctctctcctgctgttcctgatcactcttctgtcctgtaattgctgcttcttgtgctgcattctgggtaatttcttctggtcttttttccagtttactaatattgtattctgttataaggtccttccattgagtgtttctttctttcttttttcccaaacagcaactcaaaacagacattgagttttaattttggttcctgtactttttatttctagaagttctatttggttatttttcaagtctgctacattattacataattttttaatagttttatatctttaatagatagttttttgttttgttttgttttgttttgttttttgagacagagtctcgctttgttgcccaggctggagtgcagtggtgcaatctcagctcacagcaacctccgcctcccaggttcaagtgattcccctgcctcagcctcccaagtagctgggattacaggcacgcatcaccacgcctggctaattttttgtgttttagtagagacagggtttcaccatgttggccaagacagtctcgatctcctgacctcgtgatctgcccacctcggcctcccaaagtcctgggattacagagctgagccactgcgcctggcctttgatagatatttcaagttcatcttttttttttgcttccttaatttttttttttgctataccccatgcctccaagataacagttttttctttttaatttaaatataatacagttttactgtgtatccaagaatatctgaaatctttcgtgggtctctttcttttgtcttttgtatctgttgctttttgctgggctgagcctgcttaaaacaagccccgttagctgtaaaggtttaccttagaaagtcaggtgtcttcctctgtaactctctcccttttccatctgctccaaggcatttatttatattaatcttgacgcaaagggaagttgtgtccacttcaccttggccagtaaggaagcagtgtttggcagatgttgttactcctaataatgccagccagtgagtgaagctgacctgaatgcctcccagggctgaggcaatggcatgatcaccgaagctcaaaccagagacagtttcacctttctgactgaatagtgttcggtgtaggccaaatgcctgcagactactgtttgaggactggtgtggtctaccaggtgtttccttagcgcctggatgtctctggctgccatcccagggatagagcatggtgttagatacgctagatgcctgccgaagtaattatgggtgaaacatatgatgtccaagatttgcttttaaaggctccaatacctcctcccagattccggagggctgtgaaacaattagctatgaaaactggtaattcctgaagctgggtacatgggggttcatgatccctctctcaccttttttgggggagaatgtttgagactttaataagaacttgttgccttttccttttacagggtgttgcaggcatcttcctcaggcctgttttctctgttttccaggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtttgtcagcaggcctgtgcagggaggaggctggagggcaggggaagggaggggtacaggagtcatctcatgggctgtcggcaggcctgtgcagggaggaggctggagggcaggggaagggaggggtacaggagtcatctcatgggcccttccagggctggtgccactttgggaaggtgaatggattcagctggggttccaggctgagggagcagcagcctgtgcaggagacaggaaggtgggaagctgctgggctttggaggtggtataggtgtgggtggggcaccacgtgtgaggagaagggagaaggatgggggtgtgggggcgaggtggaggggcagggcctcccaggtcagatcaggaatactgatgctgcagtgggaggagtgataaatccacagggactggcccggggacgtagctgcacccttggggtcagggaggcctttggggagtggagagtggagcaagcagtgccaggaggctggtcctggagaaggtggagctgtggtcgcctgagggatggcgaggagggggactggactcgcagtctgtgatgttttggggacgtgagaaggaggcgtctggcttggtctgtaaggtcagggcacttgctggtgaggcgtgatttgggagggaggatgcccagctcggttctgtgcgtgtctgaggtgtcgggaaacatgccctggatgtgttcaagcagctgttctgcgtctgcgtctgcagctcaggaaattcctaaaagctgtgatgagagcaagaaatgagaccatgaagtcagtgtgtgcgtgactggatgtaggcaccgagggcagaagggccagaaagacctgtgctcagaggggcccagggcagccacaggggcccagagcatgtgtttgttcaggcattcattgtgtgctgggccctgctccagtgctttggacatacacggtcagatgtcagtgtaagaagttatatagtttgttaggagatgattgatgttatgagaaagataacaagtaggatagaaaggctagaagggttgggaaccagctgcagtgtcaagtcaggcaggtggagttggatctaagagtttaccgaggtgaggagggtctggcaggggacactgcacaggtgacaagcagcaaggagggtggggcgaagtcagcattgatggccacggggctggagcagagaagaaggtggggcacaagtgtcatctcatgggaggctggcgccacctcagaaggtgaatgggttcagcttgggttccaggccagagtctgaagttgagaggactccgttgggtgctgggctgtgagcccaccgtgggggcaagactgggagcagcagacccagcagggcccttgtaggtaatcaccggctggcactggctgggggccaggtaaagccagcagaggctgaggggtgctggagtctgggtgtgtgtgaacgcagagtgggtacgctggcacagtgcatgggaggccgtggattcccaaggaccccagggctgtggctggagcagctggaaagacggagccgccgcttcctgagatggagaagcctggtaggtgggtttgggggagctcaggaactcagccttgtttccacggatttgaggatgtgctgcggactggaggtgttgagcaggtggacatgagtctggagtccaggaaggcccagaggcaggagctggggtgctggagtgagcagacaggagagcccagggtgtggacagacatgagaatgccatgctaggcctaggatggagggacagacacaggaggagcagtcagaggggccatggtggtcagcacagtgtgggctgagaccagctgaccgtgctggccaccaggtgtggacacttgggccaccagccatctttattgttgaagtgaaatgaaaatggcctttttcctgattataagtgtatcatgtgtgtctttgaaaagattcgtacattatataaagatataaagcaaaggatcaactttttaatcccaccaactgttagcattttattctgtgtcctctcagctttcttttttttgtacaaatgcatacgtacagatggtaattttaaactaaaagttggacagcactgtacattctattctgcagcctgctgttttcacgtaacaatgtgagtccatggagatgtgctgcgttgttaatgccaacagtttcccttacacggatatgaggtcccaactgagaaacccatgtctgtaaggctggtgccatcatgaactgaatgagctggtgtcacgcacagactctatctcacgtgctttgtggacgaaatgttaatgtgtttgactgtggagtaccactccagatcccctttaggtgtgacataacgtgggatgtaaaccatatgatcttttctaaaatctcaaaaattctgaaacatattcagccacaagagctttaacatagattttgtggatttaatacaaaatttatgtaagcaatttcttactgatggacaatgataataaatagtatataatttttacattaaaagtaatgctgggccaggcaccgtggctcacacctgttatcccagcactctgggaggccaaggcaggaagattgcctgaagctaggcatttgagaccagactgggcagtatagtcagacctcgtctctacaaaaaataaaaagatagccaggcatggtctgtgtagttgcagctatttgagaggctgaggaaggaggattgcttgagcccaggaatttgaggttatagtgaactatgatcatgccactgcattccagcctgggtaacagaatgagatcccgtgctgtagtgaatatccctgtgtatcatccttatctactcatgcaagtactcctgaagggtaaatgctgtagtgaatatccctgtgtatcatccttatctacccatgcaagtactctggaagggtaaatgctgataaatactgagaacttgccttccggtgaatatccctgtgtgtcatccttatctacccatgcaagtactcctgaagggtaaatgctgtggtgaatatccctgtgtatcatccttatctacccatgcaagaactcctgaagggtaaatgctgataaatattgagaacttgccttccagaaagatgtaacaattacactgccacaaactgtgtttttatgtagccattttatcacatcctcaccaaaaccaaaatcacacaaatcaaattggttaaaaaatgcatgtgtgtgtgtggaggggggtgcggattttgcctttctgtagtaaagaatgaagttcatcttttcatgtttattgccagttgtgtttcttctctttggattgtatatttgtacctcttgaccatttttcattgggtcattataaattagcaatataaattagttttaattttaatataaattaaataatataattacattttaatgttaatataaacttctttcttttttttttttttttttttgagacagagtcttgccctgtctcccaggctggaggttcagtggcgcgatctcggctcactgcaacctccacctcccaggctcaagccgttctcctgcctcaacctcccgagtagctcggattataggtgcgtgccaccacgcccagctaagttttgtatttttagtagagacgtggtttcactatgttggccaggctggtcttgaactcctgacctcagctgatctgcccgcctcggcctcccaaagtgctgggattataggtgtgaaccaccatgcccagctgttaatataaatttcattataaattagcattataaattagttcataaattatatgtttataaatgagtttatcaattagcaatataaactattgtcatatgttgtaaatatttttgcagtttatgatgatgagaggtttttaaaaattttaaattttctacatagtagttttatgtagataccgagataatagtatttacatagtcagatctgtcattttcctttgccttatctgacttcagtttttgcgcctaaaacgttcttccctatccttacttgtaaatccttagttttcttcaagaactgttttgtttacattgaaacctttaatccatttgaattttttttcagtgggaggtaggaatggagtattttcctcccagataatgagccagttttaatgccatttattaatgtatccattttttaccttgttcctcttaaaagaagctttgagagctgtatgaagaagcctgatggcaccgagctaggcctctctagaggctgggcggggaagaccatggagagacgtaacagtaactcctgctcgggggcaccagctcgtctgggtgcccgatgctggtggtggctgtcacagcaagcagggctagccagaggagatggacgagtctgtgctgttgtccctctgtgtcatgctgggagacagcgaggtggggaggacagggagaacagaacgtgctcacaaagaggaggcaggaaggttggatccctgatgagccttggaacggaggtggggaaaagcaaggatgtgtggaaacagcaagaagtgggagagagagagagaggcggaggggagaaaaccgtcacggaggccaagcggcaggagctcagctgaagaaatgagattggtggtgggttttccctatatcgcaggctctgactgccaatctgctgctcctccaaggcctcggtggctgtggcatgaaacatcctgaggggcttgtaaagtggacactgtgcccctcacgtttggcccatttttcaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctagggtatggtccacctgatatggagccccgttggttaacacagtaacagtaatagctgatgatgctgtgaatcctgcaccaggcactacctggacctgactgggtgttactttcaatacctccatttagagatgaggaaacagatgctaacaggccaagcagggacacggtccagacactcagggctgatgagtctgtattcttaacagactataggcgttaccttcactccctaaaataaagcagccaacagtgtccctctaaggcctggtatgtgattctaagatgatacgggttaaagaactttgagaagctaaagttctctgcatctatgtgggatgaaggctacatgagtgatgcttttcggaagtaattggtatgagagccattgatcaattataatccgctgaggaaagccaaagagccttgatgctttctaagagatttcaaaccgcctataaacaagtgaagttacagaaaatgcagtttcccataagaatcatgtagcatgtgtagccttgatattaagggttttcaatgggaggtggtagcattaagcatttaaagtccagtgtcatgattacaggcaggtgtaacactgtccaaaggggatttcaccagtgtattagtctgttctctggctgctcataaaggcatacctgagactgggtaatttataaaggaaagaggtttaatggactcacagttccatatggctgtgggggcctcacaatcatagtggaaggcaaagcaggagcaaagtactgtcttacaaggtggcaggcaagaggacgtgtgcgggggaactgccctttataaaactatcagatcttgtgagacttattcactatcagaagaagagtgtgggaaagacccgcccccatgattcagttacttccacttggccccacccttgacacatggggatgattacaattcaaggtgagatttgggtggggacacagccaaaccatatcaactacaatatatcacagttgatgctcctcttgccttccaaggcagatgtcttaggaaatcctgatcctttttccttgtccacagctgtggctgcctcatggctcagggccatggggtcagcactctcctcacctccaccagtccaagacctccaacctctggttgcaggctgattttttaccaatcatggtcacttcattatggaggcagggaacccagctaacaatgaggcttaaacgctgagaggcgagtgcctcctggccagctcacaaggcagcggagatcttagatcagcccagcaggcttttttgagggatccttttcctgctccaacttcatattttcttttttttgtaatggagtttcactcttgttgcccaagctggagtgcaatggcacgattttggctcactgcagccctgcctcctgggttcaagtgattctcctgcctcagcctcctgagcagctgggattacaggcatgtgccaccatgcctggctaatttctgtacttttattagagatgggatttcatcatgttagtcaggctggtctcaaactcctgacctcgggtgatccacctgcctcagcctcccaaagtgctgggattataggcatgagccagcaggcccggcccaacttcctgttttcatagaaaagcaggttgtaactctggtagctcctgtggagttttggaagtggcttaataggatttgaactgtataatctagtttcagagaaatgtatgtaaaatgggttatgatttcattttctgttttttacagcattactatccaaggggttacttttccaaatagtgaatgcttttaagcacatgagcatcagtacatattgatttgggtactttaagacccatagaatgaggctctccatttagccaccctgttctgcccaggcctgctgggatcctcttagcccagcacagcagcagcagtatttgcagaaagcagcttgttttgtgaaatattttgcatgtctgcagctagagctgtttgaacagagatctgctggcctgcctgggtgtgtaaacagatagctgataccctctgtcttctgtattccagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaattctaaaaagaatgaagttagtttctaaccctagttaatgttccttttttattttttgagtcttgccctgtcactcagggtggagtgcggtgttatgatctcagctcactgcaacttccgcctcccgggtttaagcgattctcctgggtagctgggattacaggtgtgtcccaccacacctagcacatgggcatatttgtaatagagacaaggttttgctatgttggccaggctggtctcgaactcctggcttcaagtgatccacccacctcggcctcccaaagtgctgggattacaggcatgagccactgtgcctggcccctttatttgataatttacacatacatttttgtccaaaactcttctttatttcaagatgatgtttctgtggctatgtgtggtatgtggtataaatctcaatctatggtcacacgaggggcattttccttgttgtaagtgtagtctaaaccagtaggaaggaggtttaattgccaaaaccagcgagaactcgggcactgtggatactacagtgggcagctgaacgaggaccaaggagaatgtctaagaggcctccagccctgcgctcagtgaagacaggacaggaacaacagagcatacataccttggaagggtgtgttctgatatactcgtatggaaagttctgacaggttttctccctgggaagtgcagcacataccccaacacactggctctgccagtgtgccaatcccagatggtgcttgctttgtgtgcacccacacccaaacccctgccctcccatatgctcttctgtgtgcccaggtaggccctgccctcaggcagcagcttctgaacacattcctcttggcgcagacaaaagaaagtacttcgtctgtggaattcgaggctgagcctgagttctagcacaagaagaccgttgcagtccagagatgagaaactggaccagaggcaaatcatgaacagaacgggagtcaagagaaggggtttctaagatggagaagtgggggcgggtgtggatccagtgggatgtggcttccccaggttgcaaccccaaggaagtctctggaagcagcaccagtcctgatgggggagcagaagagctgccatcctcagtcagggtccgagtcagggtccgaggagagctgctgctccatagtctcgcacatggcatcctgcagggacgtaagatgaccccggggactcatccccattggctggatgactctgttcctgttggggaaaggtgcagtggggctggggaaggggcccagttggccaggcaggggtcctactcacccgtggctgctaccttcctctctacca

SEQ ID NO: 16105 - DNA, 52992 bp, Human
agaccttgttgggacaccaaggagccggcgtcggttgcttaacttggatgcggtgcctgacctagagggaggcgaaagggttgtgagcgtgacatgactggtgacctacaccgagaagctgaagggtctcttaagctctgcggccggaagccatctgcttctgcggtttatacaatagcaactttatcagaggttacttttctgcacgctagcgtatgacattaatttgtcttcctgattcatcaaagggaatttccgttgcagttggtgatgcagtgggcctctcccatttcttttttcttttcatccattacaatcaaggaacgatttgcaagaacatcctttacccctggaaaataaggcatccagggctaaaagtcccaaaagaaagaagctggaaacaagatctggggatccaattttaaatttcacattaatcattcagttaaactgtagacaagtgctgaagtacatttttccttccagtactttgactcagataccacttcatattagacaaatgttttatattctctactgagtattttccattttcatagggctaatgtcattttcagttgtaataatcgattggcatagtgtcaatggaaattttttaagattgagtttgtagtgagcagacttttggaaggaacagtgctgacatccaatggatgctcaaagtaatacagaggaggaatctcctttcaaaaaaaaatgtacagacagtggaatggagaatgaattattccctaaaaaaaaaaagccactgtgggctggatgtggtagctcacccccggaatcccagcgcttttggatgccaaagtgggaggatcccttgagcccagaacttccagaccagcctgggcaacatagggagaccaccctctacataaaaaataaaaataaagcttttaagctaacctggtggcgtgatgggatgcacctctggtcccagctactccagaagctgagaagggcaaatcgcttgagttcaggagttcgagttggaggttacactgaactatgatagtacctttgcacgccagcctgggtgacagagagcttgtcttaaaaaaagtaaagaaggctacggtgttgtagaggaaagatcccagactttgcaattatagtaagtagcaaagctaccaattaattatcttagcaagttgctattacatgaacctatttcaccattggtaaaaagggggaaaaaatctatttcacagggccataattatagttccttacgtattgcttttttatagtaggccttttgtaaatgtttaattcaaggtgaataaatcacagtggtaaaaaaggtgaagagttaacctcagtgttactttccaaagaaattgctataaggcagtgtatctaggcagggattatgcttaattgagatgcacacagtttaacatctggtgtcaaacctggcttccttctttgtgaccaccctatagatgtttgcttttgggaccactgagtaaaccaggccctgagaatccaagcatgaatccacttctgccctacttttaaggatttacgttccatgcaggaaagcagataaccataatttctgaataaataagacaacaaaatgaaatggatgctggtcaactctgatgcaaattttaagaaggagactatgcctctgtgtctcccagcttcacagaaaaaaaaaaaagaaaaaagaaagatgctcagagtggggtacctacacttggaaaaaacgcaagtataagtctgccattcccatgaatccaagatgaatcctggcacagagtaggtcctcaaattttgcaaaattaattttgaatctttatcaccctggccaatgcactgccataatgcaaatcttactatctacctttctatgtcagtcacatttttaaaactgtgtaacctatgaaaaaaaaaaaaaagctcaccaaatcaaaagagaggaagtgctaagcaaatacaggaaccaaaaaggtttatagaggctgccttatgctgtctcatccagttcctttgcggtcctcttcttcagcacatgccaaagctgttcctcacggcctgtgagacaagagcatcttggatgtaggacaatggaagagttaggtgagtgaggagcctgaggagaaactctgagggagtgaagacttggctgccatctccttgtgtggtggggtatacttctggctagactgagggtagtaatggaagattttattttcacttctttcctgtcctcagccctgccaagagtgaagcatgaggaactatgattgttttggggaactatgggttcactgtttgcagtggcaaaatagatggagagtttggtgctaaccgcggaataaactcttggcaaatacttttggactggattgttactgcagttgttgtcttgttatgggcgttttgccctttggaggtcactggagatcaagggtggccacatagcgagacaatgcagagatatgatttgaggaggaaaagaaagagcaaaaagggaattggggtgttatgaggaagaaaagacggactagaagtataagaatgagggatctgtagaggttggaaaaaggccagagtggtttcatttgttccatgttttagtattaaatcaagaaggcatagcactctaactctagtgattttgttgctaagctttttattcagaagaattctgaaggaagagattactagggcctgaaaatatgacacctccttccactctaagacaattaaaaccagcagtggaactattaaccatattaaccagagaaatcctggatttcaaacctttggagtaatgtaaggtttgtcattcttgggactcattccatagcctttgccaacatctgttgccagcatcttaactaacactgagtcactaaactatacccaatttccaaactgtattaattccacagtgtcctggtttggggtgtgtttggggatagggtatgtcaaaagtgcaaaaaacaacaacaaaaaatatcttgcacattgttacattgtcttaaaaaaaatggcgtgtgatttcaaagctggagaaacagaggaaaagtaaagggcaaattaccaggaggcaagagatgttaatgaagagaaaaaggtagtgtttaataaatatcaaactgctttggaggtaaagtctattttgatattgggccagactcttttttggacttggggtagaattctatttcttatcctacgtgagtgctgggagaatgtgaatttctgcttgagttctagtagtgctagggccttttttctttttctctttcttttttttgggggggatggaggggacaccgaaaggctttcatggcaaataattcaaaaggaaactaatacttatttagtaaatcaagcaaaaactagacatttttacatatgttaatcattttagtgtctgcagcaaccctctgaaataggtgttatccacttctttttcagatgagaaaactaagaaaaacaaaataactttttcaatgtcactgtcgggaacacctgacaccaaaactaagcaacaaggtgctctcctattttagaagtttattggttctggtgtctgtccaatgaagtaacccagatttaacagaaacttatattgttttgcatctcctgagcaggctaaatgttaggtaaatcttgtctggaaatacagaaagtaccaagtagcctggaagctaatatttgtgcagattatccagttggctacgtctccacaggctgttgatggctacacttcaacagtttcttcaaattgtcatcagcccagtaactacccttgagacttggtgtggatctttcttcctgctggcagagaaatggcatcgaggacaggttggctcaagtgagcaaatatttcctgtctgcagtggtgcctcagaggctagcagcttgtatacacccagaaggttttacctaaaccctcattacgtaggcattaggcatgatagataaagaggaaccaggagcagattctgcctccgaatgaaatccatgcaaccctcagagactcccaagagacctcactttactcctttcatgttaatattgatattatttcatctccacagtaaaagactacagagaagaattatggagtcttcagtctagtccccacttcccccgcccccactctccaggaatcccatatttgtcatactgaaattagtcatcttcaaattacaaaatctggcaaaaggcataataacctcacagtgttggtgatatgcacactcatatgaaacaggaagagaaaagcctataactcatgacccagaaagaagggttttgataactttggttagctggtgcttctgagggcaacttcctactctttgtggtatggtttcttctctcttataatctttattgtaaatggctttttattttgagctcaggaggatctttggcttctagttagagcaaagcttagaaaatagaaaagaaaggggctctagcataattgaaagatgtagaataaaaattcaaaattctcaaatttggtgtggggtctggctaataaaaatctgaggcaaaaagttttctttctttttctaccttagttttcttttctttttctttcttttcttttctttttttttttttttgagacggagttttgctcttgttgcccaggctggagtgcaatggcacggtctcggctcaccgcaacctctgcttcccaggttcaagcgtttcgcctgcctcagccttcctgagtagctgggattgcagacatgtgccgccatgcctggctaattttgtgtttttagtagagacgggttttctccatgttggtcaggctggtctcgaactcccaacctcaggcgatccgcccgcctcggcctctcaaagtgctgggatttacaggcatgagccaccatgcccggcctatttgtccttctttttaaaaaacttctattataaagaaatttaagtatgcaaaagtagagaaaatagtttaatgaattctgatatacccatcaaccagttgaaacaatcagttcttcatcagtcttacttcatatatatgcccacccattcctttcacccctgtaattatgttaaaacaatttcagatgtcattttatctgtaactattttaacactgacctctaaaataaatatatatttatacatataactgtaatgccattgccataacaacagccttaatattaattccttaatattgtaaaataccattatcacacctaaaaacttaacagaattaattaatattattaaatatcattatcacacctaaaataaacagtacttacttgatattatttaatatccagtcagtgttcaatagtcttgattgtttcatttttacagtagatttaatgatccaaataaagttcatacactgaaatttattataagtctctcaactttttaatgccatagggtcccactcatctcttttttcccattacagttattcatttgcccgagagtttagttcagtttgcttatctctaaaatggtacataaaagtcaacatttttgataaatggatgattatgaaagatctgtatatttcatttgttaaaaaaaaaaggattagatctcttctaacgccattaagaaatattcattcctccaaaatctaaaataaatgaaaaatctgttttttttttaatgacctgtgaagtttattttccttatctgagaactttagatgtaggcaggtccttagaaataatgtaattatgtgtttaaagtttgaaagctaaaatctgtggtaagaagtccgctagagatccactaatgcattattgagccataatttgaaaaatactgttctaatcaaattgccttgttatgtagatgaggaaactgcatcagagaaggatgtgacatgctcaaggtaacccagagaatatatataagacaggagactggaacttctaacttttagttaatgcaggggctagggatcagatagcccagattcaagtcctggttctgcattcatgcgcttaagcaaattatttttgtctctttcttgtgatctacaaaataaggacaataatatcatctgcctcaaagtgttaggatgattaaatgaaatgtgtaaactcctgagcacagtgcctggcatgtgttaatttttattaattattatttatttcattgtaacagatagatactagtatataatacttttccaaaaaaaaaaaaagaaaaaaaactgaaagagtaacaaatcccaactatttaaattgcaacatcttacttgattttgcaatatctcagttttatccccaaccattttttctctccacaccctaaaagacaggatacttataccttgctttgaaaattttgttacgtgctcaggataattgttaagatttaagaaaaaatatcattaggattaagaataagtgttatttccctcgtatgttttgaaaaatggtaatataattgcttctatttttctgatagaaaaaagcatttaggatttatttatttatttatttatttatttatttatttattttttgagacagggtatcactcctttggcccaggctgctggagtgtggtggcgtgatctcgactcatcgcaggctcacctaggctcaggtgatcctcccacctcagcctcccaagtagctgggaccacaggtgtgcatcaccatgctgggctgacttttttgtatttttcatacagactggattttgctatgttgccctggtctggaactcctaggctcaagggatcctcccgcctcagccttccaaagtgctaagattatgggcataagccactatacccagcccagttttatttttttctaattaaggatatttgtggggaatctaccctaaatgaatgatgaaaattaatacctgtggtataaaaaatcaaattatagcatgagactatgaaattgaatgcaaccatagaaaataagaaacaaaccacaatttatggaggtgttaaacatttcttggtaggattcaccacattcttgaagtgaaataaggaataagggaaagtatttgaaaatagccataattgaagaaaaggagatgaatgtgggcacagtgaagatatttaaggagaaaatgactgtagggatttaaatattctctgtcatgattctcttgcttcttatggtgtagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggtaaattttcatttattatagtccttaaacatggatgtttgagtgcatttctgaaaattaacagaatcccacataaaataatatgaaaggagaataatatatccaagaaagagaaaaaataatgcctcaatgttaatctaaagatgtttttggaaagaggaagagaattgagaaaatcatcacagaggaatgagtttttgagaactaaattttttttattttttttattttttttattttttttttattttttgagacagagtcacactctgtctccaaggctggagtgcagtggcacaatctcggctcactgcaaccttcacctcccaggttcaagcgattctcctgcttcagcctcccaaatagctaggattacaggcacgcaccaccatgcccagctaatttttgtatttttagtagagacgggttttgtcatgttggccaggctggtctcaaactcctgacctgaggtgattcacccgccttggcctcccaaattgctgggattacaggcatgagccatcacgcccagccgagaactacattttttctaatgagcacatggtcacaggcagagtattgcattcactggggatattctgatgttactgtgggggcatcagagatgcctgttgcagtttgactggaatggtactcaggccagagatcacctgaggaaggccaggtggcagcatagacaagtcttctcagggtgactttttagggtcactacttcccaggtcttattttctgctgaatagattaggagattcaattattagtttatatagagatgatgaagctctagggaaccaactcaaactaaccaaattgacaagtgattatatatatattttaaaaacctagggcaggtgcagtggctcaggcctgtaatttcagcactttggaaggctgaggcggggggatcacttgaagccaggagtttgagaccagcctgggccatatggtgagacccccatctctacgaaaaattaaaaaatgagcagggtgtggtggtgcgtgcctatggtccccgccactcaggtggctgaagcaggaggattgcttaagcccaggtggtcgaggctgcagtgagctatgattgcgccactccatcccagcctgggcgacagaatgagagcttgtctcaaaaaacaaacaaacaaaaaaaaaacaaaactcagaaatcaaatttacagttaaagctatcaagtaaaacagctatatttactcatatatgcattctcttcctatggataagtctatatggacgtacattataattaaaaggttgcttgatgagaatggaattagtgtaagatgaattaagtagatgctcttcatagctggtaattttgtactatgatattttgattcatcattgttccctgtatgaaatagccagaagcacagacctgaaatttgagctcaggggtagtttacgccctaactgttcttttctccagacacatacacaattttaacgatacgaatttatctctctactagggaactattgtctttgttctcagtgttagattatagctgtaggctcctaagtggtctcctgccctttgccccactgcagtctgttctcaagcagccagggtcacctttaaaaactaaagtcagaccctgtcattcttctactcaaaaccccaaaatgactcccatctcatttggagtaaaagccatagtttcatgttgatctttctggggtgaccatatatcctggtttacctgaaagagtcctgggtttatgcttgtttttctcacatcctattaactttactttttaccccagatcttcaattttatttaaagttttcttatcagtatttgcattaagtaagccactatggcttaacagacctccttccagcttcttccatggtctcatctagcagcgtatgaaacacatattcagtgaacagtgctcttttttttttttttgagatggagtctctttctgtcgtgcaggctggagtgcagtggtgcaatcttggctcactgccacctctgcctcccaggttcaagtgattctcctgcctcagcctcctgagtatctgggactacaggcatgcaccaccatgcgcagctaatttttgtatttttagtagagacaggatttcaccatgttgactaggctggtcttgtactcctgacctcaggtgatttgcctgcctcagcttcccaaagtgctgggattacaagcacgagccactgtccccagccaaattctgacttaattatggttaaatgcaaaagatggctaatgataacttgtcttttttcttgattctgttcagatgaaacctagctagcagcaacctttcaagaattatatgcagggtgctgcctgttaaagctaagagctcaagcacaagtacctcttctgatcttaggtggtagcagaagaatttctgaggcttttccccctgctggccactttgtgaaccaccactcatgccctcatgtggtcgtgtggtgggtggcctgtgagatgcgtggaacctcctcagagtcagtagaaaatgggagaaattgtggcttaatgtcatacaaattatgtttaggaaatagaggctaagtaattttgccatagagtatagtgtaacctaattgttttattaaagcagttttgttattatttgtatatgtgaagctctatttgttttattatatggtaatgccttttgaattttacaataaaccctttcagcagttagctcaaaacaaaacccacatgtttaattgtctcaagaaagctgataatgaatatgcaacgtgcagaaaatatttttcaatatttaccatgtaccatgcaggcaagtagaaagatcactatccctttgaaaaccagaaggtacaaatatggtgaagcagctttggcatctatttccaaagttaataatttaagaagaatatgccttaaaatgacttcaacacggcagctgcaggaggcctatgtacatgtcattgtgaagcacaccttcccattagtatcaaataactcataaattaattttgctcattttcaattccaagttttcttgtacttgtaagtaaactggtaataattaatgagtgattttcctttgcaaaccttcaaataatgttttttataataatttccttagaggtctcaattcaaaaatgtattaattctgaaatgtttcaattttgttttttatctaattcaaacaatcaaaataaaatatgtgaaaatttatttcctagtcaaaaagtgaaacatctgacattgttaatgccactgtaaatttagttgaaaagctcaacattgaaggtaaactgttgtttttgttgtaagaatatgaatacaaatgttaatagagcacagcattgtgttaaaaatgttcttaccaagttaacaagctatgaagcagaaatgtacttggaattggttgtaatgtgcacaaaatttgtgactgcattcaaacaagctgcggtattctgtcagtcaaaacagaaactaaaattgtcaaaatgtataaattataaatatatatatacacacacacacacacacacacagattttataagtaactgatctacaaaacttttctgacagaagctgatattgaacactaccatgcaaggaaacatttcagaatgactatatgtatattcctgtctgtgttgcatgtcatcaattggattttgggaatgcctgagcctttgaaaaaccactttgtaaagcaacccaaatttagattgcattatgttcaagaccagttggaaatttttaatcgattactgaatgaatgtagcatgaaaattcagcttttgaagcttttagcaagttacaattatgtaaaataaggcttgcaaaggaagaagctcaaatttctccctacaaaagcgaagaaggagttgaacaaatcaaaagatgaaagcagatatggtttaattatctattttgacaattgtgcttcagaaaaatcttgactttgatgtattttgacttctaattttatttggataaatttttattctctaccaaaatggagaaaaattgtgaaagtctatgattttgcagtatctagatttggtgaaatgttgaaacaatcacagatatagacaacttgaaagttttatcttgtaagaaattattgagcaaaagtgctttgaatgaaggtagaaagacagcacctatgacgatattggcctgaaatatttacatattttaatctaaaaaatgagaagattcttcatttagcagaacttacaggttcatcagtatctagagaggaaatgtgttctcagttaaaaacatatagtgaagcatcaattaaagttgtccataatttcaaatatattaaccataaaatgaagttttgaaaaagattgcagttttataaaaaaataactgtttaaataaaaaacgaaaaaaaacacatgttcctgaaaaatgtccacatcccaatgctagagacaataatatctaaataaccaattaaggtatgtgaatacatataaagaataattgtctgtaccattaaaaatgttcagataatcaattttttgttgttgttgagacagagtgtcactctgttgcccaggctggagttcagtggcatgatcttggctcgctgcaacctccgcctcctgggttcaagcaattctcctgtctcagcctcccgagtagctgggactacaggcacccaccaccatacctggcaaatttttttgtatttttagtagagacagggtttcaccatgtctggtcacatgacaccaggctggtctcaaattctcctgacctcaaatgatgcacgtgcctcagcctcccaaagtgctgggatgataggcgttagccactgtgcctggccaatatttttttaaagttgcttgaatgttcataactttgtatcactatcactttaagatatttcaggaaatttttattttgaaaataaattttggatagaattatcttataggtccaccaatataataagaccaaattcaggtcaataaacacattttttttttttttgagaccgagtctcgctctgtcacccaggctggagtgcagtggcatgatctcagctcactgcaatctctgcctcccgggttcaagcaattctccaagcctcagcctcctgagtagctgggattacaggcacgcaacaccactcccagctaaatttttatagttttagtagagatggggtttcaccatgttagccgtgatgatctcgatctcctgacctcgtgatccgcctgcctcagccacccaaagtactgggattacgggcgtgagccaccacgcccgtccaataaacacatattttaaaaatgatacaagctcgtgacccgtctgcctcggctgcccaaagtactgggattacgggcatgagccaccatgcctggccaataaacacatattttaaaaatgatacaatatgacttatttttggaacccattttctttctaaaaaataccccattctgaacgtttggtgatgtggccacctcatctgtatgatctggcccctttacttgctgtccctgtgtccttggttcactctgctcaggccacactctccttctcgtggttccacagatgctccaggtggttttcctgctggcctttccacctgaatcatatgaccccagatatttgctttctttccccacctcctatataagtccttgctcaagcgttctcttctcagtgagtccttccctgatcagtatatttataattgctgtctctccccacttcccatcctctatgcagaatattacttttacataccaatttctttattatttgtttcacagcaccagaatgtaagcttcagggcttacagtttttatttgatttttttgctttttgactgctacatcctcagccctggcacatgacaggccctcaatacatatttgttcaattaataaatgaattgccagccaaccatcttttagattcacatgttatttcttttcatatgtcaagtttaataacattatagtctcctcctaggcaccatcctgtttagttaaaggggcttagctctgacccattttatttgatttatggttcttatctaaggaggatcaacttctctatttgggtggtttttaggcaaggaggggctgctagtgtttgttcacatgccaactactctgtttagaatttggcttttctttgtgggatggctggtaattcctctggcttgtgaaagaagagctcatagatatgccacttgtcagtcccctttaaaagctacaaacatctattaactgtgggtatcattaagcctcaacattctgataacaaaaatttattctttgctcttctcttgtcacttatatatcttaggcgcagctcgtgtatactaccaatatccaggagctcaatgtctacaggtatttttttttctattaaatgcttttaaaaattaaagttagtagataattgttatcaatctttgtttgggtgataatttgctttgcaagtgtttattattagaactcgtatatcatcctcctctttccatagtctttgagcataggtagaattctgtgaagctgacttgacaacttctcaaggtgcctggcttctggaagggttgtctaggctagtgggccctgctatgtccattaccacctaaagaagtgtaaatactcccagagttaccacagatgttttgtccacgctattccagatgttatgcttcagtttcctgaaagataaaacacacctgaagaaacttcagcaagattctagcaatgtcagagctaggatgagggttaaactaagacagtgggtctccatggccaactgatgagtatttactttttctttccatatttgctcaaaatttgtatagtgggtagagggatttccttttatgagaagttccatattaaaacagatacacttactaaatcatttctcctggctaaagcagaattggcagtctgaaaaaataacaagattaacttacttattctctccttagttatagcttgcaatttttaacatcagacaactttctggaaaacaaattaaagagcataaaatatagatagtaaagattcatgcttgggaaacagtgctagatcacaccttatttggtttcaggattgcagtcaatagtgcacacatgcaaggcaaaaataaggcaagaactgtgctacaagaagttttcttaaaacttccctcttaaggatgctttttactttggtgaaggtgaggccaatttattgatacatattgccagtttattctagttccaaggatgttgccagatgagaattcctcctagtccctccccagtccctgaagccccaatgaaaaataaaaacaaagcaaaacaataacaaaaagtggctggcacacaataggtcctcagtaaatatttggtttcttaaatctaggaaaccaagactccagtagaaatgcgagtgaatgcatgaacatataacatgaaaactagcccaaccaacagcctgtatatctggcactgtgattattaactgatggtgtaccaatactaacttattgacaccctcttcctcatagtatgggcctctctggcctatttcccatgatttcctccttctcttgctctgtattccaggggagctgaccccttgggttttccaggctccaggatcagttggtcctcactgtcttcaaccaatgggaggcactgtggaaagactgcagggtaaaaagcagtgaaatccagggcatttccccccccaagtcgctctatttccacaggatctctgtcagcagctttatcttctttatgacttcagctggagcacaacaggtctgctgtggtttcaccttctgcctgttgacttgggcccctagctctggtaacttctcctcttttctttttccctttggcttaggggtagtagtgacttctgggttattcagtgtcttctgttttgcttcttagctctcccctcacctgtgtaatcaggtttctggtctaaactctgtgtactcatgtggtttgtgttttcctgactggcctttgatgtacttcctattactgaatgatacttgctgtgtagccaggcctctgtgggagagtgacataaaatccaggtgacctagtaaatatgtaatagatagatgcacatccctgagactagtatcactctgagctggcaaggctagcatataaatagaatattagacacacaaactagattcctgcattctgtttctactatttactctggcttgcttaaatgaactaaatattgcttttaacataccttcaaagtattttcaatactagctctgaatataacaatgcaataacatttctagtatagttatatatcaatagcaacatgagcaataatttagaaatgtatcttttacataaacaaaaataattctggtaataatcgagaggaataagtcataaaaatataacagagaaataagtaggggaaaaaaacccagcacaatgaagccccttgcttaagtctggattcttttagatgcatctcttgtgatatgtgttactgaaatctctgagcagtgaagtaagttgctgctgatgacatagccaagcatctttactatcttcaaaaggtcagggaacaaatcaaaggttcttctcttttcaggaacatttcctgcagtgggcactttaatttgtaatcattaactcttcaaggtctctcatttcttatgtagaattttatactgttgactcaataactgttggagtattataacaatgatctatttccctttctacactgcactaggactctagttaaaaaccagtgggaattctttgaataagcacaaatttgccccaactgtgagattggaaggttttttaggaatatacaagccctgctaagaaactgcatttgttctgcatttgggcatagggcagcagaatgtgttcacagtcctgctgccttttgtattcccaaggcatttgcctgtggcagcagctacgaaaggattatgactgatcgagctgtgagaaaaagctccagtgtaccttctgggaaacatccacaatggattgaatcaattacttgcatacttgaccggttttgctctcagattaaaacaaaaaatcttgcatctagtagagggccatgttgtacctaaaagataaatcttttatcttaagagatatccattttcctcttatattttccttgttgttaagtgatcaaaaataagtggacatgagatatgtcgtatccaaaagatagtcttttcttcttaagagagaaaagtatcaacttttcttctactttttttctggttggtaactacataaagataagtagtaaatgtatgttttcatttttgaaaatatattaagtgaaagacagaacatttacttttatttatgactttgcatctttgtgcagagagagagagagaaaaggcttgagtagtcgtgagacagagggttttggtttggtgggttgttagctaagctctgttgattaatgttgattacaaacatgattccacagtcagttacctttttataccttttggcccggtgatttcccttcttaaaatttaactcttatgtaaatgatcaaacatgggtgcaaatatttgtttggcagtattgattataataatgaaagttagaaaacaatctaggtgtccagcaataaattattagtttgataaattatataatacattatctatttgaaaatatatagcctttaaacattattttggcagataattcaggacacacagcacaaactttgcagtttgcaggcccaagctctttgttacttgccaactgtattatgtacaaaaaagtttttaacttctctaagccccagtttttcatttggaggtgataatacctagctcttaaggttgttattataaaagatttaaagagaacctgtgtaaagctctgtatagagtgtcaggcatagtgcagacagacattcaataaatgctacctattatggttgcagaagatagaaaaatgtttgcataagagtaggaaaaatgtataattttagttttctaaaattacacacaatcatagttaagtgtaatggtatcagccaaaatgtccagagtaaatgcctcctgaaaaggggattatatgtgtttaaaattttttctgtatatttctctgcagttttcaaattttctacacttaacatgtgttaattttatattttagaacaattttaaatagaaagctctacactgtgactatatttatgtactttactgaagattgtttgtagaaccattgtgtgtgtatgtgtgtgtataataactgagatatacaggtgaattgcattactgatgtctcatctgacacctccaccacttcatctgttggccatgtgtgttagctattttcctagtatagatgacctgtgttttgttttgttttaaaaatataacttaagatacaaaactatttcataaactcatgtgcgtaaaaagtcgaagaatttggaaatgtatacatagggtgaaaattgagaccactcctcttagagtctttcctctcaccaactcattaccagctccacaggtaactgctgtcaggttcttctccttacagacttatgtgtgtgcatattcatacttatgtacatgtgcttataaatttatataaatggaagtaaatttttttcttttttaaatttgagatagggtctgtctctattgcccaggatggagaacagtggtgttatcttggctcactgcagccttgacctcctgggctcaagttattttctcatctcagcctcccaagtagctgggaccacaggcatgtgccaccacacccagctaatttttaaaattttcatagagatggagtctccctatgtttcccaggctggtcttgaactcctgggctcaagcagtcctcctacctcagcctcctgaagtgctaggattacaggcatgagtgactgcaccaggctggaagtataattttcgtattgttctgggcttttcttttttacactaacaatgtttgttggaagtcttttttagttcacttaaatctatgtctgcttagcagttgcatgttattctatagcatggatgaaccattatttattttactttagctccattggtttatttccaatttgctcatagaaaatgtaccctaataaatgtccttgcacatatatttatatatatatgtccaatttttctgtaggatagattcttagtagcaaaattgctcaatcaagtggtatatgtgtctgaaatgttgatagatactgccttgcaaaagtgtttataaatttatataaccacctatggtatatataaatgtgtatgtgtatatatataaaattcatattttgccaacactgcatattatccctctgttaaaatttcaactaataggtaaatattagtatctcattgctttaaattgcaaatttaaagattaatgaggttgagggtatttttatatagtaataaacatttgagtttctttttctgaaacctgctttttaaaagaatctttagctcaggtttctatttttctaaattatttatacatttctttaaaatcttgaatattatgttttaaatatttatttatatttaagttttgtgaacttagctgtatcaatatttttttcatttttgaaatcacttcagaattttatgtccatcttaggaaaaccttcattaccccaaattgtaaaatatattcttcatttttctattatctttacatttaaaaatattgatatctatctttaatttgtctcaaatttattcatgtatttggtgtgttggggatccatatttattttgtaccaaataggttgttattctttgagtcgaatagtctgttttggatgatttgaaatgccccattgctcatataggaagttcttttaggtgcaggagcctgtttctgggttttctaatctactcctttgacctatttgtttttctttttcttcttcctttcctttcttctctttttttttttttttttttttttgacagggtctcattctgcttctgttgtccaggctggcatgcagtagtgtgatcacaactcactgcagccttggcctcctgggccaaagtgatcctcctgccccagcctcctgagtagctgagacgacagatgtgtgctaccacatctggctgatttttaaatttttgtagagacagggtctccctatgttgcccaggctggtcttaaactcctgggctcaagcagtcctcctgcctcagcttcccaaagggatcacaggtatgaacgatcgcacccagccctatcttctttaccaacatcatacaaatttaattattgttactctataagacaccacatctatcaagacaaatcttccctcctgtttttttttttctttacaacttttaatttttatagagaccaggtctctctcatgtttcccaggttgttcgcaactccaggtcccaagtgattctcttacctggacctcccaaagtgctgggaccacaggtgtgagacaccacacacccctcctattttttttttccaaaattgtcttgagtgttctatcccataaatgttaacatcatcttattaattagcttgaataattatatcagaatttttatttgaattacattgaatttacagtttaggggaaactgacataatatttatcttcatttatataggctttcttttctaaaaataaattttattgtgcatatttaaggtgtacaatattatgttatgggttatgaatagttagtaaaatggttactatagtgaggcaaattaacatatttattatctcacacagttacacatttttgtttgtttgtttttgtggcaagaacagccaaaatttactcttgcaacaggaatcctaaatacgatacaatttcattaccgatagttcttatgttgtacattagatctctaggcttgttcatcttacatatctgctacttcatattctctaacctacatgtccccattttcaccccctttcctgcctctcatcaccagtgtatctacatatttgacctttttaaatgacaaaagaggattccacctataagtgagatcatgcaatatgtttctttcttatttaacttggtataatgtccttccaattcatcaatgctatgacaaatagcagaatctcctttttttaaggctcactaatattctgttgtgtatgtgtgcatatttcacaatttctttattccattggtgtccatccattgatggacacttaagttgtttccacctcttggctattgtgaattgtgaatattgtggcaatgaacatacgagtgcagagatctttacgaagtggtaattccatttattttgtgtatgcccagaagaaggattcctgtgtcatgtggtatttctatttttaattcctttagaaacctgcatattattttctgtaatggctgtaacaatctacattcccaccaacagtgtataaaggttcttttttctccataccctggccaacatttgccatcttttgactttttgagaatagccatctgtttgtgagtggtatctcataatagtttgatttgcatttccctgatgattaatggtgttgaataccttttcatataccttttggccatttttatttcttctttggaaaaatatctattcaggtcctttgctcattgtttaattggatatgtggatcttcctttatgtctgccaatggtttttcttcatagaattcttacacatttcttgttaaacatattatttgatattttacaacttttgttagaattgtgaacaggttctttttttcgcattggattttcaaactgcttattgatgatcaataagaaagagactgtttcatttcattcttgtatctaatcaccaccctgatcttttttattcattccaatggttgttcagtcatttatcttacattttcctgggaaattattataccatctattttaaaagaaagactgaggatgtgctgcctttttttcaaatatataattctcttattttacttttaaatgtgtttgataatgtattctagaataatgttgaagattgccagtgataataggatctatgtccaacttatctcttaattagatatctgcttaataattatgaggcttgctatatatttcttatggaaacattttatcagtttatagactttttcttatttttcttgatattcaacaacaggaatggttgttaaatgtcttccacggctttttcagcacatatcattgtgtttataaagcttttctcctatttgttaatgaattatattaatctttttcctaattttgaatttcaaactatttttggataaccagtataaacaccacctagccatgacttgttaaaattttttatgttttttaaaaaaaacacatttcaactgattttatttaaccttctctcttcacacatgcacatcgttttttctttgattttaaaaagtttctgtgctatttatagaatgaattaggtaatgttccatatttttctatgtatttgggaattttatacaatgatcccccaaaaactgtcagtttttgttttatttcttgttttctgtttcactaatttatgcatttattccttctgttgaattattttagatttttctgagactcttgacttggaagttttatttatttctgatctttctcactttttaatatcacacttaagtctatttatatattttcttctcaataacatttagctttcaactcccaaaggcgtgtgtgtgtgtgtgtgtgtgcatgtgtgtgagtgtgtgtgtgtgtgtgttttcattgctatttctaactggtttgaaaattcagtttaatttttttatcccaagaattatttagaagtgctttgttttttcttaagtggatagtttttatgattaatttgtacttctattcactccaatctaagaatatggtctatatgatgtacttttaaaaatttattgagctttactttgtatcttcatacatagttaattttactaatgtttatgcagctacttgaatagaatctgtattctgtttattgggtccaaagttttatttatttataatttacttacaattatatgaatatgaaatcatcatcatatatattatctaaactttctgcaccagagatttgcaaacttgttctgtaaagaggcagatagtaagtttgttaggcttttgtggactataaagtctttgtagcaactacccaactgttcagaaaagcagctatggacagtagataaatgaatggacatggccagatttgatccaaggaccttagtttgttgatgcctgctctatattctagtttatttttattttttgacaaaaactgacaggagatataatactttttataattagatgaccagggagaaatagagaaaaaaggcagagagaacttgtttagatttttggtctagtacatattaatatatttttaaaatacccccatctctgattttagcttcatatccaggggattcattattacagttgcatttccagtactttatgtgtggtttaacattatttgagttttgatttgttcatatgacttttttgttttccctctatagtgaagcccaagagccaaaggaatcaccaccaccttctaaaacgtcagcagctgctcagttggatgagctcatggctcacctgactgagatgcaggccaaggtgagtgcaggccaaggtgagtgcaggccaaggtgagtgcagtccagatgataaacagggcccatggggtcaccagtttatctttgtggaactcagctctccattctcccacttaggaattttcctaagttgtcattgcttttttcagactaaatttaattccatgaattaacccatctttgtactatgtgttatttggacacaaaaattaatatataatacagactttgatctcaaggagctggagtgtgcttggcaaaatgaggcataagtttcttaacatttatagaataaaagccaggtgttttgcaaacatatgtggagcaaacattacggatatagagagattttggagatttaatcagagttgaaacttgggatggactctgaagaactggcagagtttggacataaagagatgggaagaaaggtggttttagttgcaatgagtcctgagggcagaggtatctaaggcttgatgatgtggaaggatttttcatttgtttgtttgtttgtttgtttgtttttgagatggagtcttgctctgttgcccaggctagagtgtagtagcgctatcttggcttactgcaacctccgcctcccaggttcaagcgatcctcctgcctcagccttccgagtagctgggattacaggtgcccaccactgtgcacggctcatttttgttgtatttttagtagagacggagtttcaccatcttggccaggctggtctcgaactcctgacttcgtgatccacctgcctcggcctcccaaagtgctgggattacaggcgtgagccactgcgcccggccaaaaggactgttaaagagacctgactaagcaggacagaggagaccagtgagcaagctgagacacagcaagggagatcaaagtatggctctgacagtaggaaggatgagaagtcccaagcccatattgagataaaatctgcctctttgttctagcctctagaacacctctaaagtggtgagctcacatagtcgggcatggaatggaaatctcagataaatgggcttaaagatttattaaaggaaatataatccagaatccttaaggtggagaatccaaccattttaaatctggttggaggatttgatatatactcatgagatgactatgaaataatttcaaagcagtatataaaaatgtatatgattggagagggcagggaccttatctttagagctcaccttgggactcccaatgctcagcacagggcctgatacatcgtgagcaacacatatttattagagagatgagtaaataaacatcacaaacaagttttccttaatgactgacatcctttgatgggccagtgtctacaataaagctgggtagattggctcattatgctgtatatctgaaaatactagaaaaaatgtacattagatttaattgtgttgcgtttctagttgatttagcttgtgtattggttgatttaaatttttaatttacaacaccatcttttttttttttttttttttttgagacagattcttactcggttacccagcctggagtgcagtggcatgatctcggctcactgcaacctccacctcctgggttcaagcgattctagtgcctcagcctcctgagtagctgtgattacaggcgtgtgccaccatgcccagctaatttttgtatttttagtagagacgaggttttgctatgttgcccagactggtctcaaacttctaagctcaggccacctgtctgcctcggcctctcaaagtactaggattacaggcatgaaccactgtgcccggccccatttatcttttgaataagctgcactttcacattgtacacaaatcaaaagtgcaaaaagcttgcactgaactgtttccttctcagctctgcaccctagccatccagttctgccccaccggagataggcagaatttcctgtctcttctatatctgttcagaagtattctggaagataacagtgaagagatagagatgtaggtgtagatgtagttatattgtatttttacttatttttcataattaatgtcagtcaccctttcagacctttcagacactaaccttctgaacactaacctcttgaatattaactaacatatattagaggaggaaggatgtctgtcagatgatcaaaatgtctcgaagcaaaatgagcattttgattggtgacagtgtgatgttataacaggcagtaaaagtaggataagtagaggtcttaaggcagacagtaacagatcacattcaggagatgaagagcccagctgtccttttacaacatagtattaataaaagatgaaattgggaaagataaaaagggaggacagtggatgggaggctttgaatgtctgtctgatgagtgaagacttgatgtggtggcaatggagagccattgtagttttctgatgagtgaagtattcagtagatagatggtagcagtcgcccagctggaaaggagtagagagagccagaatcaggttatgaggttatgaagggtcagttagccttttttttttttcttttaatttgaggatccttctttgaatggtttataataattttgggcttttgcttaaataattccaatccatcaacaagtcttatctgaccacttctcaccaccttctcctgtaatactgatctaagtcattatctgaaaatctccctgtattcactcttgcttgtcaacacttagttctccactcagctaccacagggatcctccagattccttcactcctgtgcttgaaatcctgcaatggcttccatcaccttggaataaaacccaagcgtttaccatgaggttcctatgtgatctttgcctctctctccatcaccttctcctgccgtgttcaatctcactccctctgctctagccccactgacctctttgacttttcttctaatgtgccaagttgttttattcctcggggccttccctccccctagaatgcttttcccataaatgtcaatatttctaagtcccaagtatctactcaaatattacttccttagaggggccttctttgattattacctccatctaaatcaattcttcttaccatcttgctgtgtcccttctatctctttctataacttatctctgtctgacattacaacatatatttatttatttaattatttattgtctatcgcccacagaatgcaattccatgaggccagacacttggtctgtcttatctttgctttaatccaagtgcttagagcagtgattggcacaaaccaggtattcaacaattattgccaaataaatgagtaaaagggagatgtgactaatttttgaactggggtcatcctaagatcttcaaagggtatcatcttcatgtactaaatttcctacattaagaaaagatttacaaatataaaattagtcagatttcatttggcctgaggagtttaggatgaaagggagatgaaaagatttttattggtgttgaaattttagatttttccaatgtcttgcaggaaggttggggaaaggccaagagatcagtcagtagaggtgaatttatagagtcattagaagatgccaatgagaataaaaatgaggctgattctgttcttggttcttcccttgggccaggttgcagtgagagcagatgctggcaagaagcacttaccagacaagcaggatcacaaggcctccctggactcaatgcttgggggtctcgagcaggaattgcaggaccttggcattgccacagtgcccaagggccattgtgcatcctgccagaaaccgattgctgggaaggtgagatgggctgaaattttggtcctacagccttctttgtctctctctgtctcatcaaggtttgctctttccccttatattttaagatattttagttagcattaataattactaatcacttacagtgctctggccactgagctaagtgctttacaagtatttcctcatttaatggtcacatcagcccttcaagaagaatgattgctccctttgtaaagatgaggaaactgaggactcagagacattaatggacatatccaaggcataataagaggtagaggtaagatctgaaaccaggagactgtctcctgagtttgagttcttgaccatttttctgtactgcctttactgagatgacctttctcactgctccctttgttcacacattcccagtctaaattgattgattacaattttcagctgaactcagctccaagtcacagctgcaaactcctgttctgcatcgtccttcaccgaagctatgataaaaagctttgagacctgactgcatggggcgtggaataaagtgttcaaactagaggaataaaaactgtcatttggccttttcctcttccaggggtcccttccacactaaggctacagttacaacttctctgtcatcaatgtgctatatgttgtttctgccaccccctgtggcagtgcagtggttgtgaacatttacaggctttcatcacagtgatcagtcccggaagtgggcatccttttattatcaatccataaagcacagaccacagatggccttaggtggaacctaggtctaggcctcagtgttgtataattccagggcgtgttgtctacaaggggtacaatgtgaagagtgctccctagagttgtgcaacctgtaggctgtagagcactcaactggcctcctgtgtcaggctttatttcactccacaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggatgtaagtaaatccccgctcctctccagctttcagtcactcacttagaaccagagtcatgctttacaacttctgcatcattataatatctgtgtgttccctttccagaaagtgctgacagcaatgaaccagacctggcacccagagcacttcttctgctctcactgcggagaggtgtttggtgcagaaggtatgacccgacttgagaggctgtatcccacaccccagtgggtagttataagaccagcaacacctttcctggtagtcacgggagtcctggttcctatcagtactatcaaagtgcccatttcagtactagataccatccctccctacctttctccaacatttataatttccctttaaattgattttttaaatcacagaaatacaaatgcatagtttaaaaactcaaatattacttcaagggtaatattgaaaaagccttttcttgttgaatattgaaaaagtccctttctcatctccaaatccagttctcctctccaaattattttagctgtttcttctgatatttacttattttttgttgttgttgttgtttgtttttttgagacggagtctcactgtgttgcccaggctggagtgcagtggtgcgatctctggtgcgatctccgcccactgcaacctccacctcctgggttcaagcgattctcctgcctcagcctcccaagtagctgggactacaggcacttgccaccacacccggttaatttttgtatttttagtagggacaatgtttcaccatattggccaggctggtcttgaactcctgacctcgtgatccgcccgccttggcctcccaaagtgctggcattacaggcatgaactactgcgcctggcctgcttatgtgttttaaataataactttatattgttatagattgttttatttttccagttttaaccattatgtattgactgtctaagagggaagatgaggtttagaaatgttattattaccccactcactcctaacatatttcccctcccctgttttttcaatatataattatgtcataattacaggttagatcagtattaagtgtgcatatgttgacaatcatagaatactgctcacaagtaagccatgtagcaaactgactacactagagtctggattttagagtcagacttccaggttcaaatctgggttgtggtatttgttcaagtcatttaacatctctgtaccttactttcctcatcagtaaaatagtcctaatgaaattgcctaccttatagggttgttatgaggatttagagacaatacaagcgtggtatttagaatagtgccaagcacatggaggtatagtagtgttaatattattatcacagtgtccttttggtataaattcatttttttctaaagttaacatttgaatcctttttgaaattggcttagtttttattgtacttatcactaagttatgcaacagaactgtgaaattcttttcaaaatggccaactacatctggcaacaagtcagtttctttcttttcttttttttttttctggagatatccctccaggagactttcctcctcctgattcaacatgaaatgatttcttcctgctgagtagcagtcattctggttcattaacttagaattatatctagtaattactcttggaaattccttttattagtttcctctttggatgctctgtttcctgggtcccatgtctatgttttatacatgttaccacctttattttggtggggatcatcccctagtagctttctgagaaagaatttttgagaacttgaatatctgaaaatatttttattctgtcattgcccttaagttgcctgggcatagaattctaagtggaaactattttccttcataattctgaagacattgcttcactgtcttctagcttccatgattggcaagtttttattaaattttttttatccttgatcctttctacatgacccattcttccccctttgtatgtttgtttcatgtgttttctgaattgtcttgttttttttaatttctcctttttatgtttgttttgaacaaatatggaatcagaaagctgctttactttgtttttctcctgtccttttagaatgaactcagtggggaaggatttctcctctcataaataaaagcttgtgcagtcctctgtcttttctgattactgttaaaaaacagttctaaatataaaatcaatttaagaaacaaaacacaaaaactaagccattaggtaattcagtctgtgtaatagttaaggcttccagcactttaaaagtgacagccactccctctcttttttaggaccttcaagctgcaggaggcgaggacaggggtatggcctttcctctctcctgacctcgctttgttatctaccaccctcacccttattgccagccttgacacctgcctgctctagggttgaaacactagggaggatggagatgagaatagaaggcaggaaggtctaacttgtctaggattgttgttaaattggctttatgctctccaggctcagccagtgtttagctctgacttttttccctgaattcttttcgggattaagacaggtccagcagtgaactcttgattgccctttacgtgtcttgactagctattctctccttgtcatgtttctttgaggatttgttttgtaaagattcttttttcaaggggctttcattgttccctcctagtgaacccttagaaattattaacatcgttccagataatctcttcctctcatattttcatagaaggaccatggataacttactcttttctctgacagccagtggagttataatttttagctgcatgtttctattcagctgccataggctctttcagccagactcatctatggactttttccaggggtaactctgataccactaactgcatctcactaatgccaaggcacacatatccaactctctgagtcgtcccagtgaagtccctcttttaacctgaggttatcaagaactatacctcatctttcttggtggtgatggggcactcatagcacagttttcttcaaaggaatccttctctcagttttcctttttctttacctgttttctcctgaacaagagtgaggaattccagaattgtacaagtaatctttgactacctgtttggagggatgttttgcagttcaatttggaatttgatatatattacatcttggtgccttacatttgtttacactggtctttcccaatactgctgatccatggttgtctgttactatttaagaatgagacactaaaatgctaattgcaaactccatggatatagacagaaattgttgactggtagacttgactatatggtactcaggtaagatactctggccattttgttgagtgactcctgaatatgacaatcttaggtcttttctgttgagtcaattatgctaaagagatgttctctttgccagaattctgagattgaaaaaggggatgggggaatgggcttttcaccattcagcatgtcaacttttacttaattcccatttttcagtagagagcttgactcgtttcctcatggtgtccaacatctctgatcactgagactctcttgttcaatatttacagaaataatcattgcatcttacggtaagataaggcatctaactttctaatggttctttagactttcaaccagtcctgtttctagccttgaagagtatctcatgcattcagttcctgagcccctctgatgttatcatattcaagatggcttgatttttattggcctctcccatctgtggagacgtaagttccagttttcttatttatgttaagccaggtaccactcttaaaatctactttaaattcttgaaaatttagttaatatctcatctggtggcatatcctttacttttttctctttccttatggctctttataatttacataatttcttaactgtcatgttaatgatgtttcaggagggagtaaagaaaatcccatgtgtttaggcccttttactaatatggagactttcctaaatatcaggcatattattatgtatatggttaaaaataatttatatgatgccatcacagtctgtgagagcaagtttattcaacattttacctagttatagatgagtctcaggtaggtaaagtgattttcttaaagtcacacagttagaaagttgaagaggcaagatttcaacttgggtatcatttctgcaagttccatgttttttataaaacatcacaactgccttttgactgaaattcaattcctcttcggctgttggatctctttacttttgtggtaccaacacgatatgctttatttgacaatagacccagatacagtggtgctgacagaatccactagcaaagtgctctgtagtaatttgcttgttcactggagcttgctcaatgctttttcacaaatcattaggtatttcatttctagatggtattttacctaagcagcatttttcattgacacttaatccaaatcatcttaaattgtgtcacaataaatttatattgtactggtagccataaaagtctgagaattagttgagtacaacagtcaacaagtgaatactgcctatggatcattatgatggagaagttgcctgaaagcagaacaacaggacataggcacatttcaggtagagacataagttagatacacacacaaaaaaatacccaatccataggatgaccagaaagcaccattaaggtagctagttctcattttcttgactcaggccccttctaaacagacagggctgatggggtcatttatggctttatataaacaggaaacaacacttaaaacatatttatacatagagccacatgacaaaaagtgacatttattgatcagaagctccacttgggttgtattttcctttttatgcctggctttctgtaaaaaggtctcctgccatatgatcagttcattaattaggtgtcatcctgcctcaccccaagttagatagtcacaaagagtttctataatgacagtttaacctctgagcctcctgggaaattaaattcatctgcattttttcatcagttcaaagaattcctctttaaggctcaagtcattggtccttggcatcctcccacagggatgagctcttcaatgtctacctgtgtttctttttaattgttcattatccaggtcatgcaggtgctccctaatttcccctgtggctaagagcctcaccagagtataaacactctccctctttttgtggcacttttaattgtcagtatttctcattcttcctctagaggtaattggtcccaaagagatcctccaagaaagcaagagctgaaactttcttaatttattagattatgaaatgcaggggtatcacagcaagtttgggtgattgcttttgatttctttcctgagatttacccaagttgaaacagaggctgttactcccctgctatcccactctcgaaaccagctgtccagcagatgcctagatgagggtcatttctcagatagttggcatgtcttacagttttctcaagtaatgcctacctataggcaagctcagttttgtgtcatttgctttatgcagcatcagcatcacctggggacttgttagaaatgcaaaatcttgggccccatcccagacccattgaatcaaaaactcagggtggaagacccagcaatctgcattttatcaagttcccagatgaataatgcacactaaagtttgagaaacactattatgctacacaaaattgagacaggtggttgcaggtatttgtttttcttaaatagtaggacttacggtattcagtttcccttgaatagaccctagacatcatttgacagagtaaataaaaagtaaagtgagctcttctgtgtctcaggggtttagaggaagaacacaggacagcatataaaattactagtttagattcagatctgtaggcctcaaaattctgctaaattgtctgctttttaaagaaagcaaagttgaacaaagcaaggcatgtgaaaaagtgatgaggtaatggaaaaactgcagctatatggtttgggtcccaacacctagctgcttctattgtcatgttgtgatctggctgctattatcaaagctgatttctagaaatagtgttttctagatagtctgctttacagaacactgtgcatgctttgcttacatgctgtcttagtggggaagaggtagaactctcatatttacaaaattattgggctatttgtgctcagctgatactgtcagttcccacagagatgtcaaagtcaggatgcatttaagttagaggtataacattgaagttaggctttgaagttaggcctagatttcaatctcagctcctctactgactagtcaggtgtaaattctctaagctgtctttttgcatttgttaaatgaggctaaagcctacttcagaagtttgctctgaaaaaatctcattttaatttagtactgtagacagagccttcagtggaaccagtacaatgcagatgatccataaatgggattgctgataatatagtcttcattttaggtgtctctctaagtaaatactaaggagggattcttacgtaaaagttaatctatttatgcatattctagtcaatgctgaagtgagactctaaattgcaatatactcgggagcagatgatctcaattttgctattgtaatatttttcttatgtcagctcattcaatagatatttattgagcaactactatatatgtgtcaagcattattcaaagtactagggatatagtgacaaaaaggaaagttcttgccctcatgattaatgtattctggtggaggagacaaacagtaatcaaactagccaactaactacgacctactctgcatggcaagagagagagtgattaggtagtatttgagacacagtggttgagtcacttgttctcttaagcagacccctgaggtaagcaaaggactaagccatttgggtatctcagggaagtgagtttcaaaacagagcaaatatatcacttgaataagtgcttaaggattaattagttaattttgttgtaagtgtaaagacaataaaaagaccttgcagaaacgtttgtttttaacttattaccctattaacctaaagcaatacagaaaacttttcctaccaatgtttttctacatttattcatgtatgtgtgcacacataagttattgtgtgcctaaaattctttttttatacttaagcatttctccatgttgtttcatcataatttcataatagttttataataattttaacattatcaattattccattagggatttatgtaaataaacaaaaaataaaatgctatatgcctaaagattttcactgaagcattattatagttccaaacattggaaacaactaaatgtattaacaatagtatcatatttagattacttctggtgtttagtagtactataataaatatcattaaacataatgttttcttcttctgaattatttgtattaattaattcctaggacttagatgtctacatcttttttaaaaaaaaccttgatgtagattatcaagtgactctccaaaagaataatacagttaatattattaccaggaatatatgaatatatggatcattccatatatcttccagtattgagtatatttatttaacactgtttttactacttagctaaaattagaaattcaactactaattagcaaaaattacaacttcattgttttcttttgagtttcctgacttatagtgtccaacatattattattttttttcttttctatttttattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtcctcagagtgtgacgttccccttcctgtgtccatgtgttctcattgttcaattcccatctgtgagtgagaacatgcggtgtttggttttttgtccttgagatagtttactgagaatgatgatttccaatttcatccatgtccctacaaaggacatgaactcaccattttttatggctgcacagtatttcatggtgtatttgtgccacattttcttaatccagtctatcattgttggacatttgggttggttccaagtctttgctattgtgaataatgccagaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttccatgtgtcttttgcctgcataaatgtcttcttttgagaagtgtctgttcatatcctttgcccactttttgatggggttgtttgtttttttgttgtaaatttgtttgagttcattgtagattctggatattagccctttgtcacatgagtaggttgtgaaaattttctcccattttgtaagttgcctgttcactctgatggtagtttcttttgctgtgcagaagctccttagtttaattagatcccatttgtctattttggcttttgttgccattgctttttttgttttagacatgaagtccttgcccatgcctgtgtcctgaatggtaatgcctaggttttcttctagggtttttatggttttaggtctaacatgtaagtctttaatccatcttgaattaatttttgtataaggtgtaaggaagggatccagtttcagctttttacatatgactagccagttttcccagcaccatttattaaatggggaatccttccccattgcttgtttttgtcaggtttgtcaaagatcagatagttgaaaagtatttattttgcggctattcgttgatttgtgaggtgcacttgttttaaaaggttttaaaaagcaatcaccgtgagtttctcattctcagtgtagctccattacctggacatgggatcagtaagactcaagccaagaattttctaatatgtgtcttaacagtgaaaatttcatgtattaaagagaaagttcttatacctcaacaaattgctttttaaatgtttttattatagtacagtctaaacataaatgtgcttccttacctagcttcagtaagtataagtgttttgccaaatggattcctctattaaccttcacccatccatccacattttttcttgctggaatattaagaagcaagtttagaagtcatgtaatctcatcattaaatacttcggcatgcatcacttttagctgagaaggtctttttaaaaactacctttatgcttaacaaattaagaatttcttattatcatttacaattcctattcagatttctaagaaaatatcacaggcttggtttgcttgaatcaggatctcagcaaggtcagtgcattgcattttgctgttttgtctctcaaatttaaaaaattctattattagtcctctctttgctgcttttttatactatttatttgttaatgaatccagaacctatatcccataaaatatcccatattctttatttgactggctgctttctcatgatactgttttttgctttactcctgcccccatttcctatattttccttaaactattagtttagacctagagatgactaggtttaggttcagttttcgggggtctggatgacaagaataggtttcaggtggtgggtgcagtatacttcttgttgaatcacatcaagaggtgtataatgactggttgaccacttttattgatactaacattgaccactaaatttaagcagtgtcatcccgatccctctattttaaagttccccattaatgacaattacctaaatccaatggaataggtagtaaaatgctgagttttctattattccttccatatttattagctgagttctacaaaaactttctatcatcagttattgggttatcttggaatatatctcatacaggaaaggtgagataagtgtttgacactttctattaataagagtaatgaattaattataagggtaatgaatgggttcattaacaatatccagtggagactaataaatttttatttttaaaaaatcattatgaactcatggagttatatatacttggtataatttgatctattgaattagtattttttaatgctcaaatttttttatctgaggtcagaggtagccccttcaatttggttactgtatctttctgatatgatcccagtaatcttcctatttccttggcacagcaagatatatcaggcctaacttgtcaactctgccacatacttggaatcatccatttctccaaaaagactgcttcattgaggatatttaaaaattagcagtgttcattatttctgggatgtcatttcttctaggtttttcagtggacagagcttcagatctactttttaaggtttttaaattttatagagacaggatctcatgctgtctcccaggctagagttcagaggtgctatcatagcttgctacagccttgaactcctggactcaagcgattctcccacatcagccttctgagtagctggcactacagatgtgtaccaccaggtctggctaattttttaaaattttttgtagagagtgggtctcactacattgcccagggcttgtctcgaactccaggcttcaaccagtcctcccgcctcagcctctcaaagttctgggattacaggcaggagccactgcgccctgatagaatctgtcattgttgttgttgttttttttaaagaaaagtaagtcatgagttcatactaatatatctgatatagtataatgatacagttttttgtttgatttgtttgattatttgtgtcttttttaatgctggaaatcttgctttccaaaggcattaatataattatttgctttattatgtaatctacctgtaataagttcaaaaaatatataaatattgtaaatgaacaaattatttttattgtgtatatatattgtattattttattgtatattttaaggtacacaacatgatattttgatatacacagtgaaatatttattacagttaggcaaattaacatatccgtcctcactcacagtaacccttttcatgtgtatatggtaagagcatcagaatctactcacagcaaatttccagtatatataaaaacagtttaagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttggcccagccaccccattactgggtatatacccaaaggactataaatcatgctgctataaagacacatgcacacgtatgtttatggcggcactattcacaatagcaaagacttggaaccaacccaaatgtccatcagtgatagactggattaagaaaatgtggcacatatacaccatggaatactgtgcagccataaaaaatgatgagttcatgtcctttgtagggacatggatgaaattggaaatcatcattctcagtaaactatcgcaaggacaaaaaaccaaacgccacatgttctcactcataggtgggaattgaacagtgagaacacatggacacaggaagaggaacatcacactctggggactgttgtggggtggggggaggggggagggatagctttaggagatatacctaatgctaaatgacgagttaatgggtgcagcacaccagcatggcacatgtatacatatgtaactaacgtgcacattgtgcacatgtaccctaaaacttaaagtataataataataaaataaaataaaatatttctttgtagcttgttttgtctttagattgcatcattaggactgtacactctgaacactatcatttaaagttacttgaatgaactatttcgtttttattattattatactttaagttctggtgtacatgtgcagaatgtgcaggtttgttacataggtatacacgtgccatggtggtttgctgcacccatcaacccatcatctacattaggtatttctcctaatgctatccctcccctagtcccctgcctccatcaggccccagtgtgtgatgttcccctccctgtggccatgtgttctcattgttcaactcccacttatgagtgagaacatgcggtgtttggttttctgttcctgtgttagtttgctgagaatgatggtttccagcttcatccatgtccctgcaaaggacatgaactcattcttttttatggctgtattttattccatggtgtatatgtgccacattttctttatccagactatcattgatgggcatttgggttggttccaagtctttgcttttgtgaatagtactgcaataagcatatgtgtgcatgtgtctttatggtagaatgatttataatgctttgggtatatacccagtaatgggattgctgagtcaaatggtattcctggttctagatccttgaggaatcaccacatagtcttccacaatggttgaactaatttacactcccaccaacagtgtaaaagcattcctatttctccatatcctctccagcatctgttgtttcctgacttttaatgatcgcctttctaactggcgtgagatggtatctcattatggttttgatttgcatttctctaatgaccagtgatgatgagcttttttttttcatatgtttattggctacataaatgtcttcttttgagaagtgtgtgttcatatccttcagtcactttttgatggggttgtttttttttcttgtaaatttgtttaagttctttgtagattctagatattagccctttgtcagatggatagattgcaaaaattttctccaattttgtagattgcctgttcactctgatgatagtttattttgctgtgcagaagctctttaatttaattagatcccatttgtctattttggcttttgtagccattgcttttggtgttttagtcatgaagtctttgtctatgcctgtgtcctgaatggtattgcctaggttttcttctaggaattttatggttttaggtcttacgtttaaatctttaatccatgttgagttaatttttgtataaggtgtaaggaaggggtccagtttcagttttctgcatatggctagccagttttcccaacaccatttattaaatagggaatcctttccctgttgcttgttttttgtcaagtttgtcaaagatcagatggttgtagatgtgtggtgttatttctgaggcctttgttctgtccattgatctatatatctgttttggtaccagtaccatgctgtttttgttactgtagccttgtagtatagtttgaagtcaggtagcatgatgcctccagctttgttctttttgcttaggattgtcttggctatgcaggctctattttggttccatatgaaatttaaagtagttttttctaattctatgaagaaagtcaatggtagcttgatggggatagcattgaatgcataaattactttgggcagtatggccattttcacgatattggttcttcctatccagaagcatggaatatttttccatttgattgtgtcctgttttatttccttgaacagtggtttgtagttctccttgaataggtccttcacatcccttgtaagttgtattccaaggtatttaattctgtatagcaattgtgaatgagtttcactcatgatttcgctgtctattattggcgtataggaatgcttgtgatttttgcgcattgattttgtgtcctgagactttgctgaagttgcttatcagctttaggagattttgggctgagatgatggggttttctaaatatacaatcatgtcatctgcaaacagagacaatttgacttcctcttttcctatgtgagtaccctttatttctttctgttgcctgattgccctagtgagaacttccaacactatgttgaatatgagtggtgagagacggcatccctgtcttgtgccagttttcaaagggaatgcttccaggttttgcccattcaatatgatattggctgtgggtttgtcatagatagctcttattattttgagatacattccatcaatacctagtttattaagagattttatcatgaaggggtgttaaattttatcaaaggccttttctgtatctattgagataatcatggtttttgtcattgtttctgtttatgagatggattatgtttattgatttgtgtatgttgaaccagccttgcgtcccaggtatgaagctgacttgatcgtggcggataagctttttgttatgctgctggattcagtttgccaatattttatcgaggattttcacattgatgttcatcagggatattggcctgaagttttctttttttgttgtgtctctgccgtgttttggtattagcatgatgctggcctcataaaaatgagttagggaggattccccctttttctattgtttggaataatttcagaggcaatggtatcagctcctttttgtacctctggtagaattctgctgtgaatccacctggtcccggacttttttttggtcggtaggctattaattactgcctcaatttcagaacttgttgttggtctatccagggatctgacttcttcctggtctagacttgggagagtgtagtgtccaggaatttatccatttcttctagattttctagtttatttgtatagaggtgtttacagtattctctgattgtagtttgtatttctgtgggatcagtagtgataacccctttatcatttttttgtgtctatttgattcttctctctttttttctttattagtgtggctagtagtctatctattttgttgatcatttcaaaaaaccacctccgggattcattgattgtttgaagggtttttcattctctatctccttcagttctgctctgatcttagttatttcttgtctcctgatagctttttaatttgtttgctcttgcttctctagttcttttaatgtgattttagggtgtcgattttagatctttcctgctttctcttgtgggcatttagtgctataaatttccctctacacactgctttaaatgtgtcccagagattctggtactttgtgtctttgttttcattggcttcaaataacttctttctttctgccttaatttttttatttacccagtagtcgttcaggagcaggttttcagtttccatgtagttgtgcggttttgagagagtttcttactcctgagttctaatttgattgcactgtggtctgagagactgtttgctatgatttctgttcttttgcatttgctgaggcgtgttttacttacaattacatagtcgattttagaataaatatgatgtggtgctgacaagaatgtatattctgttgatttcgggtggagagttgtatagatgtctatcaggtctgcttggccaagagctgagttcaagtcctgaatatccttgttaattttctgtctcattgatctgtctaatattgacagtggggtgttaaagtctcccactattattgtgtggaagtctaagagtctttgtaggtctctaagaacttgctttatgaatctgggtgctcctgtattgggtgcatatataattaggatagttagttcttcctgttgcattaatccctttaccattatgtaatgcccatctttgtctcttttgatctttgttggtttaaagtcttttttatcagagactagaattgcaacccctgcttttttttttctttccgtttacttggtaaatattccttcatccctttattttgagcctatgtgtgtctttgcatgtgagatgggtctcctgaatacagcacaccaatgagtcttgcctctttatccaatttgccagtctgtgtgtcttaattgggacatttagtccatttacatttaaggttaatcttgttatgtgtgaatttgatctggtaattatgatgctagctggttattttgaagaactgttatgaacagtttcttcatagcatctatggtctttacaatttggtatgtttttgcagtgactggtaccagttattcctttctgtgtttagtgcttccttcaggagctcttgtaaggcaggcctggtggtagtaaagtctctcagcatttgcttgtctgtaaataattttatttctcttttgtttacgaagcttagtttggctggatatgaaattctgggttgaaaatgcttttaagaatgttgaatattggcccccactctcttctggcttgtacagtttctgccaagagatccgctgttagtctgatgggcttccctttgtgggttacccaacctttctctttggctgcacttaacattttttccttcattttgtgtccgaaattggtgggttcttggtctcactgacttcaagaatgaagccgcggacccttgcggtgagtgttacagttcttaaagatggtgtgtccggagtttgttccttctgatgttcagacatgttcggagtttcttctttctgatgggtttgtggtttcgctggcttcaggagtgaagctgcagaccttcacggtgagtgttacagctcttaaggcggtgcgtctggagttgctcattcctcccatctggagttgttcattcctcctggtggattcgtggtctcgctggcctcaggagtgaagctgcagaccttcgcggtgagtgttacagctcataaaggcagtgtggacccaaggagtgagcagcagcaagatttattgcaaagagtgaaagaacaaaacttctacagtgtggaaggggacccaagtgggttgccactgctggctcgggcagcctgcttttattcccttatctggccccacccacatcttgctaattggtgcattttacagagagctgattggtccattttacagagagctgtttggtctgtcttgacagggtgctgactggtgcatttacaatccctgagctagacacagagtgctgattggtgcatttacaatcctctagctagacacaaaagttctccaagtccccactagattagctagacacagagcactgattggtgcatttacaaacctttagctagacacagagtgctgatgggtgcatttacaatccctgagccagacacagagtgctgattggtgcatttacaatcctctagctagacatagaagttatccaagtccccacctgactcaggagcccagctggcttcgcctagtggatcccatgccagggctgcgggcggagctgccctccagtctcgtgccgtgcgcccacactcctcagcccttgggcggtcgatgggactgggcgcctcggagcagggggcagcacctgtcggggaggcttgggctgcatgggagcccactgtgggggtctcgggcatggcgggctgcagatcccaagccctgcgccacagggaggcagctgaggcctggcaagaattcgagcatgacacaggtgggccagcagtgctaggggacccagtgcaccctccgcagctgctgtctcagttgctaatcctctcactgcctggggctggcggtgctggccggccactctgagtgcggggcctgctgatcccgtgctacccgaaactcccgctggcccacgagcaccgcatgcagccccagttcctgcccgtgcctctccgtccacacctccccgcaggcagagggagctggctccagcctcagccagcccagagtggggctcccacagtgcagcggcaggctgaagggctcctcaagcgtggccagagtggatgccgaggccaaggacgtgccaagagcgagcaagggttgcaagcacattgtcacctcaatttcaaccttggtgaatctgatgattatgtgtcttggggttgctcttcttgaggagtatctttgtggtgttctctgtatttcctgaatttgaatgttggcctgtcttgctaggttgaggaagttctcctggataatatcctgaagagtgtttttcagcttggttccattctccccataactttcaggtacaccagtcaaacgtagatttgtttttttcacatagtcccatatttcttggaggctttattcattccttttcattcttttttctctaatcttgtcctcttgctttatttcattaagttgaccttcaatctcttatatcctttcttctgcttgatcaattcagctattgatacttgtgtatgcttcacaaagttcttgtgctatatttttcagctccatcaggtcatgtatgttcttctctaaactggttattctagttagcaatttgtctaacctgttttcaaggttcttagcttccttgcattgggttagaacatgctcctttataaagctcggaggagtttgttattacccaccttctgaagcctacttctatcagttcgtcagactcattcttcatccagttttgttcccttggtgttgaggagttgtgatcctttggagaagaggcattctggtttttgggattttcaccctttttgcattggtttctccccatcttcttgagtgtttctacgtttggtctttgaagttggtgaccttcagatggagtgtctgagtggatgtcctttttgttgatgttgatgctattcctttctgtttgttagttttccttctaacagtcaggctcctctgctacaagtccacgggagtttgctggaggtcgactccagaccctgtttgcctgggtattagcagcagaggctgcagaacagcaaagattgctgcctgttccttcctttggaagcttcatcccagcagggcacccaccagatgccagccagagctctcctgtatgaggtgtcagttagcccctattgggaggtgtctcccaatcaggagacacgggggccacagacccactcaaggaggcagtctgacccttagcagagctcgaaccctgtgctgggagatccactgctctcttcagagctgtcaggcagggatgtttaagtctactgaagctgtgcccacagccaccccttcccctgggtgctctgtcccagggagatgggggttttatctataagcccctgactggagctgctgcctttttcttttcagagatggcctgcccagaaaagaggaatctagagaggcagtctagccacagcagccttgctgagctgcggttggctccacccagtttgatcttctgagtggctttgtttacactgtgaaggtaaaaccacctgctcaagcctcagcaatggtggatgcttctccctccaccaaattctagtatcccaggtcgagctcagactgctgtgctggcagtaagaatttcaagccagtggatcttagcttgctgggctccatgggggtgggacctaccgagccaggccacttggctccctggcttaagccccctttccaggggagtgaacagttctgtctcgctggcattccaggtgcatctaggttatgaaaaacaaaaaacaaaaaaacttctaaagctagctcagtgtttgcccatacagccgcccagttttgtgcttgaaacccagggccctggtggcgtaggcacaagagggaatctccaggtctgcggtttgtgaagactatgggaaaagcacagtatctgggccggagtgcactgttcctcacggcacagtttctaatggcttctctttgttaggagagggagttccctgaccccttgtgctttctgggtgaggcaacaccccaccctttttcggcttgccctcaatgggctgcacccactgtccgatcagtctcaatgagatgaaccggttacctcagttggaaatgcagaaatcacctgccttctgcatcgatctcactggaagctgcagacctgagctgttcctattcggtcatcctgccagcaatctccaaattatttattttattgctcatgtcatcagtttgatatacagttaattttcttcaatttgattcaattttttagggattcatgtttttccattttaatttttttacttttttttttttttttgagacagagtctcactatctcccaggctggagtgcagtggtgcgatctcggctcactgcaagctctgcctcccgggtttacgccattctcctgcctcagcctcccaagtagctgggactacaggcgctcgccaccacacctggctaattttttgtatttttagtagagacggggtttcaccgtgttagccaggatggtctcgatctcctgacctcgtgatccacccgcctcggcctcccaaagtgctgggattacaggtgcaagccaccgtgcccggccaattttttcactttttaattatgtacaacaatagttgaaaccatacatatactcaggagtggaatataattagcaaatattttcttcagattgttatttgtctttgtttatggtgattttttgacatgtgtaagtcattcagatatatttttatgtagctaaatttattaatatttaacttgcttttggaatttgggctttatttatgacagtttttctgtttccagattaaagaggaatacatcattaatgacaagatatgaaatgcaaatgcacacattaaaaaaaccctaagtatcattagcctttcgggaaatacaaatcaaaactaccatgagataacattgtatagatagataacatccatttgattgattaaaaaggaaatatatggatatatcaagtgatgtaaagactgaggaataattgggattttcatacactgctggtaaacaataaaaataatatacccacacaaaaaataaaaaaaggaggaatacatctatttttaattcaaatatatggtatgagtcattgtgtttagatcttgcatccatctggaaattattatttagtagtattttattttaaaatatcagatgctttttttcttcccagatgctgttttagatattagagatataatggtgacaagatcaacaatatctagtttctctcagagctaatgttcctgtaaggggagacagcccacaaagatgattttaaataaaggtaaatgccataaagacggtgaaagaagatgatgtgacaaggagggactgaagagatgcctctctgataagatgatatttgagtgattcttgcatcacatgaagaggacaactatatcaggctctgggacagaactatccaagccaagggaatacttagtacaaaggcactgaggagcaatagcccctaacacttattaaatgtttactatgaaccagacacaatgccaaaacacttcctctgcattatctcatttatttcttacaactaccctttgaattaggtaacagtaatcatcctattttgaatatgaggacacagattgaaagggcctcctctcagtctccagtgtagctttcagggctcaacctgcaacagtgaattcctgattttatctctccaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggtctgtataatcacttttctttcggacttagggaaagtcaagggttctcctctctgagaggaagagctgcagttagtgaaagggttcacagtcctgaatgaggaatggatgtgcgcatcctaaaggagaaacgagatacagatccatttgcttgtctgttttgcaagcgggaaatctagtctccatttgtcaagaacctgagggaaattcctgtagctggcaggtaactgtcaggaatttcaaggctgaaaattttactttgctgacattttacctcttgacatttgcattctttttctctctcttctctctaccccaggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataactcattgtcatatttgtttgggagataaactttctgcttcccgtgttatatactaggcactatgtacaattaagattatatcatacctcgtttccttccatccaatgcacactttaaaatttttaatcagaagaaattaaaaggagggtctccttttcactaatttttcttttttttctttttagtttggtcccataaccattttattttctagacttagatgattgaatcatttttaaaaatgacaaagcttcttaaaattgtttttattactttgtttacaggaggagaaaccctggctctccattagaaaccttacaaattcatttctttttccttttttttttttctgagatggagtttcgctcttgttgcccaggttggagtggaatggcgcgatctcggctgaccgcaacctccacctcctgggttcaagcaattctcctgcctcagcctcctgagtagctggaattacaggcatgcgccaccacaccaggctaatttttctatttttagtagagatggggtttctccacgttggtcaggctggtctcaaactcccgacctcaggtgatccacccacctcgacctcccaaagtgttgggattacaggcgtgagccactgcgcccagccacaaattcatttctaaagtaaaaaatgaaacacaatttcacatttgcctcctgaagacaaatgagatggctgttcttagagcatctctgaagaaagatgctataaataaagctcaaatgattattatctagaattaggaaagccaagactcaaagaaaaattcctcttaatcatttgttcatctcaaaatattataagtaaatgtttagaaaagcttgtcaggttatcagagaatctgattttcttatgtcctgtcagtttactgtcctacagtttactttttataaaagtaagcttcacaaggactaatctttctgcaaaagggatattgagaagatcagtacaatatctttcttcccgtggtcttaaaaataattgtgtgattatttgttataacaaaaaccagactcttagaatccttgattctgagataagttactggcgaaaactccttcactggaggtatttttaaaaataggacaaaatttgatgtctttagattgatagaggaatagtactacttgggagagctgaaatggattaaatgtttcttgccaaactttattatatctatgtcctttgttggaatggataataagggggttgtgagagttacaaggaattggcaacagttaattctataaaataggaactccaaatgcatgtaagatatgtgggaggccacacagatacggaaccatctggcctctatcctgtttggctgtctgagagtgccagactatgcagaacacacattcaacttttaaacatcctctttgcaatgtcttcactcaacgatgtcacacgcaggtgttaatatggcaatgttcttggttgccttggcaatttgacaaaataaacttggagttttagcccttaaaaagaaatgtacaggtgctaaaacttttttaaaaaggattagctattttgagattcaatagaatttaactatttttaaatgtcaaagaaaatccagagttcactaagatgtaattaagaagtgaaaacactttcttcccacattgaacggaagtggttttatttgctcaaaaagagatactgacttcaggaccagtgttttagcaataaggaaactactcacaagtaaaaagttctgctttttaaaaaccctggaaatgccattactaaaattgatcacgtacttatttacttttggttttgagtaacttctaggatgtttaaaaaataaaacccaccctcacaggacagggattttccaccagtgaatataaacatatagaaaggaatatgctctagagttggcactgtattctcaaaggggagtccctcaattagtttggtcagtttttctttgaagtaaatttagtctcttccaaggtaatac

SEQ ID NO: 16106 - DNA, 10516 bp, Human
tctttgtgtgtgtgtgtgtgtgtgtgtgtgtgtgttttttgtcatttgagatggagcctcacgcctcactctgttgcccaggctggagtgcagtggtgcgatctcagcttcctgcaacctccacctcccaggttcaagagtttctcctgcctcagcctcctgagtagctgggactacaggtgtgcgccaccacaactggctcatttttgtatttttagtagagatggggtttcaccatgttgcccaggctggtcttgaactcctcaccacaaataatctgcccaccttggcctcccaaagtgttgggattacaggcatgagccaccgtgccagccaagataacatcttatttctaatttgagtttcatatttgttatacttgatttctcagtcattggtggtcgatagccactgagctccaacagataatgcagccctgtcagacattaaaatattcatactttttctttcacatagggaaataatcttccaagtatatacacatagcagttacattatatcattatggttttgatttgcatttgtctaatggctaatgatgttaagcacctgttcatgcactgattggccatttatttatcgtccttggaaagatgtctattcagatccatttgtcattttattgattgagttgtaagagttttttatgtattctggataaaagtcctccatgatttgcaaatattttctcccattcctttgagttgtcttttcactttcttgatggtattatttgcagcacaaaagttagtaattttgatgaaatccaattcatctgttttttcttttgtcatttatgattttggtgtcatctgtgaaaccactgcctaatccaagatcatgaagatttatttctatgctttctactaagagttttatagttttagttctagcatttaggtctctaattcattttaatttaaatttttgtgtaatagagatttgaatgatttaaaatttttcctctcttcagaggtagcaacactagaagataaagataaaaaaagggccaggcgcagtggctcatgctggtaatcccagcgctttgggaggctgaggtgggcgaatcacttgaggccaggagtttgagaccagcctggccaacatggcaaaaccctgtctctactaaaaatgcaaaaattagcgaggcatggtggcatgcatctataaggccagctacctgggaggctgaggcacaagaatggcttgaacccaggaggcggaggttgcagtgagctgagatcacgcttactgcactctagcctgggcaacagagcgagactctgtctcaaaaaaaaaaaaaaaaaaaagagaacctaattttttttctgactcttctctggactgagtacactgtttttaccttttcttagttagatgatgaactagatgatatagcaaggcttgatgtctaaactggcaagtgaagtttttatagagacggatgttgaaaggaggaataacatactaaaacatatggcacatttagtttatgatgagatcccaagtagtctgtctcccatcataaacttgaacatgagtttaaatcttctccttttcaaggccgggtgcagtggctcacacctgtaatctcagcactttgggaggcaaaggtgggcagatcacttgaggtcaggagttcgagaccagcctggccaacttggtgaaaccctgtctctactaaaaatacaaaaattagctgggcgttgtggtgggcacctgtcatccccactactcaggaggctgaagcaggagactcgcttgaacttgggaggtggaggttgcagtgagccaagattgcaccactacactccagcctgggtgacagaatgagactctgtctcaagaaaaaaagaaaacaaaaatcttctccatttcaaaatggtttagaattgtatgaggtgccaggggtcccagttttatgtatcatattagttgtaacttatgagcagctgtgacaagctacttggttttctcctcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttggtaagttaattcgggatttgcacattttctctgtgaagggagtggggagactgggaggattctttccttcattactgggtttagtgctgttcttttttttttttcccaagagtggagtctcgctctattgcccaggctggagtgcagtggtgcgatctcagctcactgcaacttctgcctcctgggttcaagagattcctgtgcctcagcctcttaagtagttggcgttatagacgcatgccaccactcctggtttttgtatttttagtagagatggggtttcaccatgttggccaggctggtctcaaactcctggccttaagtgatccgcctgcctaagcttcccaaagtgctaggattataggcgtgagccaccgcgcccagctagtgctgttcttaaggttagttgtgactcagagtcctcttggggaaagccagacaagttcacaagttcccctgtgtgttacctggcagtcctgctggtggtgtagctgagcaatggtataggcctcacagatacttgcagggtctcattgggaactcttccttttttaatttaatttaattttattttttgagacaaagtctcgctctgtctcccaggctggggtgcagttggcgcgatcttgggtcactgcaaactccacctcttgggttcaagagattctcctgccccaacctcccgagcagctgggactacaggcgcctcccaccacgcccggctaattttttgtatttttagtagagatggggtttccccatgttagccaggctggtctcaaactcctgaccttgtgatccacccctctcagcttcccaaagtgctaggattacagacgtgagccactgtgccctgctgaactcttcatttttaagagggatatttaaaagagatccctgaaggcatagaatgcatgtttatgacataaatattaattggtacctatttatgtgtcaggtactgttgtagacactggggattcagttatgagctagataaccattgttgctgctttcattcttccgttcctgttgacccagagtagtgcttctgacaggactcaaatagattaccttttcttatctacacattatattgcatttctgttttgagatgttggacagaattgggccaactttaatagaaactgggtgccaagaattccaggtttcaatattgaggttaggaatctttttttttttttttttttttgagacagagtcttgctccattgcccaggctggagtgcaatggtgcaatctcagctcactgcaacctccacctcccaggttcaagtgattctcctgccttagcctcccaagtagctgagattacaggtgcccacaaccacggccagctaatttttttttttttttggtatttttagtagagacgggattttgccatgttggccagccttacaggtgcctgccaccacacccagcaaatttttttttttttgtattttttagtagagatggggtttcaccatgttggccagcctggtcttgaactcttggcttcccaaagtgctgggattacaggcgcgagccactgcacatggcaggaatcatttaatagattggaaactgtccatgttgcctcctatgtgacctcatcgtctgctcaaaactggtttctaaaattagccaggtatggtggtgtgcgcctgtggtcccagctacccgtaaggctgaggtgggaggatcgaatgagcctgggaggcggaggttgcactgagccgagattgtgccactgcacttcagcctgggtgacagagtgaccccatctaaaaaaaaaataggcgggcacagtggttcacgcctgtaatctcagcattttgggaggccgaggcgggcggataatctgaggccgggagttcgagaccagccttaccaacatggagaaacgctgtctctactaaaaatacaaaattagccgggcatggtggcacatgcctgtaatcccagctactcggggaggctgaggcaggagacttgcttgaacccgggaggcagaggtttcagtgagctgagatcatgccattgtactccatccagcctgggcaacaagagcgaaattccgtctcaaaaaaaaaaaaaaaaatacaaaaattagctgggggtggtggcatgtgcctgtaatcccagctacttgggaggctgaggcaggagaatccaggaggcagaggttgcagtgagccaagatcatgccactgcactctagcctgggtgacaaaagtgaaactcagtctcaaaaaaaaaaaaaagaaaagattttatattttgtagtctccctagttttgcttccaagaaggcaattaaaattcagttctttctgtattttcattacttctgaatctgagtcaactgtcagatggatgcttttgccttaatttgactttttattacttccaaatcatagccttagagacaagcactttctggatttcagtctggtccaatagacagtttaatggaataaaaaaaatgagagactaaattacttattaaattaagtgtctgtatcaactgttcccctggggcagtgttcagtttgatttaaaatgactttttacttccctgagggggaggcagtagagagggaggacatttccattaatgacttcctattccacagaacaaagctctgtaaagaaaatcagctgatcagcttcctctgttcatattttggctcaggcagagacttgccctatatttgtctttgtctcaatatgggggtaagagaggggaggttttacaaaattgcagaacttagagcttttctgccctggttcttgcctgtgatggtaatctttttgttgagggaagtgaagaacctaagggtccttaagtctgcttttattttttcttctagcaagtactggctgtgagtgtgggacaggattttgtgttttctgtgacagtctgcagtttttggcctctgaacttgatagttgacttgccagaagatctaatgggggagtgaggagtgaaagagtaggatgttatagggtctgtggcattctagggaatatccctgcctactactgctacccagtaggactcactctctataaaacattgtccttatttaagcaaaacaactctttgtggaatctgcttgactcctaatctcctagttagaagcaatttgagggttgaggtggaggcatcttctcatcttgatttttttttttttttctgggcttccatcttttctctgaactgactcctaatttaggcagttttacattcagactgtgggtgtatgtgtgtatgtgtgtgttaaggcgccatgtatgtgggaagtgtggaaaatgaagactgcttttgccccatgggctcatttagtgacttataatataatattaatatgttaatatccctaagacacaagagagtcaaaattagtgttttgttaaatgtggggctgggggcatggtagctcatgtctgtaaccctagcactttgggaggccaaggcaggtgaattgcttgagctcaggagttcaaaactagcctgggcaacgtggcaaaacttcatctctaccaaaaatacaaaaaattagctgggcatggtgatgggtgcctgtagtcccagctacttgggaggctgaggcaggaggattgcttgaacctgggaggtcaaggcctcagtgagctgagattgtgccactgcactccagcctaggtgacaaagtgagaccctgtctcaaaaaattaaaaaaaaaaaagtgggggtgggtggtggggtaggggctgggtgagatggctcacacctgtaatctcagcactttgggaggctgaggcgggaggattgcttgagcccaggagttcaatactagcctgggcaagacataacaagagtctatctctattttttagtattaaaaagaaaagtgggttttaactcaattggtagaaaaccaatttagtggcatgctaccaacaaaaaaagaaatttaaatagaatagaaaatataggctggggctgggcgtggtggctcatgcctgtaatcccagcactttgggaggctgaggagggtgtatcacttgaggtcaagagtttgagaccatcctggccaacatggtgaaaccccatctctactaaaaatacaaaaattagcttggcatggtggcatgcgcctgtagtcccagccactggcagggctgaggcaagagaatcgcttgaacctgggaggctgacgttgctgtgagccaagatggcgccactggagtggctgggtgcagaagttcacgcccgtaatgccagcttttagggaagcagaggcaggaggatagcttgagtccaggagttcaagacctgcctgaacaatataatgagaccccgttctccacaaaaaggagaaaatatatgttttttaatgaagtttatttatatataaaatatataaatatatacttgtatatatatggcaccacttagtaatggtaaatattgttttatcaacttttgctatattatatatacatatctattgggttccagttttaaaggtatttcttagtggagtcacagtcaaaacaaaattgagaaatagtgttctagatctcagagtatcctttagaatactagtcctctgataaatagagtttccctctataaaaagattctgagattgactgtatctaggaaatcaggcatattatatctctcttttggagattcacagtgtgcattagtaaactgtaagaggctgggcgcagtggctcacgcctgtaatcccagcattctgggaggacaaggcgggcagatcacgagatcaggagatcaagaccatcctggctaactcgatgaaaccccatctctactaaaaatacaaaaacaaaattagccaggcgtggtggcgtgtgcctctagtcccagctacttgggaggctgaggcaagagaatggcatgaacctgggaggtggagcttgcagtgagctgagatcatgccactgcactccagcctgggcgacagagtgagagtccgtctcaaaaaaaaaaaaaaaaaaaaaactgtttagaaagtcttgcagttaaatgtttatgaactttgtatgaccacagaacttttttttttttggcccatacaatggctttcaacattctgagagcaagtgtttggaagaatacaccttgagaaacattaatctagatgtgtggtcctgaggaaaagttgtatctattcattctggaagcttttgtataccgtatggggcctgtggcattctagagaacattcctcctaccatcaccacacaatagaacctgattttctgtcattggaataagtggataataggttccatactgtgggttttgagaagggtaaaggtggggcataagggtagaagcgcttttctctagaatcatgctgagaggagatatctattcctttaggtagaattactttctgagacaggaactgttaatgtcctatttactgaaattccttttttttttttttgctttgtccacagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaagtttattttccaaatttgcttttactcccaccccaaaatttccctgtttcacagttctgactgggggctcttgtttatttcactgagtcgctatacgggtttttcagtgtgtggccacttggtccatatgaagttccaggtttgtatttctggacctcagctagattaggccctgcccagagttctagcatacgtggacttccaggtgggctcttaggatttggctggtctttggggacctggagtatgacctgcagaggggtgtgagctttggagttcatctggggaattgaggttggcagctggggagcttggaattatggttggacttcgtgcttgttgtacagtctttgtgatagacttctttctgagtttcttctgactgtctggatcatggggctgtcagtgataagagtgggagagatagtcatgtctct

SEQ ID NO: 16107 - DNA, 9734 bp, Human
acaggagaaaaaagtaggaacgaggggaaaattaaaaagtcataagccagggaaagtggtgcacacctgtagtttcagcttctcaagtggctgagactgaaggatcctttgagcgcaggagtttgagcccagcctaagcaacaaagtgagaccccatctcttttaatttttttaaagttttatattttttaaaaaaattataaaaataaaattagcagcatccctggtttcaaaaagtagaaataaataaataaataaaagtagctcacaatatttcctgaaaacaggtgtattaaaagggcagaggagagggaaggcaaagaaaaagaaaaaaaaggtggcaggttacatacatacaatcttgtctctataaaagctcagaaaacatcacgtgactaggaagtttcaaatgcctccaatataacatggaggagaggaaaaaaactgttcctggacaaagatacacatttcttccaaaagggggagtctttctatatattttgtaatatctccagagcacagcataatgttggtactgccattttggcctttgtcattaggaaggtaacccacataagcctaactacaaacacccttacctgtactaaaacttcactcatatttaactgaagcaacattgttttttgtaaatataactgtaacaattattctaaaaggcaatacagctgtcctcaccagttatgttcttgagacatcagttgcaacaaacttatatgtaaaaagtattcaaaaagtttaaacattgatcttaactggagaggggtctgcacttgaacaagttttcttgctacacacattgcattctaagatttcggactcacttttgaatatgcaaagacatttcatggttaagaccacaaaaaggctgatcagagaacatttttatttaaattgccattttaaatatcagtcgttttatcttaaagcttgtcctgggtttaacaaagtttaactcacatccacgcgttgtctctccaaacacagcaggcagaaattctcctttgattggattaagatagataaagtctgcttaaccgtgaatcgctaattgtcaaatccatgccaattcggtacctaggagtcaatttttttgcctgataaacaagataattgtgtggaccgttttaaggtggttagtcatctgctaaattggctgaaatgcggattacccagttccttcgtcgtacagagttgcattctgaggagtggggctcggggatacagcccccagaaattctgaacctcggtcccgcaatctaccacaccacctaaccttggaaggccaaactaacttcactatttttgacaaaatgctttggtaatggctcattcgggccgagagggaaattctgcaattctccaacccacacctccagcaaggggagagctgcttgagtggtgagcacaagctgggcacctccggcgtctccaggaaacgtgaataggccctttcttcggagggcacagaacttcaggatcagggcccaatggagactgagcggacttaaccctaactgtgcacaggaccgcgctctccgacccctttgtggcctctcccagaggtacgggctgcgccccaagccagcagtctctcgtagggcctacagccggcagccgctggagcaggaggaggagaatagggactcgctggaccatcacaaacgctgtcgcgcgtgcgcagggaggaaccgagttcgcggcgaagtcagtttcctgactcttgaaggaagtggccttgtgtcacttccggcctccctttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcaggtaccgcgaggcttgcggagagtggccgggccgggcaggccctggctaggccgaggccaggccagggccaggggtggggggtgctggccaggcgtggggtagagcctttcatccgggcctgccaagagcggggagctgtgggggagtggtggggaggcgggtgctctttgggctccctggaaacccaaatttggagctttgcggggtggatttgggatccaggtttcggcctgtgtaggacgtttattttcctgctggtatcttgggaaataacgagcatggaatgctagagtgagctaaacctatccttgctgaggatttcctctttttctagatgaaagaaacaatcatgaaccaggaaaaactcgccaaactgcaggcacaagtgcgcattggtgggaaagtaagttttaatagttcgggtttgtgggttttttttttaaggtttaggtattttaaaaaacatattccttttgcgcttcttatattatcggtgacaaactttgcctatcgagggaaattcacggagctagcaaatctcgaggagcgggggagacgagggttggagacacatcagtgagacgagctaaaaacatcgcctttgtgtaaacatgtttgtgttttcagtgttacagagtgtaagtagaacacaaaagtgtttcctaatttaattagtaaggaaaatgtgtcatttcagttagatcgttgtgcacatcatacccttgacttgttttggcctgagttgtctaaagtcagtgcttgtttgtctctcttgtaaattgagacctttctgtactgctttctgaactaaatattctttagggtagttgcatatttcaagggtatttgaagatacgggtacattttggagtttaagagcagtgactattagatttgaaaatataacccaagtaggtatctttcctgttctgactttgtattactgtaaaaatgagggaattaaagtgactgatttttaaatgatcagtttttgattaattgtttttttcctggtggatactgattcacatcaaggggattcttttttgaagctgatttttagattgtcctgtaattaataagaagtccactgtagacagaggtctacctagtttgtattgttagcacattcttagtatttaacaaggtgtggtagcttgttgaaacagagcatgtctttacttggtaaaacttgtaaagcttccatggtacatgtttattaccttttagtttttcccaactttaagcgtttaacttagagttagctgtgagatagccagaagttgcacttagacttaaataataatatacagctttgttaaattactgaactttgccagcggtgaatttatcctgatttttttttactttttatttttgttaacgttagccatcttcaggatccacacccacacatttaacaacattagatgtttcttgtcctctttaatcaattgttatcagactgtggccttcaagtgccagcaaaactcaaattttttgtgtctcagtgtttggatgctcttatattggtgtttttaaccactcttactttcagtacagtttcagaaggagtaatttgaataatgtgcttatgtgcagtctttttgttgttactctcatcattaggctttaactttgggagacatcattttagggtaaaggaaatcttgagatttgctaggatatttaaagctgataacaagattaaattttgtgtcctaacatcttaatactcgtttagctaataatacaagaagtatttctgtagtcacaatatggaaacatttctacactgtttaagaaacgtacttattatgggatgtgaaattaggtgagttagttttgctttagagaaaactgcaggtgttaggtgctcttaggtaaatgttacgaaagccctttattttcatatctaatcacagcattaataataattatttaagtgaaaattgaactctacatatgtgaagtgtatgaaacctctagaaagtatgctgggtttgtctttacaatcttagaaattcctttgagtttcttagagaagatttctttggaaaccagatacatacatgaccatttcaaagtgatttttgtacttaatagtttggagaggttagtaaccagtactttttttttttttttgtagccatagatattttcttcagttaaataacaagatttatttaagcctttactatgttggatcctgagaatataaaattttaagaagtttaaagtccctaggtgggctttaagcctagcagtggcgataattgtcttttcttaaaaaaatcttctttcacagtgtaatatacatagtacaatagtagaagcattttcaaaatctagagatgggaatgatttggcatagggaaagggggtaattgcagaatttaggaaaggcaaacaggaggtaatgacttgaataagattttaaaggatgaataggaatagggatggaggttgggggacggtgaggtggttgggtgtgatagactttccttgagtgccttcagtgagctagatactgttgtagatactgggtttatagcaataaacagaagtccttatggagcttacattctagggagaggagatggatgataaaatgtatttatctcttatagtaataagtgttatgaagagaaataaaccaggatagaaagaaattgatgagtgagtgtggaagttgctattttactttgggtagttgagaaagaccactttgatcaggtgacataagagtagagatctgcagtgagggaaagagccatgtagatgttccggaaggagaggaacagcatgtgcaaaggcccttgggtcatagcctgcttggcctgttcaaagaatagccaaggtttattggctaaagaagagggatggtagcagatgcagtcaggagtggcatattaagggcaggacagtttgtgtagggctcttgtaagttaaggtaagggcttcagactttactatcgagtcctatagaagtctatatacagattcatttgattgttccatacactgtcttgcctgtaaatattaatttggatgttgatttttatttaatataaaaacagaaaaggggtcaggcgcggtggctcacacttgtagtcccaacactttgggaggccgaggcaggcggatcacttgacgccagcagtttgagaccagcctggccaacatggtgaaaccccatctctgctaaaaatacaaaaattaaccaggcatggtggtgcctgtaatcccagctactcgggaggctgaggcaggagaatcacttgaacctgggaggcggaggttgcagtgagccgagattgcgccactccagcctggacgacacagtgagaccctgtctcaaaaaaaaaaaaaaaaaaaaacagaagaggttaataattctggatgtggaattctttcaaatgcttaatttagattgacacatgctacctctttgatcacttttagagcaaatgtaaaaagtagaactttgaaaagatcattcttttcctttcccattttttgcttctatcttcgccttagcctgcctgctcactgcataagtttatgattatggtaatgttcttatacagatccaaaggtcagaaatgaattggaaactattcccatttgaaaaatatctgttgtggtataaatgtgctgttttctttcctcttctccctgactttagggaactgctcgcagaaagaagaaggtggttcatagaacagccacagcagatgacaaaaaacttcagttctccttaaagaagttaggggtaaacaatatctctggtattgaagaggcaagtatcaaattttgttactttaaaaaacaagatttggctgggaaaagttaacgttaatgcattaaatgggttgtttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatttttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatttctgatctcagggctcagaatggatatgagtatttttaagtttggaaatgcaagctttaaaaataacagatttgtaactgattttaagcaactgtccttgctcaagtttgcagtaattgatgtagcgtgccatgattgttacacttgattttgtggaatgttttctacttacttgatttggatcagatactttattaactagaaatgatgaaaatgttaatttggtgctttgccaataactacttgtaagtttggaattgaaaaaaaaattagtgtaaattatgaaattacttcagtttcatctatatagttcgtattaccagtaatcttttaaaaatggcttgccagtattctggcatttttaattacagtgtgatagggattttattcggggcagaaaatagtgtagctgaatatacatctgaggatgtggcagtgttatgctgttttctgtgcttaaaattttgaagaataggaatgcaggaggaagtcagaggcttatatatggctctttagttacccatgtttttctaggtattgacttaatctgcctcaattttcatttttattatcacattgagttgcaggttctaaactgtcagggctttcagagctgaaataggcttttgaagtatcccactgatgcctgtatgggcctagtacataactctcctgtgtacgttcatattcttgtgtgataaaggagagtggatgcttaccactcacagactctttaatttttttactttaacttttttcatttcagtaagtggttgttgagcatcacccttatgccacacacagagtagttgagaaaatggcatcttcatttgtctcccaaaatctcaccatgatttggtatgtgggttttacctgcactctaagagttccctactgcccttatactacctcagggcctatggtggcccagagggattgaaaggatgggtatggaattttgtttgttggctgttcctagtattttaacccatttgtagacattagaatatcatgttattgatagtatcatagataaaatcccaaatgtcccttatcatggaaataagttgtaacaacacttggcatttcatctgttcttttttttttttttttttttttttggtgaatatttattaaaaacctagacaaataatgtttacattttcctttcatagctgtggatggaaaagcaccacttgctactggagaggatgatgatgatgaagttccaggtaggaacgtttacttgtggttaacctagagaatcttagcaagggagaataagaaatctttgtagggaaaactacccagggaagaggggtggtaagttaagatggacatagatcttacttagaatgagaaaaataatgcagtattaggtaattgagaattatgtttatagacttgacttggcttgtttctgtttgggatcccaaggatgtgtaggtatctaaccttaaatattgaataaataagtatatatatatagtaccctaaatataactattacctgcagagcactaatgacccttgctccctactttgaaactcatgaatttacaagaaggtgtggagttgttcaggtatcttgggatatatatatgcattctaaaatctgtagcagcataactcctttgggaatcatgagacatttttgtctcttacctgttattggataaatttacgttcttctaaaatatttattgggcaggagaatcactggactcataaatattcccactttgcatagacaggtatccttaggaatccaggaaaattttaacattgtgtgtcattgtattctttggttctgctcccccactattgaccaatgtatgagatgggaagaggggggcatttttttcacttttttttttttttgcattcttgttcttggggctatgacacagtatttatcatcattggcaaatgaatgtctttccttcatccccttttaatatctgataattatttgtagatttggcttttttaagaatttctactcttttccttttcctagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacggtgtagtgtaacaaaggtggtataaagttctcaggtttgaaaactttgctctccaacagtccttagtgcttccatgatttatatggtgggtgtaaatatgagaatagagtattccttagtggataaacagacatttctccctgatattctctattgtaagcatatgttaagtgccttttatgaattacctcggtgttatctcctttattcctcaatttgtgaagaactaatagctccattttgtagatgtaacctgaggtttagaacttctaaaaagtaaaagtaatctccagatcccttctttgtaggatattttataaggtgacttggaaaaggtagtgtttagaataggagtggctcctgggtcattgtcttttccttaagtgtcaacactaataaatgaatagggttatgtttttatttaataaaaaatatacagtaaaattgagcatatacagttaaaagaatttataatgtctgccactataatcaggttaccagacagtttcatggtcccagaaaatccctaaacatagggttacttttaaacatttttacaaattacaatgaaaacaattgtgtaatctgaaccaaggccatttgaggagaaaatagtttctacttgtaatggtaatttattttaaattttcatagcaatttgcaagtaccttttgaaagtattatacagttgtatctaaaagtcactattaaccgtagggaaaacaaagttttgagtaaacagtatttgcaaatatttacattgtattttcctcaggatg

SEQ ID NO: 16108 - DNA, 101300 bp, Human
  misc_feature (1)...(101300): n = A,T,C or G
ctctgttttcaaccaagaaaggagagccttggactcagagtcttgagcaaatcataacagtatgtagcaggaatttgatcacatcttatcttcattgtgtatatttttagggatactttctattaataagtgatattagtgtttccatttatacagcaacatagaattgcatttaaaaataaatttaagtaaaagaaataaactgcataaaagaaaactattacatacataaaagtaacaatggttcaaagaaaggaaaaccaaacacaaactagatgaggctggaatccaacggatgacctttagaaaacagtgctcttcaccatatttcctgcccctcaccccagttatgggctttggtgctggccttacttcttgaacagcaattgaatatcttaaccaaaatattatctggaaacacttcatctagttactggtgaatgcagctagttggaaacacttcatctaattactggtgaatgcaactctctagtgatcctgtcacagatcccaaatactgcgggccagacggtattttcattctgcattgatcagattgacatgttggatggaaccccccagcccttggctgcccagcatgtctcccatgccagggtgtcaggaaagatataagagcaaagagtacatgaccaataagtcatggcagctaacacctaagacactgggttattttggaaatcttaagaatatctaggtgattatctatctatctatctatctatctatctatctatctatcatctatattttactaacaggcattctagtattaaagctatgttgactaatttccatctattcctcttccttaaagctcgaattccccagtcttctatgataccatgtttgcacattttgctctttcctcaccctcctccccttttctgggacagaagctatattcagtatgtttgtgagaaacggttgtaaataggctgccttaaaaaaaaaacaaaaaaacaaaaacaaaaaacacattttttagttcttctaaacacaaacaaaggcaataaaaattcccaatgctacaggtattttaaaagacatcattgtcacgaggtaattttgcttgtgtgttccccaaggaactgaaaagtacattatagtcactgtaaccctgctgagtagagacagtatcttctctttattctttgttattactgatactatctgttcagcacattaaggaaagaaattggtatctaatataatacatctgcatttctctcatttcccatgagcaccacaaagccagtactttttcatccttggccctgccagagtagaatccaaggcctgaacaatagtaggcttaagttttgcatttttgatgtattctttaagtgaaggtggtaaatattgatattggtaaatatcagtaaattcgtcttcttaaagccacaaggtcaaagaaaagacaggttccgtcttcctaggcggggtacccacagccccgcatctgcccactgtggctatcccagttcctgagaacctggctacatcatacacagcacacaaggcagaggcctgactagtgcaactccaacaagagaaaagacccccactccgaaaatggaaactcatcccattcccatgcacagacagggtgagggtgaggagtgggcagtgggtgtgtacgtggtgggtggtgtaggttgagagcgtcttcccccttcacggctgcagcaggagctcagcgggcgccccagccccttggctcgcggccctgccccgaccattgtccgcacacctcgtccctccagcttccgggccgcgggcgagatgatttgctgcagatgacatcagccccgggccaacggctggaagagcggaggcagccaccgcgtgaggatgtgccgggtggtcctttcctcctcctcttcctcctcctcccggctccctgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagcaccttcggagataatcctttctcctgccgcagaggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagagacgcgcgctgggagacgcgcaaacacgaccccacccagggcgcgacggtcactgcgctcctcccgcgcgccccgcacccatgcctctcctcgtcacctctcatacttggtccagaccctttctgggctaattaagaataatccgaattattagatatgagacccagagggagagtctccaataaccttgagggatctgtcaccacgctgagtccgcagcctgtgctgagttggccaccgcctctcccgctaagtgaaatgcaggtgtcaggggagcagaggccacaataaagccgcaaccgcaggaggcagaagggtgggggagacctgatgcaaccactcctttcagtcctcttctggcctcaggaaaaggctgggacccccaccaccgcagacctggggccgaagcccatgtgccagggcccgcgtgggattcatcctcaccacggctacctcagcccctgagaaacgccttttctgatttcaaacctcccgatcctttctttcctcagaatgactaggctagtcctagggccacgcccgctccccccgcccccccctccccggggagatgctgggatgcagaaccgcctgcgcttcgccaccagacagagcccgcctcgctaccgcccttggggccttggctgcagctctcagaaaggacaatgggaccccaagttgcggggtggggctgctgcttttagaagtcccagcctcgggagtggtagcttgaagggggtcggtgagggagacgtcagcgggtagggtcagctcctcgcccggtgctcgcaccagtggcgcgctctgcggaggccgaatagcggtacgccggggaccctgggcggggccgtgagggtccggcgggcacagcctcgggcgcacagagagaccgcccccagccccacccgagctgccgcagtgcctccggaccgcccgccacacctgcccccccacactgcggcgcccccgtcgggcacggctggctgggcttgcgctccgcccgggcctcgggctggcgggggccgcgcgcccccacctctcagtttgcctggctttgttgccctgggagtccctgggtgggcagctctggtctctgcctttccctttatccctggcgtcccggccctcccctcgctcctgacagaggtcgccgggtccctccgcagccccagcccgcgctctattctcctggggtggtgctgaagcgtttctccgggagacaccggttggtgggcgtggtgcagtccgcactgcggtctctacggcagcccgaggcggacaaagggcgttcacgcagccctcgttccccactccccctccccaataaaagacgaaagaaaaaccttgttttagatgaaaaaataaatgcttgtcatctgcctctgcagttggaaacggccacttgtccccagaacaaaaggctgcagggtggggactggagttgcagacctggttcttttgtttaactttaaagcacttgattttcccttttagcttaaaaaaaaaaaaagaaaaaaaatgtgagcagaaagtcatagtattttattccaaaaaattcaagaacaagagatatttcagtagtgaaatgtcttatttgagcatctcaataacccttcattttcagactatataggcctttggtctaatctgttctaatttagtttatttgcacaattttctcctggaaaaattttacacatactgactttgggtgtggctattgtgggaatcaatgactttggatttttttctttaaaaaattatttgtaagtagcatttctgggaaataggaatatattaggaggtgcttttctatctacaaaatcttcataaccattcgatgtggtggtgctaggagagggatcatcaaccccgttttagagctgggggcccagagaggcaggaagggtaagagaaccggctcaaggtcacagcactcataagtgacagaagtaccagtactgcagcgtcactcgttttctgaccctgtcatgatgttagtgcagggttggctaacatcctatgatgggaggaaggtttcagtacaacagttttcagggcttgcctttgtatggccatccacttgtgggcagcgccccatgctgggagatggttcagcaatcaccttcggatcgtaattatcttcctgctttgttactcatctgatcatcctttcagcgccctattcctcagagggtttatacaagctgcatctatttatggagaaaacagacgcatccacgtactgctatgaagaagggctccctgcctttactcgtttttacactactagcacttagtgacaaaattcagatttgtcttcttgacattaattttttaaaaaattcggttgaagtattatatagagaggaaagggcacaaatcaaagatgagcagctcaacgaattttcacaaaacggacacgcctgggttacccagatcaagaaacagacattactggaaccccagaagcccccttgtgttccctttgcaatagacatcatggcttcctgattttttaattccctaatttggtcaggtttttgcatggaactccgaaatgactgtattgatcccattaagaatcaaccaagtgagtgagcagagccgtttctttacacaccgtagcagatgctgcttttcctctgaagatggctctcctgggttctggggtcttggctgcagctcaagatgcaggcccttccagcgctaagtgaaaatcctgctcccatagcttttcagacagtctgagatgacttagcaacagagcaggctggtcctgttttcctgtgcacgacaagctgctgcttcagccgccaggtctcagctgggcctcctccagaggccactgctgttgttgcttggtgcctttgggccttgttgtgtgaagcaagatggagctgctccaggggggccagctctgatgattgtgtgttgcaggctgggaaggcagttccgcatctgttactctttcttcctatttcccctcctgccttaactgagattctgggtttggagaccctggcgacttggattcttgccatccgattactgagggctctctgggaagcctagaaaataatctataaatctgtagagacatggtggtaatgcagtaaatcaacaggcctggaacgtcccaatgtggatgcttcgtaaatgcctcttgaaaccagggaagagagatggtccctcttgctttctcaactatattcggaaagcataatgaaagctttggacatgtctcctccagagtttggaacaatagtgtttcctcggactaggctagcttcatttatttagttatgcaggactttattccaaatcgttttcgctaccaccaactactactctttggcacctcctttttctcctccctaattagcccccagcatggatttagctagtggttctcattttcagcaaaaccctgcttcttggttttattttaatacatagaggacatacatccgtgtcttgcaaactgaattctagagccttgtgaacgttttcattgtttcattttttttttaaggaactaaaacatataaagaatattaagtgtctgttggatgttttcaattaccgttagattataacttttcctttagttaacactgggaatcagcaagatttgttggtgaaaagatagatgaatgtaacatctactgctctgcatttttagataaaagtttagctgattacattgttacattctgatgtcacttaactgaatgtccttcagtctaagatggtaagagaatttaaaacccaggaaagatttggggtttagttttccttttcttttaacaggggaaataagaaaccaataccatatgtggtgagaattaaatgttagagagtcttaaatttactatatttgcctatacttttcaaagtcgaagacagatggatttctgcttgcactgcttaattggtattatctacgacagctctgtgatccatgctgaaacacaaggcagtccccaaatttaaggtcattaaattgttcaccttctctaagggcttactttaaaaaaataagttataactttttagacaagcaaataattatgtcacttctcatttgcttgtgttgtaagatgttatctcagacctaaattatttattatcaatgctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctgagaaataaagcattcctaaatgtagcatttcctttagttcatttatgtagtttatgatttcaatctgatttcagaccactttttagcatagttttacaaatataatcttatgattctaggttaatgatttaggtacttggaaaaaatatccaaaagcctgtttttcagagggagcaactaaagcccataaaggaaaatcaacttgccaaaggcccaaataactgtcagatagaacccatgtgccatcaacatacaatgcatggtcatttcattttgctttcttcaatccactgtcacctttagaaatatgaattttagcttttaaatgggaggtgcttttttaaattgttggtttcattaaacaaccctgcaaaatgcttacatgattggaaaacttggaacaatctagcctgtacacaccaagagtacctgacttctcctcatttttcaccctgacttgttctttaatgacccctccctgcctccctgccccataacctattcttttctccttttctcatctgtgtatatcatgtgcatgtcagcctcccttgtgtgcactgctaccacctggggtcagagaactgagaaggaaagatcttttgttgctccctggtcccaaggagctcactttcagggctgggcaatagccacagagcaggcccagattgttctcagagatgacggatgccttttggctccagacattgaaagaatggggttcactgcctccaactgcctggagttattctgcccccacctgggtaagcccagaaggggtacagtcttagaatgctggggaaacaaagcctccaggaagagcttgacttggtgtatattggggtgaaaattagaaagagggcttccctgctccccaacagagaccaggatgacttgcttctgaaagcctctttagaacctcttcaccaacaccccaggatgccctccagccagattcagagaggggagaatatgggaagggccaaagagatatttttctgtcctgtaaactttagagggctcactgttggctccttgttaggcacaaaggggaactacataaacctactaaatgcaatatgaaccttcattaacaactactctttgcctttaccaatattatccagcaggagatacaaagtaattacaaattattttatttctaaaattggtatggaaagtggcctgattccaaaattttcctttccaactaaaatagctggcaaatccaacataacctttattttataagtggtagtagtggttgtgcattgctaagaaacaatttgggtggaaattgctctcttgaaaaaagaaccctacatttttagtttcattgggagtgtaaaaatgagaaatatttttatcagccgtttactagtataatttagaaattactaagtggatttatcatttagtactttttctattgctaaattacaaatatgtcaaaaataaaatatgtatgaaaatataaagcaaacatttaattgtgtgtgccatgacaagttaactgaagccaagggaaaatggcaagtagcaatgtaagagcaagtctgcagataaccctggatgaagtcattcaaataatgtaccaatttagacattacttagaacaaagacagaaaaattgtatgaatttaatttaaatgcatatgtctcattattaacttattgacccagcttgacagggtagaagacaaagtagagctcagacctggaacacggagaattcagtcaacaataccaattaagcagctcagacaggaactcgatttttttgcactagactagtatatagtgtatacattgaagtaaaatattctaatgaattcagacctctcaacctgtcaagctctctgtgaaacaaaaagaacccatttatcatttctgcactaaaaagatctgcgaaatctcaacatgcctttcttgttaaaattcaaatactccattagcacaaatgcaaactgaggctattaatgtttccaggaagagccataaaattctcccttataatttgacctttccttaagcacgttaactcttccacatctgaattcttcccattgatcatatgagaaatttctgcctgtatttagtggacacacatctatttgaaaatattcctcctggttgaaaaggtctgtggtgtgtaatctaaagatattttagatgtgcagtgaactgagtttccagaatcttttttttttgtaatgtctatgtataatccaccttgattctttacaggataggaagactgaatacaatataaccaagggtaaatacaaatatgccttaaggatccagtgtgtatttaagtaacacactgctatttattccttcaagtctgtatacatgactaatgtccaacaaaaatgattacatgactgggtgttaatttagagatagttcacctgctgtgttatacctagaggttcaagcccttacctttaggaggtatgcaataaatgtctgttgttctagagatttgttcctggcaattgagaatgctgtatacaaaggtacaatgatggataccacacactggctccaccatgagcaacctattaggaaaaatgtaatatataatatgtaaacatgtaaaacacacacacacaccagagttctggggttccccaactttccctggcttactctccagacctcccttctatgatgctctctggggttccctctgggccatcccctttgggagggcaggagaaagaggacagtgggaggaggaaggaagaggctagagagtagggcatgagcacaggaagctgccctcatcccgcctcttgccctcctgttcctctcaccctggatattcctttcagcctagggaaaggaagtctgataggacttcctttccgttcagcctagggtaggaatagctgattcatgtccccaactccataaatgttttataaagtataaaaagttgccatttttctttgcctctggataagaaaattgaatacaatgaacaattgtgaataaaagagctgcctgccaagctactcaggtaacagaaaagtgcctggaaggacagacaggccaagtcttgaagattgagtggatccactctgtttatcaaagatcacataaatcttggattgatatccagggctcgataaaccaaagtcaaaaacgggatgggtaaaggaaagaaattacacatgtatactaccagaacatcattttagaaacaaaggcccgtgcttgaatggcagcccccgtgtattttctttgcctttattctacattttcttgccacctacaagtggagttagtctgtctacaagctagagttagtctgttggcctcttagcttcttaagaactaacatcttcctgccctttctagtccctccctggagtacagcctgtcattttcctaacaactgttttctttgactcttccagaagaggtgcatttactttttatgaggggcagaagttcagtccacactgctaattatccctcccttgtggcctggtggagagacctccctggccctcccattttgtgggcatccactgctaagccaccaagctcttcagaaaaggagttcccacatcctccctgaaagcctgagaaatattacagtgatgttgtccaaaccactctgaaatgactaactggaagtctctcaactgtctttctttccctccctaggaatccgatcatgggacacaaacctgattgaatgcaacttggaccaagaactcaaactttttgtatctcgacactctgcaagattctctcctgaagtcccaggtgaggcttccgctcagtgttggtcagcctagaattccaaaggacaaggagcaagctagaaagctttgtctgaggcagcaaaaagactctcctattgctaaaaggatactttgtatttgttattatcaactaggttagccagcagccacagtttaggaagtcactctaggttatcactgtgtgggttatctattttgtggattcttaatgagtttttaagttctagggttgtgtatgtgtatatatatatacacacacacatcaatgatcacacaaattttgaattgatatccagggcttgagaaagagagagagagaaagagagagagatagtatagtgtgtgtatgtgtatctcactgtactctgagctcaagggactacaaactatttaaatgttaatcttactcaaatgaaattctgaatacaaattggatgctcctaggatcccagaactgtcttcctgcaaaagaaaaaggaaacatatactgcatttcaaaatgaaatatacatcatcatttcataattgcattatcacccgccattgcattaccacttatctttcttcgtgtgggtaaaagaatctgatattacaaacttctgttaaaatagcctttttttcagagatgaaaaagaatatcaaagaataattaaaggtaaggatgcaaaaatttgtcatatgtgaagatgttcccactaaccagccaccttcctggggctatgatctgacccatgcctctggcgctggagatgtattcatactgacccatctcgtcttcttcttgtgagcaataacctatattcctcccatttggtcacatttaggaattatgagacagtttctggcccataaagactccaaacctggaatatatttctccagacctttgccattgacccatcagaaacactgtattacatcttatttcttgaccatcacttgaattttacataagagaaagctattttctgcccatatgcttttgttatatgattcctaattttattggcattgatataacatcaggaatgagattcagcctattttgactggttaggtcatattccattagtcgtgtatatacattgatatttgaaatcacttttatagaatatcagtgccttcgtgaatcacatttggctgcagtaatatgcccataggactgtctcagttcttccttttgagtttaatattagaataaaatcccatacatttcagttattgaaatgcattgtagctttcaagtatggaattgagtaaatgtgctaagaaaagcttagcaagaaatggtttattaaaagttaacttcctgcaaagccacatgaaaaatcagtttttaagtaactttgctttgagaaaaaaggaatccagagactgtcagacagcatatgatttgctgaaggaaaggtacagtataaggttgtttctcttgttgttattttattgtatttttgtcttgcgatatctccgtatcttttaaaaccatctcacaaaaaaaatgagggaagtgctgttttccaaaaagtatgattatttcaaaatgtaaaaactacaagcttttattttttctctgtaggttgttctggcttttttactatgattgtttgtaagacttctttttttgtgtgtacaagtcatgtggttctcattgtgttcattcatatttggactgactttatagagtgacaactgcatattgcataatgaaaggctgcaagcattgctgaagaattaaccatttctagacccaagacctagtattgctcctgtggagtaggaagatcaagttcccccaaactgtcactttagcctaatgtaccccattctcctctcctttctcctgctatcaccttcagtaaggattagttacctacctagttgtatagtgttatgctagaggctgtgtttggagattggcctttggacacacagcatctttactattcttgccaatgctagaaaggactgatattacgactttccctgtcaagcctatgagtacactttacaggccaaggctcccctctgggaattaagcatctagaatagagccattatagtcatgctcctgtgtggggagcatgaaggtttccaaccaggactgtaaggtgataaaagcacatgtcagattcagtttcagataagtgtgttttaaagagaagagatgttagaggataagaagacatggagatcacaggatgatcactggattgggcccagggaagcctttagcttttcctgaacaaactggaaaggttttatggaaaaatttgaagtctgtttttaagtgggtccaagtctagtggtctctagctaactcatgtacttcagttcccctgaaatggaattagctgaacattttcctttagagtttcaagaatctttcattgttttttgagacagggtctcactatgttgcccaggctgctctcaaactcctgggctcaaatgaccctcccacctcagccttccaagtagctgggattacaggtacatgccaccacacctgcctaatttcaagaatcttaaattaacttagaaccaaggagcaagatgaaggatggatcccctaaaaaaaaatagagccatttttcagccaggtaaaacattgttaaaaatagcacctacaatataccaggcattatagggtgcttggtgagtgaggacactgtgaagaacaaaacaaatacagtcattacctttattacacttatattcttgtgagaggagaaggcatttaacaatcatatacagaccaacataaaatctagccccctgcatcaaatccaggcttcaaacagatttttgggaggtttgggtttaaaaaaacatagagacggggtctcactatgttgcccaggctggtcttaaactcctgggctctagcaatccacctgccttggcctcccaaagtgctaggattataggcatgagccaccatgcccagccacagttttgttttgttttaaggccagcagagttatagtaaaatatttattgccttttatgacataagtaaattaaggctcaagttacccatatatctgtcttatgttcctgttggttatgatagcttttgttgttttttaataattggagttcacttgtaaagactgaagatagcctcaaattgcagctaacagattgtgcaaatggcacaagattgattcctttgtactagtttataccttatactagtttttaaatatggttttgagatttgatttgactatttcttcaggattgtaggtctcattcaagaccactctgaaagacttagtcatcttgaataatatcctttgagcaggaatctgaaatatgagtgctttctgtacacaaggtgggtggtgggtgcctcagttccccagaatgttagttctgtgatctttaagctctgtccaactctggcatactgtaattcttggagtggtcagtcatctgggcttatcttactattattttgccttactattgcagccttgccttgcctaaagatcactcaacaaagctttgctgtgtgcccagggcaggtctctgctgatttgccttgatgtaaagccattcctggccacatctaagctggatcaagtgagaacagtcatcttgaaagaaaaggttaggtgttcctttatgaacactctctaatcttttactcaaaggaaagttcagtagttgagtcttttcaaaatagagcaacagtcttttgttgttgttgttgttgttttgaaacagtcttagctatgtcatcgcccaggctggagtgcagtggtgcaatcttggctcactgcaacctcaacctcctgggctcaaatgatccccccacctcagcctcctgagtagctgggaccataggtgtgcaccatcacacctaggtaattttttgtatgttttgtagagattggatttccccatgttgcccaggctgatctcgaactcctgagctcaagcaatctgtctgccttggcctcaaagttctgggattataggtgtgagccactgtgcccggccagaacaacagtcttatatttctttaaagttatgattttaaatactatcataaaatttttatttacctattatatcatatgttttttgtaccctaatcatgttggatgagaatcattttggttaagtctgaccacaaaagcaaagctaggcttaccatgctgtacagggtttatttcattttccgttgccatttgcttctttcccaaatgtaactttaggactgtctatgtatagtagtaaagaaggatatctcccaggggttgtaagaagtgccccataattatctgtcgtagacagacatcattttgaaacaagcaaacaaataaaaactattctcaggacaagtgatgtcagactgaaaatcagtttcaatttttattttttcccttaattttgccacttttatctgcctattaaaataatttaaaaattttgatcatctgactcctcatcagcagcctagcataatgatgaagagtacagattctggagtcaaactgccttgtttgatcttaaccccacggtttatttgctgtgtcatcttggacaagttaactaaccgttttcagtcttcttgtttgtaaacaaggatgatcagttccacctcatagtttctttctttttttttttttttttgagatagagtcttgctctgttgcccaggctggagtgcagtggcgcaatctcggctcacagcaagctccgcctcccgggttcacaccattctcctgcttcagtctcccgagtagctgggactacaggcgcccaccaccatgcctggctatttttttttgtatttttagtagagacggggtttcactgcattagccaggatggtctcgatctcctgacctcatcatccgcccacttcagcctcccaaagcactgggattacaggcgtgagccactgcgcccggccccacctcatagtttcaatgcagatcaaatgaattaaagtgtgtaaagctcttaagacagggcttgtcacatggaaacaaatgtgaacgagtgctgtctcccttctggagtatctatttgacttgtatatttggtgattgttattatccgtgggaaataccgggtattgatatttggctagtttcctttttgtagtaattttaaatttgtattaaagatgtttctcagagaaacgactgctttcagcattctcagaaggcgcagagctgctgactatgtgtaaagggtgacaacattctatggctgagcttctaaggtcctttgggcttgagagcaaaaagccggcaatgctttaaagtgctggctggtaaagcagagcctgagagggggttggagaccatttgcaaaatggtcctgtgggtgcccacgcaagggctgtcagggaacgtgtgcacagtttgagggctggcctgcctccttgctatgataacccatccatggtcactccctccacgccgttctacactcgcttttctcttctgctctcaccaatcaacaggtgactatagacgttgccaggtttaagaaacagatttcttgtggtttattttcttagctgaatacacagtaagaccttgatatatttacattttgtcactagttttataacatctagatcacattcacaaaaatcatcataaaatgtgatggatggtgtatatgggcagttttgttttaagaaccgatgcctttttcctagaagataaacgaaccacagctgagcatctttagatttgtgctgagtgattgctaaaaacatcttgcctggagattggttttcgatggagaattagaatcagccctttgaatttcagtcatgcgaatcttctccctttgacattaatgaggcacgggttacaactaatatttaccagttgagtgataagaaaatgagaaaatactcttagaaaaggtctaagaatattttaagccatctttctctgtctagacttgtgtgtttagtctgttgtgtgtagaattatagcttaattgtatgtgcctagaatacatcaactgctctatgacagggagtaatgaatgtgttttcagccctgctccaacctttaaacaataaggcacacaaatatatgttctagcggcattcaaggggctgactcaccctcagggaacctgcaatttcagagggacagccgattctttatcctcatgttttctgtgttgtttgtgtacacgcacaggtctaggtacttgtccccatgcctgtgaggctctgctcatctttcctcattgcatcatcatacaaggttataggagaaatcgtggtatgttagaagaaaatgacaaatagagagcattatattcgttaaggtaaccagatctctgtttaatattccttgaggtcattgctgcctgcctgggaaggagagtcccattttaatgcaaatccctagcctttctcccacttgccccgtgccctgagccctcctggcccggttgcagggaacagagtgatcggcagctcctcatgctgtccgctctcaccccagtgctcccattgagactttgccgcccaagcagcagacagcccagtcacccccacctgcatccttttctagcggtgaaagagccagaccttccaaggagaagattagaattttatagtgtacgcagcataaggcataattcctgcaagctttacatcttggtcaactttcaaatttcaggattctttatatccagatcctcacatacaagggaattttttcccttggtgcaggtgtggccagcagaaaggaataaaatggcatttcactgccatgttcaggcttcctcattcctcagggtagttaataatgggctctttcagaccaccctagaaatacctattcatctcactttttttttttttttttaagagtggaaaggatgttttactctgctgactgtaatggctctcacgcagttcctaatgggcactgtggaaccactcagcatagacaggcataggcaggaaggtagcagaaaatgggctgcctgggcccaggagccattttaggagatgtcaataacccctccattaaacccaactaagtgcgttccacgacagctgctaaccaaggacagcacctcatgctgagtgtcactgcttttgtcttcatctccagagaccaaagagagctcatgatttttgttagtagagtttttttttaaaggttttttttaagtatgcagcaacagcaaaccatcaagcaagcacagtctctttgctttttctgcctgctttttggtcttcctctggggcagtttgttcagcacctatggtagcctactagaaataatggtggaagatgaagaataaagcataaactaatagatcactttaaaagtgccaagtaatgtttttgagtgcttattaataagaaagcaactgtaagggaatatttggaagaatgaagtatttcccactgtttataattttgttgggaaaataagtcattcacagctttaaaattcactgtgtttctcaacaaagaaagagagtttctttttatttttttaatctctttttgtttttgagacaggttctcccctctgtcacccaggctggagtgcagtggtgcaattacagctcactgcagtctctgcctcctgggatgaagctaccctctcgtctcagcctctgaaatagctgggactaccagcctgccactatgcccagctaatttgtttttttttgttttttttttagttttttttgaagatggagtctcactctgtcgcccaggctggagtgcagtggtgcgatctcggctcactgcaagctatgcctcccaggttcacgccattctcctgcctcaggctcccgagtagctgggactacaggcgcccgccacgacgcccggctaattttttgtatttttagtagagacagggtttcactgtgttagccaggatggtctcgatctcctgacctcgtgatctgcccgcctcggcctcccaaagtgctgggattacaggcgtgagccaccgcacccggcctatgcccagctagtttttaaattattttgtagagaaggagtctcactctgttgcccagtctggtcttgaactcctggcctcaagcgatcctcctgcccccgcttcccaaagtgttgagattacaggtgtgagtcaccctgcccagcgtgagagttctcttaatttgcgaactgtgtatatgtgtcagagagagagaaagagagagtgtgtgtgtctaattcctaaagaagaaaggggtgaaaatggagagtataataagcattgcattttgattgttcaaccatgggtttagtcacaatgacaaaggttacccaggtaccagcaccccactcccagctgcaacccaggactaattaaatgctacctaggcaacgatcaagtatccccagacatcatactccagggcttaccccttttgttttctcggctgtgatctaagggtaatttctattgcatgtgaagtcagatttccttggtctgagagaaacgtgagaaagtaagaggtactctggggaagcgcacttagtgcaccacagggactggagaaattaacataaatacaagacaataataatgttattttaataaactcttctaggttaaaggattgcctatagtcaggactggtgaaattgatgcttatagaaaatgcaacaagagcgtctacatgtgatttaaaaataaaagtaagtaattaggaatgaaaattgaaaagctagggtagtgttttattgaatgtggctcctctctgcagttgtaccgcacctcatttgaaacactcaagctgaggttgcctctcaaaattgctgccttgcattcctgaggggttaagacgaaatatgaacatcctgaggactgtctttgttgtcatagagggaagtcctctaaacacgcactttgccattaatctggccatttctttctcaataaaacaggttttcaatgggagctgtgagtaaacacgccactgttgagcattgtggctcaaattcagatttcttgttggcttctcacgtggatagtgcgaggaaggaacagctattcccctgagggagcaacacgtttttagtgcacctggccccaggaacactgctctacatagatgtggctttttggatcctgaagtgtatccatcaatgggaatgtcacatttggagaagttatccttattgcaataaaattaaagatcaaataagttctggaacccaggcgaacaatgcttccttagtgcagagccattttgagcagttgtctcttgtgccttttaaaaacctctcacttggaagttttgatgtgtgaaagatgtgaaaactgcctaagagaattcttcctctttttaatggagctcgatgcctgtttagggatgatgtagcaaccgcttttttatctagaattccagatagtttcccagctcaaatactaggagtttttggtggtgcaattcaattgaaagtggtatttggtgtgaagttccagcagccccacaagatgctcaagtgccttgtagttagtttagtataatgtgcatatgtgtttgtgtgtgtgtgtttgcatacatgagagaaagagagagagagaaaaccttatctgttctcatctattataaaggagacaatcctttcattttatatggtatctccttttgaaggtgtcctgttagtgtcctattatcagccaatctgtcattaaatatttatgttcctgcagcaaggcacagttcagttcctagctctgcaggccataagaagacttgtaagtaaatcctgtcttcagttgtttacaattgagtatggaaataagataactaatgaaacaagccagtctataataagtgccaaatgagaattttgcaaggaggtccttctgtaaattctatttgttcaggctattttaaaaaaatctgtgtgcataaaaaaagcattaaaataatattatccatgcaaattggggcataaatgcaacagatcctaatgcactgaatcatctttgtgaccagggaattttgaatccagcctgaattaaaatatttcctagtttggagctacattttagattaagcccattaattcaatgatgaagagttagaatcgataatttaagaattcacccttctgaaatcatgtgagaacaaaactcctgacctggatgtataagcttaatttcaagattgtctttatctttgagtgctggaaaattgtccattggcagactctgaagacactagggaagagattgtgaaagtgaaatgttttaaggaaataaatgtgaagtaattgtttcactgccctgaggctagaatgggtactttggagagtgtctgattcagctgtccctgtgttgagggaagcagggaggggacaccaattgcaagctgctttccaggacccttccccctccggagagaccaggaagcctgacctagtgcagcagctctgggccacacctgagagcattgttgcccatggtgctccctgaagagctgctgtcagtcctttccttttctgtaaaataaagggattaggctagatcaggtcatcttaactttgttctgccagccattagttctgcaaaacatcaatagtcagtggaaaagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatcttttattaattatctatattgcaaacaatttctttgttgcagatttcctttaaacattaagatgtggtaaagtgtttatttacaaaaactatcaattacttttcagagacttggcagtctggaagctctggtaaagagccagtgtcttgaactccatggacagagcacttaaggaatggaaccgggggcagaaaatctgagctttaatcccagttctactgctaagtagatttgtgccattgtggacaagttgcctagcatttatgaacttcagttttattatctctaaggtcctatttatattaatattctctcatacaagtgaaaaaagtcattcaaataatgttttttcaaaaaatagtttacatataaagttggcaaacatagctgatgtataaaccaagatgtgtggtttttccagaaagttttttgagattcttaggacacaattacttgcttggctgaatatactcatttcacaaatatattgtttgtctaatgggatctggtaatgtgtcagtactaaggttaataaaaataagcaaatgaagacacagtccctatacggtctcccatggagctctcagtcaaggtgaggagacagacattgatgaaatagtcacacaaatttgtattacaagctgtgctaagtaggagggaaaataatatggtgctatctaaatatgtaaaaggagaaactgatgtggtaaggggtaagtaaactttagagctgagatttatgaagagtgctttttattttacatttaagacattggacactgtatttttccctttttaaaaattaattttattattattattttcccttatgtttcctttttaatacagcattagcaattcagcctagttttataggtatagagtacgcagatttatcctggacttcatatggatcaatgtgaggttataatagcacatttctgaggaaataggaacaatccaatagaagtgattctaaaatattttcataagatattcttataaggattccactactctgctctgagttaagaataaagtaaaagaaaactatctgaatatttattggcctcttaaaaacatgggattgatgacaagttttctgggctgcaaaaattctaatgataaatagagaaaggaaagcaaccaacatttctgagatcagaatggaaaggtttgtgttgtaacataattagggctccagagtgcctatagaatcatagtttatgtccatggtacttagaggttcattcaataccttcctcccagtgtcttctctgtacttgcttatgagttcctcacctggtcattgttaggccagtcatctctcagagtgtttgctttcttcaggccaacagtacgcagccttcttgcatcacgtctgattatctttcatacaccatttactttttggttgaaatgtccacttcttttctaccatgttgattgatatctcttggtcctatgtgatgaagtatctaaaatttcaacttttgcatataaagatacttctattacttggaggatattactgaagcaaataacctgtatattatttagaaccaatggcccttgttggaaaaaataaagcctgccttcaccattaaatctaatgaagaacagattttcttgttctatgtagtattttacttgaaggtgttcataattcagttgcgaagtaattttctcagtagcgtgtgcacaaatctcagctgatctgaatctatctgaaattaaaatacggtgtaaggaaatgttgagatacaagtatttttcattaatttttttctgaaatgctctgaaccctttcagcctggagacttttttccgctagcaaagttctttcccatgtgctcttatcattgtttctcttcctgttctgatttcagccttaagaatatgtataattcttaaaatggaacttcttagatctcatcctccaactcatcatttcctcttcgatcttcttctgtgtattctaggagaacatttcacatttgtcctgtacatcactgggtcaatattctgcaggatttgttctgctcttgagtgccttaaatgcagatttaaattctgctattgcattttgtatttccttgaattcttttgttcattccactggggacttctttctaaatctctgcctgtcattcagcccaccctgtttttattgttctctgtcgtttcatagtggcaacgtctgcatcttttataggagccaagtgtcattttctaaaattttattttgttcctatggaaagtcatttttagagatatattttttccaccaaatctcaagacagtgctcatttttccttgtgctgcagagtcttttcaaaggtcccatttagagctctgtttgtttcctccttcctgtataagaaggaggttcaggaatccctgaaactccctgtccaggttcagcatttgccagcagagggttgtagggactccttagcaaggctgcccacttgggagctggcaattttacccgctcatctagaacctggaagtcaggttcaggtgtataacctccaccctgggtccatggtccctgagcagccatgcatctggcgtgggatgctagcctgggaagaaatagtctgtctttactgtccaagtttctgcctgtaatcctagagaattagatagaacttgcatttcttctttgtacaaatattacagaccatgaccagcatgcactcctctccaggatcctcctgcctctgcctgtacttacaggtgtttttcctgagacaactgtccagctcaggctgtaacgcagaacagctctctcctctacccccagctctgttgggatctgaggtgaggcgctggaggcgggatggagagcagtggaaaaggaggtatctgataccctgcagtaagcttctttttcctgtcttgcatcctaggattaggggcaggtatttgaagagtgtgtcaaaaactttccaaccttctttgagtccagcagaatggtaaagcgtgggggcccaggagctacagtggccaagttcaaatatgggcttcacctcatgcacaaggtctctgtgcctcagtttccttatctatgaacctactttacagaggatttatgaaaattcagtagctataaggcatgtaaagtgtagaaatacatttttaagagatgtttaaataacaatgcttttacaaaatacaaagacagtcttaataatgattaatgcttttaacttgccattcaaggaaatgaataagaaatgttggtaaagcaggaaaagctgattcatcttgactcagtgttcaaaccaactgtaccattataaagtctacagtattattcagccataattggttcaggattatggtttctttgtagcattatcagttctctatacttgaagttcccaagagccaaacatttccatttttctttaatcagaatctgtcacatttcaaaactccctttcttctttatggatattgtggaaaatcccttcctgcaacctccagcttccgccaaaagtgtcacatgcattcttattgtcactatgtgaacaccttatgaatgagggctttcttttttaactttagttttcacatgtttgtgagtgagagttttgtgtgtgtacatgttgtcttttgtgacaccacagtttgatttgattgaaaaagaaaaatgcaattttatttaaattgctacttggggatataaactttgtatcagaacatcaagcctgaatccatggtcagtgaagtcctttgatttctgctccttttagtattgtcgcagcaagactccctcactgcattagtgggttccattgtatttccaaggagggcccagtgagaagggcttgcctgcacctcacggccacctcccttcttctgcagggtaagccttgtaattacagcagacattacatttgtctccagcttctaggggatgatgtcattgcatgtcaaacaggggattagcatgaggagagaagtcctattgacattttcattttcattaagaagaatttggttttgcttcattttgttaacggaagctgttgtcttaccacataggagaattttttttttttaaagaaaacttgaaaacgtagaagcaggcatgtgctgactgcatgaataaaaatatactctgtagtggcactctatcaattagtgaaagcgtctgggacacaaagcatgcctgggaaatctcctccttttcttacaaaagcagaatatcattcttctcaaagctcacaatggcctgggccctgctgcagaaaatgttcctgaaaaaggaaggcagagacttggccactgctgagtagaaaaggaaggcaggcggctggtcccatcagacctctgaaatattttgctttttcgtgatggcattgatctagtatgtcttaaagtctcattccttatgtctcagggtaaggctcttagttcccttcccatatgaaaaaattaatcaggagcgaggtggaatcctgatgtttcagatgctttgagcccagagctgagttggtggaagagtataatttttatcagtcatttccagcccctcccgcaataggaagaaaatcattgtcagacttggggtagggagttgtggcctcctttcaagcaatctaacaataaccctgagtcagaaaatctaggttcaaataccagctctggcttttactgggctatgtaactgtaggcagcttatgggattgctccgagccttaactttctcatctgtccaatggcattaattggcaatagtacttgcatctcaaagggttatgcctggtacctatcaaccattgtttttcacctctaaaaattatttcctttcaaaacatgggccagtgttctgaggtgaccttattacttgagtgagtaaaggtggtggttttctttttttctctctctctctcatttgtgtcagtgttttgcaagtacaggtcaggtagccaactcttaccagtcttgatttcctccttgtggagtagacccagtagctatgagattgagggtcacctggattagactggctttggaatttcaggttttttgaattttcccaaagcactggaagaaaaagagtccttgtgaatttttcttgggagtttttagaaacccttacaatagttctcagttctccatatttggatcccagaatgttcctagcatctagtttccctggaacagagtcatcctgtgaaaaaggatgaatccaatccagatcagaccctcttgtgaggtgataattttccatccagatttccctgggacctttccatttgcattcttgttttgccttgaaaggcagctggtgagctatttctttttcctcattggacttttcatgtccaattacctagatgattattgctcctgtaggactgatattttagaaagaatttggaataacactgggttttgaggtgtagcccaacaggatttgaccaggagtctccatttacagttcttcaaggccagtgcatttggtgagctggttggaaggaaactttggagtgttctagaaagaactagaccatctgaatcacctgtcctgatgcccttgtgtggaataaaggagaaggcactgccttgtgctgagtacttaagtgtgctgagcacctaggtactaagtaaagtgctagttactgtactaaacatacccatgggcatgtgctatcccctgagtttctcctgaacctatggaatattgccctcatttcctctattcccacccccagcactccttgaactatctgacatacaggacagctctcttaccacaagctacctgaatgtaaatataattcaaaggaaggacattacaaacaggaaatcagcaattgactatggaagctgaaattgctgtctggagatggccagatactcttttcctgggtggctcaaggagtagtcgggtcatcttcccagggcctcaattgtgtcctctccaagctgtcagtatggccctgtcatccaagacttgtcctcatctctgggttcagttctctgggataatttaaaacctacctccttctccccaagacctcataatctagatggaaggaaaagggggacattctcagttgtttttcataatcattttactactaccctctgtcagatcctgccccaagtcacacctagcctaatgttttgtaccttgactcaattgttggccagccactccctttccctccaattagggtgtgtccttgagttgttttgtatcctcttctgattataaactataaacatatacattttgactactgaccccaagccaaactacaaggaaaatattgtccagagggtgctaatatgggtgcttaaataatatgtgaattattattattttttgccaagcccataccaagatttattttgttattaaaaatgtgtgaacttggttttgagtattttacatttggtcattttgagttgcagggagattctgatttctgcatcttcttccaccctatgggccaagtgcccttcactgctactgaaggcttgtttatggcacatgaaattggctaggttattagcatgatttgcatttttgtttatgtcagaactgtaggctgagtaataattcacagtacaaaaaagtcagttcagtttattcataaggatggcttatgacaaagcagcaattccatttttatcttcctaggcatgtcagaccatttgctgatagatcctgtagactggtgttgacctccacatatatgagtgaattcaatgacctattggccctattgctatagtcaatcatcttgacagcctaaatttctgtagaaccttgagtgtattattttcttagactagtctacaagggatgataggcaataaatatgttccatgactattgttttatgtaagccacaaattaaatcatattttctagttgaattacataaaaagcttatgatctttaactgctgagatccatcttcattcagaattaaatggcaggagcttcccttaatttacctggccaaatcaagcaaatattgattttaaatgatctgtataggtctgaagctctggtttgaagatgtctgtttgaaaataccttttgtgaaaataaataataaagttactcctcccctgtttatctgattgttaaattttgtcaataattatgattccttaaaacaaagtacaggctcctatgcccagaattgacaacagaaatggctttgagatgattcagaactatactttctcttattaacatctaatatgtatcaaagccttttctccccgtttaagtagagaagtaaccttaaaaatatttaaatgtgatcaaaggatcttggtcataggattcatgtgtaagaaatgtcataaatagcctcaatcaattactcatttttcatttccaaagttttaaaatagttgacatggaaaaagtattaatatgcatcgtatcttggaaacatgaagaattatcaactattctgtttctttaccagcaggtggcatgacttgttgctctgctggtgacaatataaaacctaacccaccctatcactttaaattgttacataattaaaagagattcctaaagtacttgccccaaatataaaagttgaaagtttaatatccttatgatataaagagttcttacaaataaataagtaaaactttaacatttcagtagaaaaataggtgtaggatatgaacattcaatttacatacacacagaaggtgggtggagaaagacacacatatacacataccaaatggccaataaacgtatgaaaaatgttcaacctctttataaattaaggaatacaaatgaacccaggaagatacacatttttacctccaagttgcaaggttttaacaaatgataccactgatcactggcaaagaggacaagataggcaccttcatattctgctatttggatataaacaaccttctgaaatgaaatttttcaatatatatgaagagtcatagaaatgctcacgtacttcacccagtaattccctaccaggaatttattctatggaaataagcagagatatgcacaaaaaatgttatgtaaaaaaatgcttattgctacgttatttctctatgtgaaaaactggaaaaaaacctgaagttctcaacaatagggcatgtataatcagtaatgattaatcaatagaattcagtatttggcctgcattattataaaccatatcttcgaagaatctttactgatgtgtaatgttgagtgacaagggaagggttcatgaaggtatttttcaatttgatcacaatttgataccaaaataatttttgtcttttccttgacacccaatttcaatgacacccaaattgtaatatgggttatcactgagcagtaggtgaacaggttattttaattttcttccttatctttttctgtgttttttacattttatgcagtgggcacatagtattttacagtcaggaaaaagtatacacattttcaaaaatggtaagccaagcattggagacatgaatcactatcgcttttgtattcctcatggaaatgagattcaatagtaagttacgtgtctggggaaaatagagctcatttgagtcagaggttggaaagctcttatgaatactaacctcagaaacctcaaaatagtatgtggtagaataatgacatggcacgaaaagccacggatgtcagtctgagttaaggttagagtagatacatacaacagtcataagagaaaaaaacttactaatctatgatctccagttctggtaacctctagggtcggtctgtgcctccatatcaaacctttatcacagtgcagtgtactggggctgctgcaacttggaagcctgggttctcgttctggctgctctgcaaatatattttgtacttaaccttgggcaagtcaccaactctctgaactgagagttttcttccagggctggatcgttattcatttttggagtttggcattctgatgcactttctagccctgcaaggtaagatgtaagtctccggggtgtctggccaatgctgaagcagattgaggctccttttgggccaacccttggatcagaggtgtccgaagtcatcttggttcagtcgttttttaataataagttgccgtgacataagttattggaaaggaccacagttgagggtaagaaaggcagtttgattctcttgtggaggttataaaatgaaagcagagatctgtccctgaatatgaggaaacctcgtatatagtttaacaatgtatttttttcttacataaaaatctaagtttgaaattaccatcagactaaatttcatcccatctgtggtagagatggttttaaaattgagactttagaggcagcagatctttatcctgtacacctgatacataagaaaagcccagttcagaggactttagtttttaaccttaaagacaaacatattcagacatatattgtataaggatgtattacaaactttttttttttttgagacagggtcttgttctgtcacccaggctggagtgcagtggcgcggtctcagctcactgcaacctccgcctccagaggctcaaacagtcctcctgcctcagcctcccaagtagctaggactacaggtgcatgccaccatgcccagctaatttttgtattttttgtagagacgaggttttcccatgttgcccaggctggtcttgaactcctgggctcaagcaatctgccctcctcagcctcccaaagtgctgggattataggcaagagccacaggacctgtcctacaaacttcttttaccttaaccatggtatagaaaatacaggctgatccatgcatacatctaaaattgaaacaaaagtttaacaaaacaatgcctatccttattatctgcaatgcattatgacattttctagtctgttttattctatactattaagaaacactggctttgaccatttcatgctacagtaaagtattgcagccttcatttgaagaacactggtatagaggtttttgaagaggtgcgcataagggagagaaaaacagctgcatgtcctgacaactattaagtatcactcataaatttattttcagcaacatgggaaaggaaaatagatcctttctttattaagttaattgtgacagaaactgggacaaaaataacgtgggaggaacatgttaaaagaggagatttacacatatccagtgttttccagcaagaagaatgcatctgaaagaggtaaaactgtgattatcgaagcaatcctattacacctatgcagatgaatgaaatcaccaactttaggcaacatgaaaaaataaaagggccaagatcaaagtggacctggtattatttctagcgtccatcttggatttttctttttttgtctgaatccccatctcagggtatgagtcgttatgaatcaaaggatcaccgcccaataaaaccattctagacagaaaccttttggggttgggggtgcaccattctcctcttctacagcttccagaccactcattgcccatggatacccaccagcctcccacgttcacacgactccatctgctttttttggtgtctgtgtcttctggagcattgaccaggccagtatagggtaccgttccctgcacccagagtttcactcccacctcaaactcttttacctcctggggtacatgtccacgctttactcctctcctgccctccagcttctttctttctttcctcccatttctcctctcttcccctcccttttgcctttgctctgcagagacactggtgccgtgacacacatctgagcatggctggtggggctgaccagtggtcaccagtgcaggatttaagtggttggagcttaatagtagctacaagtctttaatttcttcagcaggtttttaatggcctttgatgcacgttagaaaagacatggaaagtcctgaattcagagccttcatgctgggtattgtatagtcagaccagccctgtctctggactgaatgggtctcttgaaatcataaatgcattgcttagggatcagtagcctcggagtgacctttctcactcatggctttcctgaggctcagaaaggccaggccttgtcctgggtgagccagcctctcagtaccctgatggcatgactcagaaagctggacaatgccctagaatgactttctccattaagcccaagaaatattgcatagaatcagtctgtctggaaattccttatatggagaggttctgagacgattgtatgtttggtttgcaagaggatcatggtttaaaaaaagaaaaaaaagcctaaggcagtgatatcatattacttacaggcttggttaaaaaagatagagaaaatactccttcaaacgtttccaccctaattctggattacactggggacgacagcaaatcccattccactggttctggctgaccttccctgcatcttggagcaaggaactctcactgtctgcctgtttctcccagcacagcactgcagagaggcccagaggctataaagccctgccacgtgtttctccaaatgggtggtttttattatttctggaatgcagtccccagccccaaatcctaatatgctgacaaggcaaaagcaaaagagacctgtggaaccccacccagtgacagtttggtgtccctccccatctgggcttggtgcccaccctgtgaccctcactcttcctacttcccccaaggtggctgggagtggaaggcgaattggagcacattcaaagccagagtggaagggagtgatttaagatcttcctgtgagatggagtcctgggcggtcgcttattgtgcagactggattgtgctatgggatctgctctgcctgtggagggggactgtgtttctacatccacctcatttcatcaggcaaggaggaggggcaggtagtctgcaaaattccgctatgtggtttaacacagtgaagacctgaaacctccttgatcaccaggaaagagatggggaaactgtacctaggcgtttctaagccaggagaccggagctcgctgaggaataattatgtggaaacaaatgtaaagttaaaccttaaaaagacaatttaaaatatatttacataaagttatatacttctcattttaaaagatgatttaaggagatttgggcctaagtaaggagacatgaaataaaagaaaaaagggattttttttcaggaaaaaaagtgctccccaagtagaacaagaaaaattctccagcataagtttcaattaaaaaaaaaaaaagtaaattgactctagcacatggtatggggctaaataatagagtggagcagaactgttatgggtcatttttatataggccgtagtgcgtaaacattttcgactgtgttttttattctatttcttaatagatgaggggtggcattgaggcatagagtttttaagtgatttgaagtcaagatataatcattcttggcccagcttcatagttcattctccaaaaataagattttctagttgttgtgtgaaatccatagtgaaaagtctgattgcataggtgtccatatgctggagttctaatcatagattcttctgttgtgttctcttgtgtgtgtgtgagtgtgtgcgtgagtgtgtgcagttgctatagaaagacaaataccaactaagtgtagaaacatctttgcacgtatcatagagaagctgtataattttatcaggattcccagagaagaaaatgtgaaatgttagtcccaataatttagtaacaaaagaatacactgccgtgttgagatgccaaatagaaaagataatatttagtgcaatccaagtggcaaacaaatacatttcctttttagggctatggggtgaggcagtacagtgaggccttgtttaagtaccctcaacagaatccagccttttaaaaaccaattcaaggtcatcattatgaacgtcatccacaattgaattatgtctttatatttgcagtgtcttcttggagaggacgtatcggtttgccaccagacagaatgatgccagctctggttttttaattcatatgtcttttaaaaaacatatctgtcttggtatcctccctcgatatcacactgccagtagtttttttctaaactaccttcagtgtgcttgtttctaagtactcttctatgttagttccccagggctgccataacaaagtatcatcaactgggtggcgtaagtaacagaaatgtattgtctcacattccaagaggccgaaggctggttccttctgggggtactgagggagaatctgttccatacctttctcctcatttctagtgatttctgccatcctccctccttagcctcccaagtagctagaaccacaggtgtgcaccatcatgcccagctaatttatttattttttttgtaaagacaaggtcttgttttgttgcctaggtaggtcttgaactcctaggctcaatacttggcgtacttggcttgtagatgtatcattccattatctacctccagtgtcacgtggcgtgttctccctgtttgtctctgtgttttctcttcttattcagtcattgaataagattcccaccctaatccagtgtgacctcattttaactaatgacttctataaagaccctttttccaaatgaggtcacattctgaggtttccacgtggacatttgtggggaatactgttcaatctagtacaccttccttctatgttgttgttctgaatctgctgtggattggaaaatctagtcactaagcttgttagacctcctctctaaagaagaaaaagagagagagagacttgatcccgaatcttccctaaggagtcttccgtcgtataaagtctttgagctgtaagtgctttgacttagtggtatctattttgcctgctcagaggctttccctcgctctaccttttaatgtttttttactgaattcaaagctaaattttaagttttcttttcagagacaggatggtgcagggatgcgatcatggctcactgcagccttgaactcctgggctcaagagatcctccctccttagcctacaaagtagctaggaccacaggtgtccaccatcacgcccagctaattttttaatttttttgtagagacgaggtcttgctatgtttcccaggccggtcttgaactcctagcctcaagcgatccccccacctcagcttcccaaaagtactaggattacaggcatgagccaccatgccaggcccacgctgaatttctcacagctgatgctgctggataaagaacttctgacacatgaagtgttacgcttgggtcttttaaacagttttttagagtgttggggagaaaattagctaagtaatgcttctgagaggtagtctaggccatgactagaaaggcatgagaagaggctgcgtgggagaggtactagaatgcactccttcttataactgaaacacagatccttctcttcccctggccatctgagttgtaggagactgttgttgcttgtgtgagattctagagggccccatccctgcctatctctggtgctgcctgtgaattatactctgttttggtgaaaatcacgctctgtccagctgtggggagcactgtctgggacaaattcccttctcagttcagtttgttaatagtttttaagaactacctttgtgcagatttgttccctggactgttgaaagggagggcactagtctttaaagacagtgatagaaaccctagtggaaaatgctcaccaacacagtatgaaatgatagaaagatactattgggaatttgggatctctggcttcaacctttttatttctctgccaaaagaaaatacgaaacctcagaggaacacaaagaaagagaatgatattaagcacagaatgattttaatctttggcagcaacccatatgcttaaaaaaaaaaaagagggaaccgtgtttccattgtcatgcacctgtcattacactgaatgagttctttttctctcttgatggatggtggtcttaaaagcttgctgtttttcattagcaaagtgaaatggggtgccagtgctaatgctttgtcattctgatggagaataatacatgaatcagtgtaattattcagtgtttgcataatcagcaagattttgaaggggaatgttgcacaactcagaagtggcctaatttcacctgacaatattccattcagactccaagcatctccttcaagaagcagtgaagtgttggtggatttccttaaggccccatacaatgatgatgggaaattgagttgtcctaaatcactagttaattatgatatgcccagcggtcacttggaggttcttgctctagatctcagtttatattcatccctattgttttagaaatgtcatttatttatcatgcatgaagcatgacatattgttccacgtgggttcagtaacgaaccaccagccaaatccattaaatttcattgaggagtgaagtaagacccagaaatgtgggcaatttgagaggaatccccccaggatggctcaagttggataaagagataggtcaaagaagagacgcattgggagtgattttggaaagctaggtaattttaatttacactctttttttaaagagagtctcttttacaagaaagtagcctattagttgagatgttttagggacctttgcaatgccagttggaaggagggagactgaattttttattaactcttttaaatcaatttattccagcccagcatgacaccagaaccaaaaaatctgaacaatgccccagggctggatcttacagtgacccagctcatctaatttggactagattgcttttttcattaaagctaaaaataatgtcaggcaggccacctttctagtgatttctgtgggtgaatcatgtcctatggaggaggccttgcctttctcagacgtagccagtgccatttgagtccgggtttgctccccttttctctgtgaagccagcctgcgttgatcttcatgaggggagtgaacaataatcgtagataacgtttactaaatgcttcccatgtgccaggtgctgctctaagcactttctgtgtatgcgccaatgtaatcctcatagccttccaagagggaggccctattattatcctcatgccaccacgaggaacctgaggcacagcatggttaaacagcatgcccaaggtcacacagccagtgagtaatggagatggggttcagatcccagcaatctggtcctcagagcttactgctcaattctgaagaccctcaaataccactgggaagttctttaactcaggaacttctgttttccaaggcaggactcctaagaaccttataggcttgaggcaaatgcattccatgtacaggaagtatgtgcttttgacacatagcatcagcctctttctggggcaactgaaaactttttcaaaagcagcacctccttggctatgggatgcaaggatactgtcattcacgtctgatggaaaaatacattttatccaaatcttcttttttttttttttttttgagacagatcttgttctgtggcccaggctggagtgcagtggcatgatcttggctcactgcaacctctgactcccaggttcaagcaattctcctgcctcagcctcccaagtagctgggactaagggactacaggcctgcgccaccacgactggctaatttttgtatttttagtagagacaaggtttcaccgtgttggctaggctggtctcgaactcctgacctcaagtgatccactcacctcggcctcccaaagtgctgggattacaggcgtgagccactgtttctggcccaaaatcttcttaaaaaacaaaagaaaatggcaaagcctagaaccaagatgtcacctttctcggtaaagctgaatcagaaaggcccatctttgttgctggggcaatatcttgaaggttacctgtgcctcatcacttgctctgtaactatttgtattccaggtaatatgcgtcactggatgaatcctttttagtgattaaaaaaaaaaagaaaggggtctctacccttatggggtagtgagacattaagcagataatcacaaaatgcagagaaagaaaggcaagcccctggcatagatgcttggtccctggaagcccagggcaaggcctgcgaggacacgccccagctgtgcatctgctgggtgatcaattggccagtattcctgtgccctcccagggactacccatcctctcctccagtacagacagaaggtgagtggtgtgctgatggccagctgggagggaggtcttgagagacatgtcaggggaaaaaattggttactatttgatggagtgggcttggtggtttgttgcctgggaaacttgctgactataaaatgaaccagaggaggatccagtttgctgtctgcactgacagatttacagacaggaaaacaaagccttcttaccggatccaagttaacatgaaaattaaaaggagtctatgcaaagcggagttcaggacagtggtttctaaagtttcttttacttacacaggaaagaaaatcacccaaactaggtgaatggtaagtttctctaaatgtcagaacaatcgattataaggcattactcagtttatagccaattatctacattgattaagtataaatttcatgatagttatgagagatattaagattttaaaaatggaaattattttataaaatacttttaaaaacccatcttttgcactgcacttatggaaccaaagaacagcttagtcaagccacttctgaaactgtcttccatgaaaatttcaccctgaggctgcacagggctccttaacatcccctctccttcctgtcttctgagaattaggggaacagtccctcagcccctctgttcatggagaccagctgagacccacagaagggcccatacccagggagatctttgctgagagcatctaggaaatcagccacctgtccttgatgttaccctgccagttttgaatatccttcttttcaaattaattgcagaaagaccaggctagctaaaacattcatcagaaccacttggtagggcaggggttgcacttatgaatgtacagttttcagagggtcttccagggtaggacctgggaatctgcattttgaacaagctcacaagatgattcttctgttcatcagacttggagagccactgccctaggacgtggatccacttgccacgcaccgaggagatgttgaggtgggaaaaggaaacaggaacgggaaggaggtgtgtttgcagtaatgcaggagaagactccttgctctttaatgctcttcgaaatagcccagaccatgtgtttggactgtgtacaaagggagcagccacactgtggtgtgctcagggagaggagttaggagatggcagcctaactctccaacttggagcattcacatggctgatctttctccttgaacttactgaggttcttccctactcatttcacttagctaagaattactactccctcttcaggacccagccttccccttcacctggattaatttaggtcccctgttatgtaccctgcagcttgtgattatctgcttactacctcaccctccatgagagtagagaccatgtcttattcattgctgtatccaccagcacctagcacaatgctggcacatagtggctgcccattaaagattatcttatttttaaaaaaattgaatatagtactctcatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtctctgggtaaagtgattagacacctctgcttgctgcttcttcatttgtggcatccatattgtccacaatgggtgtggatttgttttcataattttttagagggttttaaagaaaaactgtctctgtgagactgaaataggtgtggtcccaaactggcagtgctgagctgggctcacccaggggccagcctctctctctgtgttttttacagttccctccctgttctttagatagtaaataatcattgtgtcatcactgggttgtgtttttaatcacttttgacatttcacagtgattcctttttctaaacacatttttatttttagataactttagatttacagaccagttgcagagatagtacagagagttcttgtttccccttcaccctgcttcccctactgttagcaacttacataaccgtgctactttttatcaaaactaagaaattaacatcctgttagttaaactacatggcagattttttcctgatctctccaggttttccactgaatgtccttttaccatgccatgatccaatgcggtatcccacattgtatttagattgtggttctttctaaaggtgcacaccagaacagcattctagcagggtgtgttcctaaattatcctatctatggatatgtttttttttacgtaaaaagtagatgtttttttcctccaggagtggagagagggacacagtgaagcaattggcctctagctctttgaaataaatgggattccttgttctgcaaaacctggggtcggaccccgttcactccccttcctaccctgagcattatgtggactgacaccaggtctgtgaaggaaaaactgaagaataaagaaagcatttggaaaatcccatggttgttttattttattttattttattagacagagtctcactctgtcactcaggctggagtgcagtggcgcaatctcggcccactgcaacctccacctcctgggttcaagcaattctcctgcctcagcctcctgagtagctgggattataggcacccgccaacacgcgcagccagtttctgtatttttagtagagatggggttttactatgttggccaggatagtcttgaactcctgacctcgagtgattcacccagaatgctgggattacaggcatgagccaccgtgcctggccccatggtatttttatagcatttcttataaatcaaccaagtttcttgaaaacaataatttttgttcagaagtactgttgtgagtgaggagaacattgtgcagctcagcctgtggacatacagtggctgcagcgtgggccccaggctgctctcatgctcgctgggcctgctgggtctgctgggcctgctggaacaggaagcagcaacgcaattccaccagaggaaccacagggaaaccaaggctgactgaagtctgagaagaaagcctgtctagagtcacaggagtgaaaataagaaaacaaaatttagtcaggaaattgcaccatggaaatgtctggcgtcaggttctataaattccgacccgactatagtcaagtatttgccgagccacctcgtgtttgcttcagatctgtgtttgctgcttctttttgcacagatttgtcttttgtttccttcccattaaaaacaggaggcagcgggttagctgtgctgggttacacagcagcagatggtgttgcccaccatgggcagagatctcacatgagagagcggggagggagggtggacatgtcacacccatgccattttcctgctggaaactctacctcacacatgcagggaccacaatggatttgacaagaaccactcatataaaggcagaaagtcttttaattacataaaatctgaaactatgtgttagaagcagtggtctcttgccatttctgtggatacccatcttccatatagtcttactcaaagttaattgaagacaagcagaagtgaggcctggagtcagtgtgggggtgatttgtaatgacaagttggaattgaatcctggtgggacatcacagagctgggtgatatgtggcgtgtggtggtggtggtggtggtgaagaagacgggttcttaagaatacaaacccttgaacatgtcagatttagtctactttcccttcttgattctctgggttccccttctgttagtcttcaatcaagtcctttttggaaagattcctttccctttgtttagagaacattggtcaactttgaataacaaatgagaatagaaatgacaaaaacgtctccaggtctcagctgtgggaccttatgagcagtgttgcacaaagacattccccccaaagcctgctactgttacttttaggatgttcatttaaaaaaaaaatctcttttccctaggtcgggaagatgaccttcaccatataatttcggactaaaatctgcagattgtaaccatagttaggaggcagttcttcattaaaataccctgcatttaatctttcacatattgtacaaaagtaaaaccaaaacaaaataatactgaatggtaaagtaatattatttttttattttgctaaaattccatggggtgttcattttctttatgactcgtctcttattcctagctcattctcgtgtgtctatcacagtgaagttgctgtagacaccctcagatttctagaaatagtatctgaagtgttcccagagggaataggatttagggccaaggaattaggatggtcccactctgtgcccatgtataatgccacacagactgagtgactttcctccaaatggatatcgggctggcatattttgggacctattgaatgtttttggtcccattccagtttactgttaacagcctcatctatttgtgaacagacacaggagtagtatctatatgacacaaagggatgtttgacaacttttagctaatttggccactacagatggccatgggcaggtgagagccagaacaaagtgttggagcactgaggtttatcattcagcggtccccggcttcctgcccagctgagctcatgacctttgccaaccagagttttcctgaataaacaaacacaggtcccctaccagatggagaggtgcttaatagaaccaggctgccaggcctagcaattgtgccactagttgtgaccaggcttgggaaatttagaagctgtgtcttgtttgctggggcctctttccccagatctgctagttctggagattccagtaggcactgagcatctcactggttcctctgtgtgcatttttccttgtgctgtgaaccagcatcctggtaattcctgttaatctctgcacttcttcagagtgtcttctaaaccaggaatcctttatctggggaacttttaccctgataaatgctggtgcactgcaaattattgaatgtcattagggtgccccagaagctagattattctagactccagattgaacaatggcttatgtatttttctgaggagggcatatcctgcgaagggaagcccagacgttctggtgagttggaggtgcattgttaccgtgtccttacacactgtgtccattcactggtttagcacttgattgtaacagcatatattattttctaaactttttatctacaaaatctcgcctcatcaacaaaattgttaaactcctcaagagtagtgatcctatgtttggtacattttgctccccccagagtactgtatagcaaagagctaactggtgaaatggcttaaattataggtcaaggagctgggatttaatcctgagggaactgaggagccattggtggttcttgagctatggaccaacttaataaaaacagtaattgagaatgtgattcatcgagactgtgttggcacaaaaatggaggttatagttttatgtattcccgtccctggaagtttctgatagttatactaacaataagaatatgtgacagattaaatgaaaaatatagcaggatgtttaagtctacacaaaggtaaggtccttcattgtgacaatatgcagttttgcacatacaaccatatttggagcctgtctacaccatgttcccagcatcagtggagtcaggagagtggtgatgttctgactggtaggggctgtttttgaaatattttctaaaatctcttcatttgttaacagtttcctccctagtcttgagtagcctttctgtagaaaatctgaaagcgtacaagaggtaattgattgattgattttcttttcttttttttttttttttttgagacggagtctcactctgttgcccaggctggagtacagtggcgcaatctcatcttagtgcaatctctgcctttcaggttcaagcgattctcctgccttagcctcccaagtagctgggattacaggggcctgccaccatgcctggctaatttttgtatttttagtagagacagggttttaccacattggtcaggttggtcttgaactcctgacctcaggtgatccacccgccttggcctcccaaagtgatgggattacaggtgtgagccactgcgcccagcttgattttcattttgaacatgcatatggccccccaagcttgcatccctgccctctcttcctgcttctcacctcctctccttcagaaacactggttttcctttatggcacccaccaccacacttgctactcctggctgccactgcatgaaggcaacaggaaagcccagcctggtaccctacacctgtgtaccaaccacctctactcctcaacctcacttccttatgtactgaatttcttaagccctctcttgggataaacattaaaggtagcagcaaaaaatagaaacctgtctgactaagtgagcaagaagacgataggcgaaagcaggaaattttttaatctcatcctcttaaaacataaacaaaaacaaggcaacttgaaaatgaaatagcatggccacaaaataagagctatggtgtgcaaactgagcagtaaaagcataagatatgatagagatgcttaaggacagtagaaagatgagctatccacttctgacctcagatttcatggacgtttgtgataactcagattcggacagtgctttccaatgcagttcccatatgttaccccatttaaatctcagagcaaccctgagataagaattgtcgttgttcccattttgcaaaccaggacttggtaagatttagggactcaaacatgattcttctggttccagcttctgttgccgtgcacaatatgggaagcagtgtttcctctgacccacacagggacacagagcaagaccaaagtaccccagaggtccaactgagtatcagagcagaaaagagctctcaagagtagccagtccaaactcactccccattccccactgcccttttacagatgaggaaacagactcacaaagaccttgtaagtcacgagtcagaactgagtagtagcatcattacgggctggaagatgttaaaccttcccagttcctaatccttgtaggtttatttgtagaaggcaataaattataagtcagctcctcacagcagcccaagtggccagtgaccagcacttagtcagtgcttagaaaatgtgtgttaaacagatggaggaatgattcactgactttaattgtaaccgtatgcaaatcagtgcatttcttttatatctgtcttgacctacttttcctacccaaagatgttgtttttcactcagtttggaatgagagggtaatgtttgtagaaatcccaagacaatcagctgagaggccctgtaagtgcataaagtaccattagtggtattattgagttgcttttctatggtactgtgggttaatcaaaggcctttgtcattgttgttttaaacacaaatctccaatttattatttagttcgttgcttttattaacttatttgaaatgcaaatagcagcaaacacaggtcaacagctgcagctgtgggatgcagccagtgagagccaagggacaagatggagatgggattcccggggacagggagccatgggcttccccaccctccctggggactgactggggaggacacctttgattacagggatcggggagggtctcaggggcaagtgggcagcagaatctaaaaggaatgattgatctcagtccctggaagtggagaaaaatgactagacagcctgtaccttcctgataagtttcccctaatagattcttgctgtaaaagcaaagcccaaaaccttccagtaattgcttctggactgtgggaaatgacagtgctgaaggaaataatacaggcaaagcagtttcagtaatgccttgcacatagaaagcagttactaaatgctagcctttatcactctttcttgctctgtcacccaggctggaatgcaatggcacgatcttggctcactgcaacctcagcctcccgggtccaagcgattctcctgcctcagcctcccaagtagctgggattacaggcatctgctactacacctggctaatttttttttttttttttttgagatggagtctcgcgttcgcccaggctggagtgcagtggcacgatctcagctcactgcaggctccgccccccggggttcacgccattctcctgcctcagcctcccgagtagctgggacttcaggtgcctgccacctcgcccggctaattttttgtatttttagtagagatggggtttcactatattgtccagggtggtctcgaaatcctgaccttgtgatccgctcacctcagcctcccaaagtgctgggattataggcataagccaccgtgcctggcctatcccccgattcttatgatagcccttgtaatctgatgtactagtaagagatagtgggaaactctaaacgatgcaaacctaaatgaaccttaaatcttgtctcacttcatacaacgatttaggtgattaaagcaattggagaaaagaaagaggagaggtgtttgggaaaatgtgaatggattcctttaaacacagcacaagggagctgccctatggttgaaggggaaggaagttttcaatggtgtttgaattatgtgatttgagtatgactaatttggagaggaccactgatgtattgattggtaaagtaatgacaacttgaaattttggtgatttcctaatgagacccaaatcctgggctcagtggaaatgaatatggaaggcgacaggtaggattgatgtaataaaaagctggtgcccttattgttctaagactcgtatgtggtgaggcagtttgggtataagtgctcatgggcagaagacatttgaatggagcataactagagacaagaatctgggcccagagaggttttatgtaaatgcatataatttgatgttgaaagggttcacttatgcagaaagttagagatttgggcaacatggcctaatcactagtgattatagcaacacccatttcttgagtatccatatgccaggcttcttacctgtaagacctcacttaatcctcacaacagccatatggggtgtgagtactgttattcccatgtacgattgaggaacctgagggtcagagagattaaataatcagcccaaggtcatagttagcaagttgtagggctgggatttgaacttatgtttgccagtctccaaagcctctttcagagcctctagaagagaaggaaccttgtgcaatcaagactggaagaaaaaaaacagtcctagatgaaagattgtaaaaaggctgcttttggaactcacagaagggtactgaaaaaaaactgtagaaaggtgatctttctttgaagaagagtgtttagattagtacagtatgttactactctgttgtccctacatttggacttatttcttaggagtccttggtgattctttggaatttctctgaagagagcaaaaatgtctggtgtctggaagctactaaaaaggcagatagtgtgtgttaacataatgaaaaatatcactagatgcctacttcctgtggactagcaagtaaacactgggccatcttcaagcttggctgtgtatgtacaaatatctgtttaagttgaccatctgctgttgtattgttgataaacaccattataccagtgatttaacttatgccctggaggaagaagtgccttctagaatctcttaatggccataaaacattggcgttgatagattttagaggcaggcagccttcaaggcattcaatgatgaaaataaagaaacatttgtgaaaattcagtgaagatttcagaggccctacaggaactaggagcttcataccaagttcacgtttgagtctgagttcagttttaaaggaaatgactttccatgacagaatagtgtgagatccaggccttactcatggttgttgagtacatgcagcctccagccacacgaaataatacgttcacctggtaaagagtggaggcttcatcagaatcacacccaactagctccttctctatgccttgtcttcctccagcgtcttgtagagctaaaatgtgatgactcttttagtttgtatggaggagggtaaaaatgtgttttcaaactgagcaagggaagaagtttcagccattcctttatcttcttcccctttttttgtatttccattttcactttgagcataaatgggaatcagaaggtaggagggaggatgttattatggatcagggaccgagaataaagggcagttttcagctgtatgttggaaacttaaaaaaaaaaaaaaaaatccaaaccaaaaaaactttctgtattcattccgttttggaaaagactctgaaaaaggaatcacatctttgatcaagagcaatggtattaggtcttttactacaaattatacttttctgtgagcctgtatttattttgccaggcttgaaatagctgatgttatttaaacaactgtgtgactattgtctaggaaatgagtgtaggctgggaatagcctggctgattacattgtttagaaatgagccttattttttgcagtccctttaggtgggagggttcatgaatgttcctgtggttggttgttccatggtgtcttctgtttatatcaagtcagtagcctcatgatgtcatcattttattctaccgtatatcattttaagcctactgaagaatgaacagagctagttccattccttgagacagatatataggcaacatcaaagaagactaatctttgattagtctttgaaatctcctaatctacagaaagtagagactagggcaaacagtggggctcccaccctctccacctcagggaccagaatcctcattgtgatttgctgcaggcttctttgtctctggagagcttcaagagcaagctagactgaccatggaaataagtgacagttcattggtcaggggcctcaaagtgttacctggatgaatgagagggtctagacttaggcccagagagagctggggatttcataggctagaaagaccccagaacatagtacaattcagttgcctaactccagtgtacaccatttacatcatatgactagtgaatggtacccctgggcctggggagaacatgttgtttctccttaagattctggtacatccaccttcaaagatcccaggccaggggactgagaagagtgcaaccctgagtcagccagggtgtttgactcagtggtactcaggggacagagagagaagatgagcttccatgccagatgcatgtgggtttgagtcacaactttggcactcacaagccacctggctttggatcaatcacttaatctctctataccctggttttccatgtgtacagtgaagtcagtcatacagctgccattgagaaatggaatcaatgtcataataatactcaaacaatacataataagcagtcaatacatggtggctattgtggctcatatgaataatagtactagtgctggtgtgccaatgaaaggacaaacaaatgaaaaatactgctctctgtgagactcttttcaacccaaagggcatcttgccctgcatggccaggattctgcagatagatggacagggaagttgcagttggtgaagagtcacagtggcattcctgacttcctctgcctgtcttttctatcccaagggacttctgctccctcagctcacacttaggttctgctgatggtgtgctgaaaacataggtgttgaaaaaaagcagagctggctcagcgcagtggctcacacctgtaatcccagcactttgggaggctgaggcgggcagatcacttgaggtcaggagttccagaccagcctggccaacatgatgaaaccctgcctctactaaaaatacaaaaattagccaggcatagtagtgggcgtctgtaatcccagctattctggaggctgaggcaggagaattgcttgaacccgggaggcggaggttgcagtgagccgagatcgcgccactacactacagcctgggtgacaaagcgaaattccgtctcaaaaaaaaaaaaaaaaaaagaaagaaaggaagaaagaaaagaaaaaaacagaattgacagccagttcagaaaccttatgaagagctagtactaagttatcatcaccagagagtgaaaaggaccttcaagtccaagacagcactgcagacacatcacgccatgccaggcaggggactgaactcagtgctgcgtgcaacctaacattctgtgatgaaggattaagtcatgccactagcaaagtgggtgtgattggcgagagatgagtgtctgagctggggagaaaggaaagaaccaaaataatggcagaaatatttttatcctgtaaaagtaaaagtcattgtcagtgtgacaattgaaagaccttttcattccctctgagatattttcaaagtgattaacttgaaaaatcttcgatgtaagggctgtaacatgactgggggggcatcttttttttttctccttcttctcttacttcttggaggaaagatgaaataaaatggttttaagaaaacgaaagacatcctgaaaaagaaagttaacaaaaacacaaaaggaaaaagctccctataaaaagcttactacctgctccctgcagttacaggtatcattttatgttagcgcttatgaaatatttctaaaaaaaaataaagatgttcacatgggttttgcttccttgcttaaattctatcacctcggtggagtccagggtctttgctgcttacacacattgtgcgggacccaacatagtagggacttggtaaatgttaaaccatcatcattaaaaaaacactttctcttccactttgagtcctttaagttttatgaatgcatgcgggcagaatattaattccagcacagtgagtgttgctcaggagtgattatgccacctggcttgaagccttccagtgcacttgtggggattttcatttcactcatcatttaaagtttgtcatgaggggtctctgtgaaagaaaaatatagaggagcctcggctgggtgtgggggctcacgcctgtaatcccagcactttgggaggctgaggtgggcagatcacgaagtcaggagatcgagaccagcctggccaacatagtgacaccctgtctgtcctaaaaatacaaaaattagctgggcatggtggtgcgtgcctatagtcccagctacttgggagactgaggcaggagaattgcttgaacctgggaggtggaggttgtggtgagccaatatcacgccactgaactccagcctgggtgacagaatgagactccatctcaaaaaaaaaaaaaaaaaaaagaaagaaaaatatagagaaacctaaggagagaagactcactggacatactgtgtgaagagttctctgactctaaatagctttgtaaataaggcagttatgtttcctagtctatttcttttccaaaagaagggaggatgtgtgattgcctctagcccaacatttgtagccaactggatgagattccatgcttttaccatcattgacccaaataggtaacctaagaattgagcttaaactgcttctcttgcagcccatctgtgcttccaataaggaatctgagtcatgtctagattaggaatcagatactttttttgccacttgagatgagctcatttaatagaatgcttccatttggtgtgggataaagtatggatataggaaggaggtgtcgggatcatagagctgtaagggcatgaggtcctgtgggagcaacctcagcctcttgctttggggagggtgaatgtgtggatacctgcacattactcctggctctgccattatcttgctgtgtgacttcggacaagtcacttagcctttctgaaccttaatgtcttcatctgtaaaacagaggtttggaatagatccatataaattcatatttctgtaaccctgtgttacaggctatatgacttttttcttttttcttttctttctttctctctctctctttttttttctttttttttttttttttttttttgagacagggtcttgctctgtcacccagactggagtgcagtggtacaatcagggctaactgcagccttgacctccaggctcaagtgatcctcccacctcaacatcccaagtagctaggacaagtacttgggacatgtaccaccacacctggctaattttttgtagaggcagagtcttgttatgttgcccaggctggtcttgagctcctgggttcaagggatcctcctgtcttggcctctcaaactgctgggattacaggcatgagctgccacgcccagcctgctataagacttctaattggactgcatcatttcatcccagagacctggttcccagggttttcacaaggtaggaggcattgtttcatagttcaggtgagggtgttgataatctaggccaggactgtgacaagggtgacatcatctgtggtatgaaatttatttttagcatcagaattttgggggcatcttgagttgaagagcagtggttccttcattgaatgacactaatttggctattctctgggtctcttcttacagtttaaaaaggggctgatgatgggctggatgggaactgtttccctggtaatgttgccaactcatctctttgctggtgccagctttcttgtctgagttgtagagctcatgcctgatatgacagtggcaaaggatcatggaaatcatgtgcagggtaaccagggaaccagcgcagttgccttcagtaattaactaagacatccattctgaggtgggtgggacctcagttccagctcctctgcatatcctcagggacagggtaaggcttgtggtcttaaacagaagagctctcagtccgctgggtgaacattgctttccctgcgtgtttttacttgcaagggtattttgttcaaacaattttaatatttatttgttagggggttttatctctattcataggtgatatttacccatgaatgagtatttttcttggaagagtctctttcctttcttccttgtttttttccctcttttcaactgggtttacctgttagcaattggacatatatgtcttgtatgatacagtgccctactgttgctattttaataccatgagaactttgaaaggctaaaaccaaagtacaggacccactgaagcctacactttacaaataaaaggtaattttgtcagctaatttgtagtggattccttgaccttaatctttcttggtcccctggtcaaaatatagtcacccaatttgctttttttcacatgtccatattttaattctttgccaatcattgtctgataattgtcttaattatttgtttatttttgcttctctgcccctactagaatggaagtcttgctgaccactatctccaggacctggcatataggaagttcctaatatatatttgtcaaatcaatgaatgaatgaatagatacttaagtcatagaatatacgtcaagtccacagacccagaatctaaaataaatcggaatttaaaatgttgtacatcagttggttaaaacgctaatagaatagagatgttacttaggggattcaatggtccgaaggagtctgtggccaggaggaagaaccaagaacaaccaacagtcctgttcctggccaaaaaccaggaacaggaccttgggcaagtcacatgacctcttgggctcagttttcccatccactaaataagaggatgggatgtaatgatcattagttcacttagccatttattgaacaggactatatcactaccctagatgaaaaagcagtgccatataaccataaacatattcattacatataaaatatgcattactattaaaatgtgaaaaagctcataagtgtatcaccccaatcttgcatactgccagtagaacatgtactgcatgttgggagacaccgtgatagagcatgctatgtgctgtgacagagcaagctacaaagcctaactgtagaaccagatagactagaagggagaaatcctagtgatagcaaacatttcagtagctctgagatcccatcatgttctaccctcacaacaactcttagggtaggcattattattatccccatttaatagacagggctcagtgttacttgctccaaatgacactagtggcaagaggacttaaacccaggtcttctggctgcaagtcccaggccctgaaattttaccctgtaatatgctagctgtggtttggcaaatgtaggagaaactacatcatgtacaaggtatatcccagcactttaagcctcagagagttttctcaacattttctcctagagtaatagcttctgtggcttgtacagagcctccctaagcagcactgatttcatgatcgtcaacagaatccagggaggtaagggcagtgtgcagacccctttccagcctctggggagagaaagaagtggccactggaaccttggtggagaggagtattccaggatcccggtacacgatgggcatctgtttgtaaaaatgcatgtaaatttggcctccaaaatattccgtgtagtctagttctcactgaactgtggcccactgataacagcagtgttcactccctagagaggtcgagacagcagcttcccagcactcagaggtgtcttcctgattctccccctggctctgtgagataactccctttagccctttttttgtctgcagccagcaagacctggtgataatgtgaggcccgaggccgagctaatcctccctgtagaaatccaacagtgaagcgtcttgtctttatgactattcgccgaggatgtgtaaagggaaatgcaagccccaggcagcagtagctggctgggttccagagtcaaaactgaattaaaaactcattaagtagtactttgagcccgcaagctgactggcgcgcagtgctgggaaagctgatggtggaggaagggaagggctggcttcttcccgttggcaaatggcagactgtgggcaggacggggcagtccaggaaacaagatgaaacacagcccacttgtctgtcatgcagacatgtttgtgagtatagcttttggtacagccacataatgtatgctaattgctatattccttcttttttttttttttttccacgggaaatggctcggtgagaaagctctgaaaccaaagaggcaatgcagaaatgccaaaatgcagacattacaaaagagagaggaggaacaaagggaaacaggggatccaaatttacatcatggtttagcgttctgctaaatcagcacctccctggtccatgcaagtcatatggaaaataattgagcagaatttcctatttgggttgattttcactgcatctatctcataggttgcaatttgttaattggattttttttaaaacaagaagcaaaaattttacccccaaggactagaaagttagcaagttaagttgaaactccaaagtaattatcagagcttccagaaaatattaataagacagtatgagctggttctctctctactactgttctgaacaagacacttctcagttgaccacaagactcagatgcaaactggggaaagcacacaactgagcccacttaaaagaatcatccatctgtaagaaaactcattcagaatattttgtatgtgccaagctgtgtacctctagtgttccgttagatatccttttgcaactgtcattctttaaatcaaataaaaacagaccaagatattaaaggaatgctttgtctaatgaagcaagagtgcacagacattttatattgaaagagaatggaccagaaatgagaaatatattttactttgtcattggagtcaaaagaagtattgataagtagactttctttcccccagtaacccttcattttttttaaataaaaaagtaacattctttagagcagttttgtagttacgaaacaggaacttttataatgaatttgattagatgtgacggaaggaaatgcaagtatttttcagaacgatgtagataacacattaaggcatcatcttctgtcatttaagaattatgagaataaagagaactggagtcgggaatgtggttagactctcctctggagggatagctgacgcacggaaagcactgctcctccacttggctcttgcccctgtccagctcctgtcgcttggccaaggccctgagctgaggagggcctcaggcttgctcacctcctgcctttccaatccttaactttgaagccttgcattttccagatatctgagtttacactgagcagtggtgccctcggcaaccttagggtgctccatctcaccttccagcttctccagcaacagcctctgctccaaaataaatgaggtgttcagtgttgctttctgggcaggaatcagatgttctttctttcagttaaactccagagctctggcagagcttgatttggtccatttttctctagggccggcttacctgttggcatttttacagagacaaaatatgctcccaatttatactattttatttacgaaagagcaaagagtaatacattctaagaactttgattagcatacatatggatcattgcatatattccaagtgtatataaatacataaaaaatacccaatggagaataatgcaagacaggaatgtagaaagtgattttatgcatgctgcctttcttaagagaacttgttacttctcatggaaattaaaatctggggatttgctcaagggcaattttccccaaagtccccagattatttccctccctccttggactcattttaaactaaaatttcagtcttttaaaaagaagatagaagaggacagaatttatttgactaccttgtttgacttgctctttgtcatgggtttcagacctgtttctcaggagagctacgtctgttggttcagagtacatttatcaatgccttgaaaatgcccattggccagatttggttgaattgcctcagaaacaaatctctgtttgttaagtaaaccattaattaaatatatggcccagaacttaattcctttggtttactacatcacattttcctaaataagcagatgtattctttcaattataatatcccagaggtcaacggtactcatcttaaaacaaataaaaaatacgttgttaaggtaagaaatcaaccttcagcaaaaaatatggtttgggggcatactgtggcaccccattaatagtgaccttgtgaagaccttgtcgttgaatataaaatcaaaatgaaatctaacgatgcctcattttaattccttaagagatcttaaggggtggcagaatgaccacaggcaaaatccaatgcgcgtgtgagaaaaccaaacacacaaacaactcctgacactttggggcagtttttggccctaatcacttgaaaagagctaggcaatgtcttctttttaattatttatgcatggcagtgggtttcttgtaatgatggcccaggtgtatatttttcagatcctgaaggtagatcacctgatttgcttacttctaaagacaaagtaagcaaatcacactttgattgtttactttgcttgttaaatccctctgagtgggatttaacataatagtgtggattgaatcacacacacatttcaacccacactatgatgttaaaacccattcagaagtggagtgagtgtttgtgtgtaactatgggtatctatatttttagttgtccttttttgcaaaagattgtcatcacctaaatccctataggtggaaggctcggatctaggctttgtgagatttacatagaaattgccaccttcacaggaagttcaatgagaggtacatgaaagtatgtaaaagcattttgttaactagagtcttataagttggttggaggcaatagctcatataaatactatgtacatcctctaattgagctatatagtatagagactgttaactgctataccagaatttggggataagagacaactctgggaattgaagtggacagagagatactccctgaggaaataaaaatatgagctgaacatgtaagaaatggattagatttaagtaggtatgatgccttattttatggcacagtaaattctatcaccaaacaacactctttatttaaaacaaccttcaagcaaagtatcccactagggcaaaaaatgaatgcagtgaccaactggcatgaatatctgatttactaaaaatttagattcctgttagtggaaattaaatgaacacatcagcattgtaaattaccagtctatttcatgtaagctttagtagtatggctctttaagttgaatgctattaggtgaaatggaaaactcaatggctaatttaaaagccaagggcctgcatcctatccgtcaaagtatgattctccataggcctgagtcagcagcaagctgggtttcacatctctttatctgctctaaaaacaatggtatgaagggaagcttttacaagaaggtcagctctctgtatgatgtttccaagagagtactcaatagttcgtgcaagcatttaccctttactaaatgttttatttagccttttaataaatcttttactgctgaaatacagggtttggatttggttgaaggagaagtggtgaaaggtttagttggagaaagttcttttattaaatttctcctccttctgcccaccgagaggagctgggactatcccatacacagtggctcagtatcccctgtggcagagcctctgaagaggtgatcagaacagttaacctgccaagaccttgttgcgtggtcctctttgatgtttaatatagccagacgcggttgttcacgcctgtaatcccagcactctgggaggctgaggtgggtggatcacctgaggtcaggagttcgagaccagtgaaaccctgtttctactaaaaatacaaaaaatgatccaggtgtggtagcaggtcactgtaatcccagctagtcgggaggctgaggcaggaaagtagcttgaacccaggaggcagaggttgcagtaagccgagatcgtgccactgcactccagcctgggcaacaagagcaaaactccatctcaaaaataaaataaaataacataaaataatgtttaatatatagggctagaatatctatccaaagctttatgttcatgtagcttatcaagccttcaaaagtgacacccttctcttgctgctgcgtgtcaggacaacatagagtaggaaagggtaaagtgaaagggggaaaagactgaagtcttccctgctcagaataaggaaaaagggtaaagaggaaaacatgagcaaatatggtggcttttcgggggacatttttgagataaacatagcaaaggatagtgcctgaagatgcagtcgaggtcttgaaagaccatctgtgggccaagagtttaaagaaaaggcatttaacagtgtaagaaggacagctgcagtggctcacacttgtaatcccagcactttgggaggctgaggtgggaggatcacttgagcccaagagtttgagaccagcctgggcaacatagtgagaccccatctctacaaaaaacagaagaaattagctgggcatggtggcacacacctgtagtgttagctacttggggatgctgagttgggaggatcacttgagcccaggaggtcgaggctgcagggggccatgttcatgccactgcactccagcctgggtgatagagtgagaccctccctcaaaaaaaattttttttttaaagtggaagaaacgtgtttgggattcaatcaaacccaaatgggagaagttgagaactaggctttaaatgagacatcattttggtttcccagacagggcctgtaactaaggataaagaacaggaaagtagaatcaggactgtgcccctggtgtgccgagaatcacccttcaggtctggaagagggaagaaccaaggtcactgggaaccgggtgtgctgttctgggcagctaggcatccagccatgactgaacaacacaggcaccgtgcaaagaggaaatgcgtaggtgctgattctgtcgtcacttacgaatgatccatctccacctcaccctttgaaatgatgcagtggagttttgaaatgatgcagtggaggaataaacacaattcatacaaacaacaaaaatcacaggtcccttgggttgggctaaggctttatgtcaaatcctgtaatgatatgaccagatttattcatcctggctggggtgcaggacctgagtgtccacctgtacattacttattacagatggtggcagctgaggcaccacttcagccaggaccagagctcaggtcttgaacctcatcctttttggtcaggatcttgaccttaagaagtcccttcctggccaatcaccaagctggttgctgtggcccagcctgatgctgccactaccaatgatattgtccccctcgcagttttactggggaaaaatcaactcatactatttctccctggcctagagctaacaactttctgagggatggaaatcagtagattctaggtttaatatgtgttatgtcggccatttgcattttttctttttttttggttttcttttcaatagccaaataccaaaaaagactaattagatttttgtttttaaaaggcagctggttttgagaccgaataatagtttgatgatttggtttgataataacagatgagggtgaaaggtcaaccatttccctggatttgatcaatggcagtagtttgatggcaaattaaatatcagataaacctgtcaagtgactccaagaatcaatatttactgggaaaagttgtttgagcctttaatgattacatttgctcccaagggaaataatgctagaaatatgttcaggtattaggataggaatacataaaaatcatgtgaggatgattttaaaggaggtcacttattatgttgttattgatcaataaggtattcatcatctgtgtttctggccaagcctagcgccaagcatgagagccacatttctgcctcttattggacagagccatctggagatcctacagggacctcaaactcagcatgcctccaagcaaactctctgtcatctgtcttcctgcttccctttagaatagcttattagttgaaagcttggactttggatactgaacacctggtctccatcccagttccgctactaactaatgcagaccgttgggctgttgctccactgccctgtgccgcctttgcctcctgtgtgcaatggggatagtggcttcctcatagcattaatgtgcacattacatcagatcacagacataaagagcttaggtcaggtcttgaatataccttagccatttttcttattcagccctttatgcaatattgattgcgcatctgctgtgtatcagaccctccttatgacttacgattcctgatttagaaactgtaaaaacactgtctcctgtttaaaccgtatttcttcaggataggggtagcatctcattcatgttttaatctcagtgctcagtttatgaacgtagcactaatttgcctgaattaacctccagaaaaccatgtcttctataagtaattcacattgttttaacaaataggaaatacaaaagcaggagaagaccatgaagatttttttaaaaaggtgtctgaaacctactctagtctcaagaaagtcaggtctaattaaccatgtgaaagtggcttttttgtggtaaaaatagctgatatcggtaatcttttggttttacctaatactgcacagggcacctggcacaccacagggtttcatcacaacaaaaataattcccagatccatatctcaaatgctgggattattctataacattctgaggataatgtacctcagatcttattcttaaagattaaggatctggacctcgtaaacacttaaaacaatctgagaagcagtgagggacagtgaaaagagagtggggatcacgagtcctgtggactggatttaaaacctagttcctgctgggcgtggtggctcaagctgtaatcacagtactttgggaggccaaggcaggaggattgcttcagcccagtagttcgagaccagcctgggcaacatggcaaaacatcatctctacaaaaagtacaaaaaaattagccagccatggcggcctgtgcctgtggtcccagctattcaggaggctgaggtgaaagaatcacttcagcccgggaggttaaggctgcattgagccatgtttgtaccactgcactccagcctgggtgacagagcgagaaacctcgtctcaaaataaataaacaaataaacagataaatcctagttcagtagcttattttgtctctctgatgctggacaagacagctaactcttattgaggaacctgtcccaatagcttctatttgtccatctataaaatagcaagaatgataaacattgacctttgtgatatgcaaatgaggtaatatgaaaataaaaaattgtataaaccataaagtccatcacaaatgaagggtagtgttagtattttagtacccactctccaatagaactgaccacaatatgcataggaaatgcctatgacaggccactcctcgtctttgagattcagttttctcttctgtaaaacaagaggaagagagaggggacgaaattgtcgccaggactccttcaggtcctcccattctgtgaggtgaggaaattctgatttcttacactgtatgagtgacaaatcctgctaggcttgcggggggcacatttccttcttggctgctggaccccttacattttacatgcagaggaggagactcctttcttgtgcgttgaggggcatgtgtattttcctttgtctgcagcaggttttgcttagagaacagggcactcacagatcccaccttgtctcagcctggaggaaaccaaatcagagacttggaaccctgtcattagagcttaagtaagtggacacagaagaaagtgctttggaaatggtgaagcaaacaccaacacaaataggcattgaactctgcttcctttcttccttccttccttccttccttccctccctccctccttccttccctccttccccnnnnnnnnnnnnnnnnnnnnnnnnnnnnnnnnnnnnnnnnnnnnnnnnnnnnntccctccctccctcccttccctccctccctccttccttctatctttcctccttttccttcttttgacaggatttcactctgttgcccaggctggagtgcagtggtgtgatctcggctcactacagcctcaacctcctgggctcaagtgatcctcccacctcagcctcccgagtagctgagatcacaggcgtgcaccaccatgcctgacgaatttttgtattttttgtagagatggagtttcaccatattgcccaggctggtcactgtatttaaagagacctggagttggctcacctgacaggttaccccatcacccttcactccatgtgccttttttatttttatttttaatctgtagcttctgtactttgttgaagatgtaacccttaggctattttatcaaccacagctggtgccaggattgggctttgctggttctacttaggtgccctccagggagcccaagtttcaacaccatctatgttatttatttctacttctttcagccagaggataaaacagagaaaaagggagcaaacttcttccttccactgtctttcaccttaacccttgatatccttgattctcatccctttgccttgagaatttttaatagggagaagaaaaaaaggaagaggaaaacctaagagaatgggactgggtaggagagaaacaccgaagagaggatttagaaagcaggtcaaatgagaatcctgcacatggaaaaccaaaccaaaaccactgacaacaaaaagaaaactaacaaccacaaggtccaggaagtatagagaaaattaggtatagactcaaattaggtaataactaaattccctgtaacacaaaagatatccaaggtaaaaaaatgttgtctaactcacaagcaatgatcaatttatttaaactaaagaacattatttgcgaagtctcctgaacttgagtttttttattctcttaagaaaacaagtgttcaaaatttggagagccatagattcaggaacattttcagagatgaaacagatacataaacaaaaatttatttcccacagaaaagaaatgtcatttctaggaatattaggggaaggtgggaaagaacttggctgatggttcagcagaaaccaagaaggaattgccctcagggcgtgtgtgggaggccatagtgccctgctgggtccacacacacgtgtgtgcacgcacacactcacacacacttaggcaattcagcaggcgttggctgaccagcagccaaccctggctgcacacttacctcttacaaaggagaatcttggcatcacagcttgaaaatctttattttggatgggagtggatcaggaaaaggagaaaggaatagtgtcacagcactgaccttggccttgagtggcctcatggagcgtgacaagggtccccaggcctgttcttccacactgtcaagtcagtaaacctcagctctttcgtccatgaagagaagataatatttgccccactacttcataaaaatgctgtgagacaaaacaaagaactacctgaaggacaaaatgctttggcaactctaaggcactctacacatgcaagattttattgctgtgttctggtgatggactctctggtgatcaaaggattagattttgtcactacccatttctatgtattagccttgtattcagtcatttttggacccaggagggatggcacctggcacatagaacgtgctccaatgtgtgcatgaccttaaaaccagcacgcacattgaattatgcttttgccacctttttgttcatgttccctgttgcctctgagacacccagcctagaaaaagttcttttccaagcctcaggctgagatgtgcaagagcggatgaatgcgaaaagatgaatgagttgattgggggagttaatttgatgcagaggacccctgagaaatccagctacctccagggctaggagttttacttccctggagacagattctgtgtaatttcctggtaacaggtggccttctgttttctgtgctgatgctattggtctttggggatccgtggaattagaaccaagtctcctaccacctttgttttctaacagcacctctgtggcaggggtgagggttttgtgtctcaccctgctttgggatcatgtcctccctcagggctgaggtaggtttttgctccaggggagccgaggaagtcttctgttaggctgggttgcctcgatccttctcctggaccctctccggagctctaagctggggcacctgggatggagagccgctcattgtagcttctcagagcatggttactgggtaaactatgttcacctctttctcttcctctctgtttttcgtgcttagaaatgatgtggtgggatggaggggcacagggagaaccacctgggggctgcttgtgaggcttccttatttgctggtacctttcctccctctgaaaaggaagttttggggattccttccggccaggcctctgggccccagcgttagttgccagggatagagaagacttctgtgaggggctctggaagaaaaggttcactacaaaactctgctgcttcaggcgtctcccctcctgcctcaccagctcccattctcttcaaatcaaccacacatttgctttacctgccatgtgggtttctgcagaaaggaggcctggagctggaaatgatttcacaccataagctgctattacaagcttctgggagacctgttggttagttattaattcttagttcctgtaccaagcacctttcatttcttgctcttagccatttagctaaattttactctcaagagtgttttttgcacgaggggttagaggttagaggtttccgctcaaaaaaatttactttggtaaagaggttgagttgaataactctgactctatcattttctcttccttcccttcctccctctcttttttccttccttccctccttccttcctcccttccctccttctcttcttccttctaatgaaaagagacttcattttttattttttgaggcggagtctcactctgttgcccaggccggagtgcaatggcatgatctcagctcactgcaacctctgcctcccgggttcaagtgatcctcgtgcctcagcctcccaagtagctgggattacaggcatgcaccaccatgcctggctaatttttgtgtttttagtagagacagcgtttcaccatgttggccaggctggtctcaaactcctgacctcaagtgatccacctgcctcggcctcccaaagtcctgggattacaggcatgagccaccgtgcctggcctgaaaaacagactttaaaatcaagacatttagtgcttgtggtctttcttgatcgaccaaactttacttttagctaaatcaacccagtccttttttatctcacacatttttctctctaactccagaatcttcacattgtaagttactccagtgttgaacctgggcagggggctggaagtagttggtaggtgaagagagggcagcagtgggagctgacagagcagggaggcagagatggggacaggacggcttttctcctggctaaagcccctgcccatgccctgcccctcagtcctggttaccaatagttcaggaccctcctcatcatctccctttcatactgagtagaaatcagaggcttgctttattcttcaactaccatttctatttccttcttccaaaaccagggtgaagcctctgaggggtgtgtgtgtgtgtgtgtgtgtgtgtgtgtgtgtgtgtgtgtgtgtagatgaatgctaaactctgtggagaagagatcccgcaagcatcctagaaatttacatacatagaaaataatattttgctttaggagatttcagaatcagctgaatgtagcaaaacataagctactaaaaaagccaaaccttataagacacataggttcaattaatctgtcacattttcaaaaaggaataaaatcccaacaacagccaaaaaatgcaggcttccttttgagttccaaacccagctttgggagagcacaaacaaaagtctcattgtctgcaaggcccctcctgcttcgagggtccttagactgtcctcttttgattctgaggtggcgcggaccccttttgtcacacacaatcttctccactgcccccgccccgccacccaggtcgaggcttcacaatcatgctgagttttgtggggaagccctcaaagactttttcttatgaagcgataagtgacacaatcattccaggtcgagcccccgcttttgctgccctcagaccgatgccggggaaagttaacaattcatggggctgcctaagggtttccctgtgaggtgtcgaatggagaatgcggactacaatggtggagagagaggctggaacccggctgcctttctttcctgggaacttcttttctgaggcaactgaatgagacctttacaagccagggtggtggcctcccttcagaatgcctggcccgtttcccagtgtgaaacattccccaaatatgcaactttgtgagcatcccagccgcctgcgctgagaacccgcccgcctgccgcaggaaagctggcacccacgggtatgccaggggtgggggcgcgtcagggcccctctgccaggcttggccagatgctggggcggcccagccccaggttacgtcgtccccagaaagaatctggccaacagtctggccgtgacaagagctggaagcttctctctctccctttaaatcccctccttcattcaaatccgatcctataaaaaggcttttgttgaaggagcagccatggcatcttggtgcacgtctgtgccattcctctcaatatttccaaagatggacaaaagagaacatcgttagttgaattcctgggcaaactggtctgaagattgacttggaaggagtggaggtaaatggcaactgtcacgtggcatttgttttgtttgcaagtgatgaagccaaagaggaaaggaactgccggtggatggtaagaaggctcctgccaggggccacctcggcagcaggcgagctcactgtgtgtttggggaagagcgtgctgtggaggcaggtggactgtgcaggctgctgtcgcctggacatgggtgttgaagggtgcagctagcgggctcagggcgttgtgtaggatcacttcagaaagaaagaggctgggatttcattaccatcacttgtggagggagccactttatgtaccttgctcaagtctacttgtatggattcctgcagaatacagacgtgatgacagtcatacccggacactgcactggctgatgctctgggtgcccacaacaaaattgtgaccaaagaaatgactattccttctccttggtcttaagcttttgcttaatttcatctcaacctagtgcctttgaagctcttgaaatctttgtttcaagaagaccactgatggaaagacctagaaagaggatagtttcatgtgtcttgccaattttcattttatcattttcttatttaatttgattttcttttgctttaaatgcacatggttgtcaaaaccaaaaacaaccaaaaagccgaaaagcaatgtccaataaattacagtatttagcattcataataaatgaactttctttcctgtggtttattcttcttaagcctccgttctttgtctgctcaaactgtgggactttgttctgttttggagtttatttttaggcttttggagtaagacatcacatattttctcttaattttaacttcttttatgtggggtattctgccaccgttgcctttttttggccaatattctcttaatattttctgccttcctgcttttgtaagctcatctctgattttatttctttggacctttccctaactgtcttttggcatttggtgtctgtgccttgtctgttttaacaaattttagttccagtaaccaaccccatagggcagtgaagcagaaggactctagatccaggtgacccgggtccaaatcctggcttgaccacttactagttgtgtgactttgggcaggttaattctcttctgtagactcattgctttcgacagtaaagggggataatcatagtagctatgtcacagaactcttctgaggattaaacgaagccatgtatgtgaagtcttagaacggtgcctgacatcatcattgttctgtttaggcttctgtctgtgatgtggggtttgttggtaaatgttagctgttactgaaagtaggatggtgggggagaatgggcttggtaacagtgatggtggttggtggtgagtatttcaacatgttgctgtttctatagtacttctggtccttcctgatataaaggaaaaagaaccagtgtatcctgaactgctttatgttttttattttctaattgctttattgagatctagtttgcataccatacaatttacccatttatagtgtactagtgaatgttttttggtatattattaatttttaagtcgcgataaaatataacatttgccgttttaactatttttaaatgtacaacttggtttcattaattacattcacaaggttgtacaaccatcccctctttttttattttatcaagtttttgagacagagtcttgctctgttacccaggctagggtgcaatgacatgttcttggctcactgcagcctcgaccttctgggctccattgattctcctgcctcagcctcccatgtagctgggaccacagatgtgtgccaccacacccagctatttttttttttttttttgagacggagtctcgcactgttgtcggggctggagtgcaatagtgcaatctcggctcactgcaacctctgcctcctgggttcacgcgattctcctcttgtctcagcctcccaagtagctgggattacaggtgcacatcatcacacctggctaattttttgtatttttagtagagacggggtttcattatgttggccagactggtctcgaactcctgacctcgtgatccacctgccttggcctccccaagtgctgggattacaggcatgagccaccgcacctggccttttttttttttttttttttttggagacacggggtctcactttgttgcccaggctggttttgaactcctgggttcaagcaatcctcctgcctcagcctcccaaagtgctgggattataggcataagctactgcatccggccttcatcacctctattttaaaaacattttcatcactccaaacagaaactgtacccactaagcaataactccccattccccttcccttagtccctggaaccttctaatctactctctaactctataaagttgcctattctagagatttcatgtaattggaatcaccatgtttatccttttgtgtctggcttatttcatttagcataatgtttcctaggttcatccatgttttggcattatcagaacttcattcatttttatgtttgaataatcttccattgtattgatataccacattttacccaatcatcaatagatggacatgtgggttgtcttaccatttggccattgtgaataatgctacaattaacattggcatacaagcatctgttcgggttcctgctttcaaatccacctggaagtgggcttgctgggtcatacagtaattctattttagctttttgaagaactggccaactatttttctagaaaacagttgcttttggtcattctctcctcttgtatttctctcctctggtgtctgcctctctcagattcttttccatttcctcctgctgcctgagagtcattgtacttccaagcagcagacatgtttgtgtctaccctcccaaccatgcgtctccctcccacatttcggagagaacacccacttccctgtccttagcagctgcccaagcatgtatcaccaactgggccacacatctgcctgatcatttcatcccattgtccagggagggggagtcttcatagaaggtcatgcacaggtctccatccactttggctggagggctggttcagccaccgaatgaccctaggacctgtgagcagggggagtcagcgttgtggagccacagccccgcagggtttcagccctccttagacaggcggtcatcacaccaacgccttgctttgttgttctctgtccactgtgcatgtttttaggaggcagtttggccaccctgtttcatgggagggttgttctccacttttcatttgcttacggtgtctccagtttcctatgagcaagtgaattaattaatgaatactccaacagactgtaagcctgcctcagacagccattctggttgttgggctaattgttagctggggtttctggatgtcattcatttcacaataaggctcctaattaatctcagtgcagttctcaccagaagaaaggctgatacggagaaacatccccaattaccatgagaaaggaaatgtcaagagccccgttgagttttcctggcacccacccttgtctcagatgaaaaccgccattaccgcaaggaggctgcctagaccgaccctgaaaactggagagtgtgagagcgggaggagcccccgaccacacaaacccagcctggggaggaacctactagtggctgcaccctcttttttaatagcaccaattgtgtttcccaagatgatgtagagaatttcagtgctgtgtaccacgtcggaggcagaaattcctctgctgtcccaggagcaggcagggcagtttttatctggaaaagctaaaggtctcctcttttgtttgtgtttttgtgcctgcaggacaaaagatccttcatcaccgaagtgacgttttagaaacagtggtcctgatcaacccttctgatgaagcagtcagcaccgaggtaagcattcagctctgtagaatctggggccgggccccacacactggatagggacccagtggattagaagggctgggcaaatgggggcaggagagggacacaacagagagaagttctgggttaagaggtctttctcaacccccattaagtggctggttccctgcatcggtaccatccagaccactcctcctgataaggacaaagaagaagatagtagctggaactgtaagattttgtccaggcaagggagtatgaatttggggtatttatgctgggggtggtggggagtgctgctgggatggagtctgatagggatgtattagggaaaagagacgcaagccctcaggccgcgacatacagggcaaacctggagaagaatggcatctcaagaatggcatctcaatgcaagccccattcagagctctcctgcacactcctatcgctgtggaaaggcaggctagcatagtggtcaggagcatgggctggcaccaggtcacctgggttcataatcccacatctgcctcttactaggtgggagcctcaagcaagttatttactgtctttgtctccgtttgcacctctgtaaaatgggggtcataatagtttctacatttaatgttcatatttaatgttgtgcttagaagtgccaagtgcttagaacagagcatggcacataatgactgaaatgtaaatattagctgtgattgttattattaccaccatatgaaactgttgctatggagagtcactgggtattttggagcccagtgtgacataagaacttggttgaagccaagagtccctggtcacccaggccagaggagttgctatcactccactttccacttcctttattatagttgagcgcttttgagatagagttgcttctcggacatgaaagcagccaaagtccctgggaaccttcattgtttgcagcgtcccttctacccacactttgagcatctctgtgactgtatcctgtttttgtaaatggagatataattcaaggaccataaaattcatccctttaaagtgtgtaatttggtggtttttagtgtatttacaaagttttgcaaccatcacccttatctaattctagaatacgtctatcacgccccaaaagccctgagctcatcagcagtcggtctccattcttccccgatgccgacaactgcgaacctgcctgtcctgatttgccaattctggacatttcatataaatataatgatatactatgtggccttgcgtgtctggcttattttagcctaacagtttcaaggttcatccatgtcgtagcatgtgtcagtactgcattcgtttccaggctgaacagtgccagtgtatggatagcccacatctgtgtatccattcctcagttgacggacacttgagttgcttccactttttggctgttgtgatgtcacctgtcatgactgacttctgcctgctttagatcagcaggacctctgacaatccatgaaggtgtgaagctgaggaaagtgatgggatagcaatctctgttactaacagaatcgggaagtaattacagcttgaaaaaagctggagaattacagcctgggcaacatggtaaaaccctgtctctaccaaaaatacaaaaaattagccgggcatggtgttgcatgcctgtggtcccagctactcaggaggctgagatggaggattgtttgaacccaggaggcagaggttgcagtgagccgagatggcgccactgcacactgcactccagcctgagcaacagagtgagaccctgtctcaaaaggagaaaaaaaaaaaaaaagctggaaaattaatatatgtccaggcaaactgcccggaagagttgtgagaaaggaaaaatatggaattttataaaaggaatccaggcttgcctgtggagcagatggggctgaaacaattacttaggtacatgtgttttttgcatgattacactgtggggttcttgggtaaggggtcatggtctgtttacttttgtatcctcccctcagtgcctaacatgatgcctggcaagtaggatgtgctgaacattcatgaactgggctcagaatggataccttggtgcttagagtggtgtttgctgaaggacagctggcttcctgccactgaaaagtgcacagagagttccttagcgcaaaccatgtgcaattatctcaaagattgctatttaggggcagccttttctttatattcaatgtcaagcaccttactgatgccattggagactgccgtggagctgtgtgtgtgcttgctgcacgccttggaagggcatatgggaggggttggtttgggaccctagtttggaacaccgtgcttactgaggaggccactggggaacctggactgtacatggtgattcagcctgtgagatagttccgtcttccctggtttcgcagaccacgtgctgctagcagacatttctaacagctgtggaacaaatgattaccagctgtgaagactgctttgaaaaagaggaggaaactagggggagaaagtcaactatcgctactgtcgtgattgtagagaaactttgaaaatggcattcttgggcaaactgataactacacttattggctttgtggatgatcctacagccagggatccattcaaccctcccgtgctcttctggcctccaggagaaattagacctttggggaatgaatgctttttgctggtaataaactcccatggctccgaaggctagccctgtcctgaaggtgggatggcagcactgcccatggctcagggcctacgttctgtgctttatttcaggtgcgcttaatgatcactgatgctgcccgacacaagctgctcgtgctgaccgggcagtgctttgaaaataccggagagctcattctccagtccggctctttctccttccagaacttcatagagattttcaccgatcaagaggtaggttcgtgtctgagaatatctgtgcttctagtggcttggttgccttaggttcctctttgagagcactgggggagacaaaagaagaagggagggaacctcacagctctcctgaaataagcaaaactgcatgatccaaaatactttatttctatggctcattgccaaaagaatttagagcactcatttacaattaattggaatcattcttaatgtgcctgagatatagatgggaggggttggaacagtcaacactttacagatggtaaaaatgatggagaaacttgaaatgtcagagcccaaaagaaaacctgcgtttcctgttttctgaaataatactccaaagatatctggggcttttggcacctcgttttccaggcctaattatttcagatttcttttactttaatgcctggccccagtgtttgaacttgggctgtttgaacagcccacaaaagagagagggctttacaaaaggagccacgtaggaaaatggggcacgtctgtgacccaagaaaaagatggctaaagtagctggactgaagctggatcattcatatttctaatgcgtatcttattcaaagatgacacatataaagtgttgaaaactgtgtgaagttagtcgtattttgtaaaatgagatcaaagattttgatatgcttatttctgcttgggaatttatcctggctgggaaactttccaaagtaatgcaccttgtttatctagcttacatgtttatagcaattacagaaacaattcagacccatccccatagcaggttggggcctgcctgtggccgatagcagatttctacatggagggactgagggatgttctgataagaagagtccccacatctgtttaaaactgtctttctgaggtggtggcttgtctgtctcatgtgtactgtgaagggccacgtgtccttctgcacttaattttccttggccctgaggttcagagaaagctctgtttgtacttttcatcactggcaagaactgtaagcacactgcccaacttcatctgagtcacctggaggcttctttaaaaacactgatcagaaggcataataatgttcactctccagccactggggtggggagaatgtaaaactgtgaaaaggaacatttttgaagccacagctgtcagaaggtgtggcgtcatctgcatcttgaaacacataccaggatgggatcccccaggcaggcagctcctttctcagaggcttcagagctcactcacagttggttcatctttaccacttcaaaatgcaagctttggctgtgtcttcttccaaggccgctagagttcacgcatcttgcctcattcatctcggtatccattgcacctgcacatagtaaaggcctagtaagccgctgttcaattgcattgaaattccaaagctagggctacaattctcactctgcctactgtcctgaagttgttgtttgatcactataatgtcagaatgttttgcaagattatgtccccatgtgcatgttgtacccggaggcaggtgggcatttgtctagtagctctggggtcacacacattattagcatcttgcctcagggaagagagaaagctgcagaaggctggaagtggcccaatgacatggtgagcagttaagtggcctgcttatagctcatttgcatgcacatgggcactttccacattcctgtgcagttctgtagttattttctagtggttggtttctacccaagtcattggtttgtcttttttgccgaaaaaccagacaaaggaaatatgtaaagaaaagtgtcattgccaagattttcaataaggaagtaacacgatttggcatatttgcatctcaaataatatccctccttccccttctttaaataaggttgttatgaatattgctgcttaatcatttttactagattatggaagcaaaattttagcaccatggactgtgcacgtgtcagattttgccactaattacagaaaaaaaaatttgccctaactgaagaactcgagttccgtggaagggcagattccccagggtttatacttattggggtaggttctggaggacacatattttgattatactcaggcaggtatcattatggtcagagaccatgtcatattctcttctgccacccacaaagaaaggatgccacagctaaagtgaattgaaaaccactggactggaccagtggttatcagccttttggagctaggattgcccattgttgccttggaaaaagggttgagtaactgaataacaaacggaccttgaagaccacttgttgtccagctcttttccttttatccagtccttgaaacatactagttaactccagggaaaccaaaaccacaatttgggacaaacaaaaatgatactttttaaaaaatataagaacagctaaaaataaatggactgaaaaaatagaactatcagtacactttgagcttcaggttttggagtcttaatcactggagatcaattaacaaaaccagaactaacagacggtacaattgtctggctaaccccactcctccctgaaatccagggatggtgaaatcatcatctcctggggacatttttcagtctctgtgttggaaagtttttccttatttgtctcattgtatcttcaaggaagtgatgtgatccctttcccacctacagtgtcttagttacccttcaccaacactgccgattttttccctttcagattaatcatcttcagttttacccacagttcttcataaccctgctcactgtccttcaaacttgttcctctgtcaagaaagggaggtgaaggccaggtgctatggcccatgcctgtaatcccagtactttgggaggccagagtgggaggatcacgtgcggctaggagttctaggttgcactcagttataatctgcactgcactccaacctgggcaacagagcaagattctgtctcttaaaaaaaaaaaaactatacttaaaacattaaaaaaataaaataaaaagaagaggagatgggatgggtatggggggaattcaggagtttagtcctggtcatgttttagtgccttgaaatcagacagttggatttatgagaacagagctcagggaactcagagtcgggctggagatactaatttgaaatccattagcatattagaggtatttgaagcccagaagacacatgatgtgacctagagtgagaaacattttaagaagagaaagggcccaggtccagtgttgacaggtcataaggccaagaggaaggagccagtaagggagacttgtttcaggtttttgcttgttggtctaatttctctaaaatgtcatgactcaaactggacaccctattcaggagtcatttgaccaggttaggattgtgagagttgataatgtctatagttttcaataccatcttctattaaagaagtctaaaagtgacttttgaccatcaccatacaccattaatggtcaatggggaagtcaatggggaagagatgcaggctttgaggggctcgacaatttatataatttaagggctcttttttaagaaaaatgaaacaattattaatatacagttaagtacagggccatgccaatgaggtaccttgaagtttaagcttctttggcttcatgataaatccatttgactgtcaactaaaatccctgagtcttttccatggatattattgttaagccacatctcccaatcctgtagtttaccctgctggtttattgaaccttacatttatccctttagaatgccatcctgttagaattgacttagccaccatcatcccaatgtcaagagcttttataaataccttaattctgccattccacattttgctgtgtctcccattttcataccatgcacaaatatgatatgcatgccttcgccatttttatccaagtgaatacaggccagaaaatgagacttgaggcagcccatcatagacctccctccaggttgacattaagcagcactatttatatggctggctggaaatccacctaattctactatcacactgttcaggggtcctattaaatgtctggctaaaacccagagatacactgtctactgtatttcctcatcagccaagcaagtaacctaatcaaaaaggaaatgtagttcgtaggccatggtttagaaattcaaatcttgtttcattaatctcatctgcagtaaaaccatttatttcttacatcttccttcctcttccagtatgcctgcatttaatcagaaaaagtaattaacaaaaaagattatctttgtcccaaagcatattcctccttgttgcatctgtcatccaactttgtaagaaccagggtagcactcagtgtggttacatctgaagtacccactccaggaagataacatgtgttgaactggccaagtttggcacacagatcaacaaacatctactgagcctgattatgtattgaggaaacaaagataactaagatacaaagatacagaagatatatttcctgctatcagaaatgtttagagtagtgggttataatagttaccatttatcatggtgatgatttcccaatttgttcagaagaagcctcagtttccaagtctaagaactagtcacaagcttccttgccactgctaacattgttggatcctccttatggttctcatctattcattgaataagcttggtcaggtgctgccgtgggctggccactcttaagaccctgtctttgcccttgaggcactctctactgtgcttgttggcccacaggtctggaaagaggctgtgggggaaaacacgggcttcattctgttgtgtagttccaaggatgtaggagttgttcttcctcctcctccctctgcccaattccatctgtctgttttatgactgagggctctgtccagccctgtctctgcattcttgtctcatcattcagaatgtgctgctgtttcttcagagggaccagattttccttctctggaaagaaacctgtcaaagcaatgctggctttcttttctgctttgccttgtacatcacggttgttcattcaccagtgtctcttggctatctttcatgacctctgacttctcagaattctgtgcaatcttgttttgttttggggtcatttcctgcatttcatagaaattctctggatagaggtgaaaagacggaaagtaggaagatattccttaagtctttctaccttctgcttcaacctggtaattacatactttacataaaaagagccagtgattgaatgccccctactcacagctggattatacccttggctgccacacctctcagctagggtggaatttcaaaaattaaaatgaactaaacttaatttttaagtttcactattaaagatacagcagttattctagatttgccccctaaaacatattataaaacatgaatagtttgcatgtgctttgtgtgaaaattgggatctagagacttttaattgtgctatagtgattgtgatgagagtctctgctaactattgtacaaaaaaccatatttgatgccctatgtttgctttggccagcaaatcatttgagcaaagatgcctgtcccctctacccaaagatggtattaccatttgctttttcacttttcttagctcccaaaaacaggagttgattcttatcctttttacagaaaattgtgaagtcacagaaaaacagcaaagttttattattttgttattttgcggccctttacataaaatgttatgcttaggactaatatgctaacaaaacaaaaatgactattttactgcaatattgcagtcgaatataggaaaactcagattctataaattattcttacacacattcataatagtagcctcagaatgctgatagtcaggagatagaggaaactaatctaatactagaaggtaagagttcagacctgctggctcagggatgcctggaccaaatgaaaccttggctttaccccttgatcatttgtcatccagaatacagagcccttttcagtcgaaactctgagctgatttgtgagctttactgagacggaaagaatattggagttgatggcatgattctccatcactaatttgctaggctaagaccatgaaatatatggccataatatggagtgagagagacaagtagtgtttttattaaaccacaatttctgttttggtcctgatttgcttttctatgtttacatccttgggaagtactaaacaatgtgttgaaaaatgtttcagccacatttgatcttagctgctcacacccaacttgccctgaaaagaatgggagcagtaagagaacagagtggctcactgtggagttaaacatgagcaaatggggaacgaacttggccaaaccactttaatgtcatggctttaataaaaaagtatttgtatctgcagagaatatgctgggtgacccactcatgtttcaatcagcgtgcactgatgccagaaaccagtaattttttgtagtaataggcaatccgtaacttcttgtctcctatggggaaaaacccaccaaggttttttcttttttacatgccagatcctgaaaggaggccacaacaagtgccctgttaatctgaatttctttaaggtatccatcaggcctttttttttttttttttgccaagtctagtggaataaaagaaaatattttttattagtggtgaaatgacccagacagctttctcttgtgatagtttaacgtttttttttaaagggcatctttgcctttattctaggggtaatattcaaagtgtttcataaccactgcagcacaatcctcagttgcccaggtggtcactggtgttagaactggagcagagtactggcattcccctgctgggcaggaatagatggtggaggggttgttggggaggtgccagggcgagtgggtactggttgaggtagaagccagtagcagcggggctcaggacaaaggctgttcaccttccagtagggaagtatttcagcatttaagcaaccaacatcactatgagagtgcatgtctgaaactggtcctatgtgcatcctgtgatcctgtaacacatagttatagctggagatgatggatcagtgatgataatcacttacaccttttctttctttctttctttctttaaaacccagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggtaggttgagaaggctgggcattggatatatgtcacaaccattctacttgcgtttacagcctttatatttccctgtttggctttgtactgggaagatgagggagcacaattgatgctttaccttccctgtactcttctcctctgcccaaaggtatatatctcagtccagtgtggccttaaggcttggaaatagctcagtgtatggttcaaagcagctgtgattcatcactgggattcctgattttgtgccgttttcgaacacagcaactacagccctgttctaaatcttcagaaccaaggatgtgtctttcaggtgcttctggaagactggtttcagccatactggcctcagaatccagcagggtaacacaggccaggagctcccaaaggcctaaggagaaccagaggtttcacatcaagactggatcaaccagtctagacccaagatttagagtccttttttaaaaaaaattttttttaaattaaaaatgtttacatttttatttaaaacatcaccaggttggagataaatcctcattaaaggcagtgttccattttcttatcagccaaaaaatactataatttcagttgaccagtgagtgtccggtgaaaattgagagaaaaacattgatggctctgctcttacccttctcttaccccatggcctcattagtagagactcaatgctatttcagattaaaattccactgggaagctagatgcatggcctcatgcctgtaatttcagcactttgggaggctgagatggaaggttagcttcagcccaggaagttgagaccagcctgtgcaacatagcaagaccctgtctccacaaaaaaaaaaaaatgttttttatagtcttagctacttgggaggctgaggcaggaggatcacttcagcccaagagatcaaggctgcagtgagccagaattgtatgtatcactgcatgccaagcctgggtgacagagcaagaccctgtctctcaaaaataaataaataagcaaatgaaatgccacttggcaagagcaggtatccctgatttttgatcattcatgtttttggtcatgattctcagatttatcaggttctcagcaatgacctgggcttttgatggaactggtctatggcagtactgcttcattttgttgcttcacatcaatcacaaggattggcattcatacattttatttgctttaggtaattattcagagatttttagatcacaattcacaaagtaatgtaaatggacccaaacatgtaaggcacaacataatttaaataacattgccctgatttattagggaaaatctgatagagtaatctttggagctctccaattaagtacactttaggatacatttgttaaaactgcaaatttttactttaaacaatatggagtatcaattttaaggctcagttctcagcacatttggcctttctacatgcacatagaaaataatcggaattttttcatgtttaaaatgaatgaaaaaccaccagataattaaccctttcatctgaaagagttgacaactgacctgcacttaggagaaaacatgaaatccatttaaacagataaaaccaactgcaaatttgccagaacatatacatcctagcccacacaatttttaaaaaaactttttttggacatttaaagaggtaatttaaaggcaaagtaataagtgaaaatgagttaattttcatttattttggagatgcttttagatgtctaaaaaggcaaagttgcagtactaattgacttttaaagcaaacctgggcagttctgtcagtttgtgcttctgtgagcaatattcatttgatgttgatggtagtgatttagagtagagggcgaaattggcagacatgtttaattactggaagaactgtaactcacaaacttctagtacaagtcagaattctttaggaattctttggatattttgagggctttcggctcagattcattaaaataaactattgatctattcatagaatgaattagcttatccaattattactttggctgattctcaccactccctaacctctctaaaaataaaactgtacagttgatagaattagctggtggttttcaatctgggatgatagtctttaaatatcctatggagaaagaggattaagcatgtaaaatctagctggtgttttaattggctttacagcaatgaaaccagctgcatattagaatcgcctggggtgcttttaaaagacagtagttccaggccccaacccaagcccacttaagtcagactctagagaatgaggcctgggtgtcagtattaagcatccgaggtgattctgattatatagtcaggctgaagaaccactgcctcaaaatgctagttctattaacatttcaaaagctttaaacttcctaactggaacaagttagttttcccagacctttgtgatttgactgggggttttggttgcagtctgatatgtcctgattagctagagaaagcctagtctttctgaaccttcctttgcccaagtttggcatccagccttgtctagggaaagaagtatcacttttcagaatactgtgctaaggagagaatatggtgtttcatcagtttatgaatgagatggaggtgctgagggccttggaaatcatatggggttaagatcaaaactatttgctaggtagaatgttagggtataatatccagctgtggacaaaattgctatcaatgagaccctaaaatagagcactaagatcacttagctatgttttgccaaatacagacgttttcttttgacttttaaaatctacttcttagatcacttatcaaataaagaaacacattaacaacttctttaggaggagtattatatctagtgccatcttgggaaaggccttcaaactcttcttgcttcctaatattggttgtccacaaagggaaactatcccattcttcatttctcctattgaggtggtaaacaaccatgttatgttttgtcacattgctagcgtaaatgcccttgacagattaccagggagatggaaatgctgtcaccactttgcatgtctcagaggacctacttgtgattgaatagggaaggtgtgattgagtggggaacatgtgctggatgtatggtctcttcaccttgctatgaccttgctttgtctttgtttatttacccaaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgagaactcctcgacagtgtctgcactgccgattgagctgtgtccagaggcaatgggaaggaaccatgtttaaagaggcacctcatgtggctgatcgtggatccacatgaggtgcctcctgtgtctgtcacacacgaaatatcctgagaacaaagtcagtttaacacacagtaggtagtctgaaataatattcttggcaccaccaccaaccacggccttggaggaaagacaccttaactaaagcagaaaccatttatctgcaaaatgggcctaagattaattgcccttcctccagtatgccaagagtcttgtgtgtgtgaatcaaagcggtcatatttccatatgagagctcctgaggaattgcctttcttcctttgtgttttatgagtagactgcggctaggaatatggccatttagaaaaacagctctccatgtgaaattccacagcaggagcattgctgaatatagtccctcacaggacactcccaactcccaaacatcatgcctgaccacaaaccatcccttatttatttaatgacagggtctccctatgttgcccaggctggtctcgaactcctggccttaaatgattcttagaaccagctattattaattcagctgtgatctttgcttatcaagttttatttgtggttctgtacaaaattacctagtaaattgtgcttgtatcatattatatagaattacttgttatttaatcatatgaaatctaatgagaggcacccagtggctccctactgaatgctagatggaatttatactattcaggacattacttacccaccccatacctccatccccaaccacacacataaagtaaaggtgcagatctttgttctcaggacaaaatgttagttactcacaatgagtgggcttttgagggctttgaagtgcgcgataaaatccttggattaaatatgcaatatcttttatgcaaaacttaccagttgtgttaaaggaaatacaaaaaattgtaccctaacggaagcacttctcttaacagtaaagaactgagaaactgattaattgctttttggttccagccttcagtttcccttagaaacaatagcttttctttgcagctttattctggttcctggaaaatatacattgaaaaatcctttgcatttcttgaggaaaatagaaaagttttctctcatttcccttcttcttccagtggtctaataccttgctattcaatttttttcatatggtttctgtttctgcccttaaatagctattttttttttctctccctgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtg

SEQ ID NO: 16109 - DNA, 85913 bp, Human
gccctgatgcacagagttgcgcagcactgagttagacaacaaatagagaagccaaggtggcggtggtgagtttggagttcagtggaggggcagaaagagagaaattaagttgcagatgtggcacccataagcgtctgcaggtggtggtggtggtgagtctggagttcaggggaggagcagaaatagagaaatgaggttgcagatttggcacctgtaagcatctgcatgatagtcgtccacaggctgcatgtgactatctatgggaagtctagatagagaagaaggccaatgctgagccttgcgatactcaaatgtttataaatctagaagagggcgaactgccaagctgacagagtgagcagccagggtggccagagaactggagggtaaggcagtgatgtggcacctccggagcaaaggaggagggggacggccagctgcatcaagtgctgctaagagctcaaatagaatgaaagtagaaaatgaccattggatctggcagcacataggttataagtgacttccacaaaaggacctcccatggttgagggcagtgcagcagaacttgatgaaaaccagacaaactggactggagggagtgacaagagatgaggagctcagcctccctgaacagttttgttgtcaaagggaaaagtacagccaagcgaggggtggtgtttccttcgctaaagagattaggcctgtctgaatgcgaatccagcaaggcattgcggaagttaacagcagttgcaaaacactggggcaggcgggaagaacacgatccaaggcacgagagccaggggtcagccacggcaacaggaagatgatggtgaaaaccaaaagtttctgagagtggtctcaatttaggaagtttattttgccaaggttaaggacgtgcattgacacaacctcaggaggttctgatgacatgtgcccagggtggccaggaaacatcttggttttatacatttgagggagacatgagacatcaatcaatacgtaagatgtaggttggctctttaggaggtaaaatgtgaagtggaggcgtccgggtcataggtacatttaaaggttttctgattggcaactggttgagagttatcatctaaagacctggactcagtagaagggaatgtccgggttgcatgaaggagttgtggagaccaaggtgttatcatgcagatgaagccgggaatacactgcaaatgtttcttatcagagtcctctattagtcttagggtctccgtgcggatgtttgtgaggccatgtttgacttccgcttcccatcaaggcctgaactagtttttcaagataacttagaaggccacaggcggaggggagggtccatccgttggctgcagggcttagaattttatttttggttcataacgaggagggcagggacagaagccaccgtctctgctccccagcgctggccctcactcggaaagcaggctctcccctcgcatcgtcttttaacaaattcctgctctctcggcccccgtcgctgccatctgggctctcctttccgcgcttcattaggcgctgccgcggcaggggctgagggcctcaggggacggtcgcctccctgccgggacgccccggccctggcccgcactgtggggcgcagtcacccagccgtcgccgcgtagccaggagcccggctgagcgcgttcgctgcaggagccatcctcagctgggccctacttaactttccgcaactccagtccccgcagccagtcggggaccccgcctccctctccttccttctccctctcacttcttcaccccttcttttccctcccttcctcctcccctgcccgcgcccccgcccccgcccccggccacagcatccgacgtggcgcggccggctgcgcacgcaccgtatgcttggcttcgcggcccagcagggcgggcgggccgcggtgacgtcagtgcgcatgccgtcggtgggctcggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccggtactgactcttttcctctctctccacgcgcgggtgccgggggcgggctcgaacccgggggcgccgggcgggggctccgcggggagggccccggcgagcgctgagacgggttccgggccttgatgcccgcccgaggggcgcgggccgcggagaggtcgggcgcccaggcccgggacgagcccgccggagcttcggccccgcttgccggcggcggcgaagcgtttcttcctgaggagcgcgggcggccgcgtacctgtgcgattgcgcgcaggctccggtgccttgggcgaacccagttgcacaacttataacaaagttttggcggataatatttacttagaggatacagatgtctagaaagaaagtagcagaagcaatgaaaagtcagtggtgttaatatcatggtgatgattaattagaggctgccagcgtttcataccgactcaagaaccaaggagcggaaataatttttatcattaatcactcaatatgactttcaccgccagtttcttccacatccagattttttttttcccccaaagttgctttttctgattttgagcaaatcctaaacttctgagccaaggaagttaaagccaggaaagagcggtctttcttagaacatagggatctaagcagccttcatgcttctgccacctcctcctctctctgggcacagttcctgtttgcactttggattctgtccagacgggtctgtttccgtttctactctcctttccagtggcagtcggcccatatggagggacactggtgagaagatcaaaggccttgggtctcagaagccaagtcacttcaatgtatggatgcgtgaggttcttttaggtcttaatagcacgccttagtgtcataaactcagtcttgtaggaacagaagtctttgagaaacatggcttcttttggtggcacatttgcgccattttcttgacaataaagattcctggccaggcgcggtggctcatgcctgtaaccccagcagtttgggaggccaaggagggtggatcacttgaggtcaggagttcaagactagcctggataacatggtgaaaccccatctctactaaaagtagaaaaattagctgggcatggtggcgggcgcctgtaatcccagctattcaggaggccgaggcaggagaatggcttgaacccgggaggcagaagttgtagtgagccaagattgagccaaagcactccagccttggcgacaaagcgagcgagactccatctcaaaaaaaaaaaaaaaaaaaaaaaaagattcccattatccttctctgctgtcctccgctatagggcgggaattctctgcaccagcacaatgaataggagcggttctttaaatatgttgcagtccagagtaggcaatatttttcagtggtgacggaggctctctacaacaaaactaactggcactgggaaagaaaaatgtctaactgatgccagagaacttaagaggcatggggttttagaaaatcattccactgtgatggaaaatggttttgggggaatttgtgttgcattggttttaagaaaaaaagtacttcaaagggagttttttttttgatgggatttcttttaaggataactgacttccattccaccacagcgggtccctgtccactgtggggaggagcgccttgatttccaccccgggcagggctgcctccaggaactgcagcagccacctgctctggccctccactccccaggacatgggttacattaaagcgtatctgttggaatgatacagaaccaaagtacagtaattaaattgcatacagagacacacccataaagaagttttttgttttgttttttgaaacagagtctcactctgtcacctgggagtgcagtggcacgatcttggctcactgcaacctccgccttctaggttcaagagattctcctgcctcagcctcccgagtagctgggtttacaggtgcctgccaccacacctggctgatttttgtatttttagtagagaccggattttgccatgttggccaggctggtcttgaactcctgacttcaggtgatccacccacctcagccttccaaagtgcccatatggagatttttaaggtcagaggtataaactgtacatactcactccctgggagaaattccttgctggactctggttttctttgaattgcagagtaaacagctaggctttgtgaattacagagtaagtagtttatttacccctgaggagggaagaggcagcttatttgtgctagtgtagcagtgagcttgggttctaagtttgaagacatcacttcacgcttcactggggctcagtttttctcctttatgaaattcgaggtttgggcctcggggcaagtcacagggtggggctgtgtttgctgcagtgagtctcacgtcccgcttcagcatcagggtaccagcactgttcatcccccaggtaaactcctctagtaacttcagggcaacccctttagacttacggggtgagctcttgcgggtggctgtcaccatctgtcatctgtctccaagaccatagttagaggaggggcccaatagcagcactcctcaaatgccagcagcatccctcaaatgccaacagcacccctcaaatgccaacagcacccctcagatgccaacagcacccctcaaatgcgctttcctagatgttacagaggaccatgtgtgaaccttttctggcaggaagctctggtgttcttgtttagtctcgcattgccagagagtaggcagctctgaagggtagatagtttttaaaaaaaaaaaaaaaaggcggcccactacactaaaggataatcatcaaggatagccaagagcacagttcataaatcaaaatcactgccttaaaaatgttgagaatgctttcattaagtgcttaaattggataacagacttgtgcctcaatgctcaatcagaaataataaaattctcttacagtgactatcttaatgttcttttgtgtcttctctttgttgctgtctggcccatatctcctgtacattccccgcaatccccttgttttccttcgtgcactaaccttcgcctctctgcctgtcttcttgcttccagggctgggtcttcttgatctctttattcccggggtggcacaaaatactcaataagcactccagagtttccccagggcctcttctcacccctcactgcccccatagcaaaccgggcccacaccttcctcaactctgagctctctgtactgtgcgcagggatgcaggtggtcctcttggccggttcaggcagcagactggtggaaacactaatgaagtttgttgagtgtcacaatgtgctgacacacttctaagcgcttggcacgtttaactcatgaaatcaccagtcatcttaacattgagataccgaggacagtgccgtttaaaaacctgacccagagccgggtgtcgtggctcacgcctataatcccagcactttgggagacccaggtggggagagcacctgagctcaggagttcaagactagcctggccaacatggtgaaaccccgtctctaccaaaaatacaaaattagtcgggtgtgctggtgggtgcctgtaatctcagctactctgtaggctgaggcaggaaaatcgcttgaacctgggaggcagaggttgtggtgagccaggatcacaccactggactccagcctgggcaagaagagcgaatatttcgtctaaaaaaaaaaaacctgacccaattgtttggagtgtctgttgccaactcccctgagctagtgacctagtgggagcggccggaaaggctgttgccttttggaacttcagcagcccgacagacgactccatcactggccaggtgcctcctcccaaggtgggagacgaatgaggcagtttgtaaaggcttctgaagagtgttagagaaaggtgctgtgcaaatacaggtattgttatttacaagtgatggatggcactgcatcatgtcctggcaaatgtgctgtcgtctgcagtcctctgtagaagtaatccagccttaatgatttgagaccttaccactgctcttgactacaaaatatttgcagagaaatggggtgagactgcttgtttgatgagttattgcaaatgcagattagcagagttagaattagcgagattctttctgtttcatctaacagcagtcatagcattccacagcagaaaagaggacctaattataagcctcgctattactcatttctgccagtctttgtgagtctgtggcagtgagatgggtaaaatctctttgttaaatacattttgctggccctgttcccctccatttcccagtggagccaaaaccatgtgtcagtagagttctcataaatctgctacatgatagctttgaatgttactaatcttacatgtggttttctttgaaaagcagactctacatcccctctcaaagtgaattaaatggaaatataagcacgattatatttatttcaagccatgttactttttttagtaacttcagagtaacttagttctctcttacactaattgatacgtcagacatgagttaaggatgcctttcaaaagtctagtgtaattctccctgaattatctccctgcagaaagactttcagattatccattgctagaaacagaagactaatttgtcttctattaaccctgtggtcacagatttgctaagcatagtcccagtgtcaaccagtcaggaccagaaattgaatggtccaggtaagaggtctgcccttgttcccaacatgccaaggaaaacaagaccctttagttactatcttttttcagaagccttctgtcaaggtggcccatggtatttcacctcttccctagcctttttttgttgttcttgtctagacagggtctctctcaggcttgagtgcagtggcgtgatcttggctcactgcaaccttggcctcctgggctcaagagatcttctcgcctcagtgtgctgagtagctgggactacaggtgtgcaccaccacaaccagctaatttgtgtattttgtgtagacacaaggttttactatgttgtccagtcaggtctcaaactcctgggctcaagcgacctgcccaccttggcctcccaaagtgttgggactccaggcatgagccaccgcacccagccttccctagccatttttggttatctgtgacttctaacgtctttgtgagtgtccttttcattttggccagtgccctgtgcattcttacttggttttgtgactgcttttcccttcccagcttcagaagttttttttgtttctatagagaatgttcacttttgtataaagtactatattaggtatagagaatggtacttcctgttgtaacaaacaacctaaattctcagtggccaaactaatccaggtttatttctctcctgggtggggtcttcttaacaaagagcaattcagaggcccagacaccccttgctgtataacactagcttttcattgtgtggctgctgctgaggggacaagtgtaggtcgccgtgctggggtccgtatggtgtggcccacaagtggtatgcatcatcacatcagtttcctatggctgctgtaccaaatcacaataaacttagtggttctaaacaacacagttttattatgttacagttctagaggtgagaagtccaagatgggtctcactgggctaaaatcaaagtatccacagggcaactggttccttctggaggatcggggagaatcccattttcttgccttttccagcttctagaggctgcccactttccttggctcgtggcgccttcctccacaagccaaggaaagcttcttcaaaggcagcaatgaccagtcacatcctcacatcacacactcagagccctgactcttccgcctccctctttcacattcagagacccttgagattacatgggcccacctgggtaatccagaataatctcctcaccttcagtctatgattctaagcacagaatagcagtttcccttcttcttcctcagcttacagtcagctgatgagcaaccttaattccatctacaaccctcatttcccctggccgtgtagcccagcacactcacaggttccagagtggggggacgtgatgacatgatgctgcccaccaaagtcacttttccccatactattgggcaggacccagtttgatgcccccaatccaactacggggaagctgggagtgagactggcaaacacctgactagtcctagcctcaaccaattcccaatgacagcttttccaaagcacttccaggcagccgatcctactttcccctaaactttttgaatcagcctccctgcactcaaggatatacatgtagctgctccatgtacctcccagcttgaaaggggcccagtcagctgtccggcaaggtgcccatcctggcccagtcagtactcattttgtcctttgggtcagaaactatgtcaaggatggaacacacactgctgtggaagatggagtgtttggcccaggggggtcccactatgtctctgaacttcattctttaacagggttgctccgtgtaatttaagagccttctcaccttcacagtctatgattctgagcgcagaatagcagtatgaagccaacgagagtgcaaattcaggaaagtatctggggctccagctcattttttagcacaaaccattacttctaccttatctatgcacacctgaaagctcctgtaagggctccacttggtctgggggcaaggttctcattggggtcttctataacttatgtctgttattgggccagactgtcagtacccactctctgcatacgttcttaccgcctctcacccctttatcctctccactttttagggttcccaccttcaggtgcatgggcttccatagatgtgagtctccacttgccagtgattctcctctctcctggtggagtcatttttcttaactaagataggccatagtcccttgccctgttcgcattgggaagttctacccacctaatctcaccagcccctttgcttacctgccactacattgctctacctgagatcctttggtttaatcataacctgcagcactggttgttttctgttttgttttgttccttccactggaacagtcctcagaacctttcgtcacttcttttaggtagaagagcttccctttgaataacatttccatagctcttctcaggcaagaacaaaggtagcatatacttgtgagtcatactccagtacctgcagtggatgcttttgggacatttgtgtgagttaacagcccttcctagctccctgctggaaattgctccctggttcatggaactcttccagtatttcccctttcttcttcccgcagtagcattttctagtttgctatttggcactagcagatagcaagccaccagtgactgcatcttacagccaggcatcctgacacctgaggacggatgcttggcccagggtcccacatagtcatttgcctccttggtgtttgcttacctcccagatgtgaccgtaggtaaagcttcctccactccccttcccacttgggcaggcagctgctctgtggagagcttttcatttcaagctcaccttcccttatctaggtagtgtaataacctggccctgtctgtaggccgttcctttgagttactctcagaagccatggtgctctgcttcctggaaggaatctgatcaaggaaaggcttacctacgattaagggtggaacccagtttgccgcttgccagctgtgcgatttggggccgctggcttccccttctccctgcctcaggatctactccgtggggctgctgtgcagtgaaagatgcgtggactccaagtggttagagcggtgcctgccacagagtggtgatgaggagcagaagttggatctgtgattctcccaaagcttcctcaggtggtgatgtaatgacggaggtcctggtggtggtcagcaccacgatgggcaggtgctttacagggcatggccttcattccccagcaacccgtagggcagcgctctttaaggaactgctgtgaagagagggtgaagagctggaaaagcaccaacgatttgaggactccagaggcctctcttgagtactaaatgctaacttaaaaacccatttaataagactagctaacagttgagcacatcctgtgtgccaggtcctgttggaggcatttcatgtgtcctaactcatgtaatcctcagctggccctgggagaggggaacattttcactctttcttcataggtggcagaccctgaggcacagagagcttcagcaacttgcccacacacagccacacacacaagcacatacgtatgcacacatgtgcacacacttatgcacaggcacatgcacacacacacacacacaggcagaactgggatttgatcccaaggttctggctccagcatctgtgttcttatcctctgcacagcacttctgctaagaggaagcttattttttacatttgaagctctcatttgaataacaaccaccacgacaaaaatctaaggtttttctgtttctcctaaaaatactgatttgcaaataattctgcaaagatttctgcaaaagtaattcttcttttgtagttttacaaatgaagagttctagagacagtgatacaacaatcacaataaatatgtgctgtcatattttttggcagtattgtaagttaaaatgaatctgtctcagctttgagttattattgttattattgccactttttattgctacattaatcaccaaacataactgagagggattaatgaagttaattgtttttagaaactaaattaaatgcaaatgctaatgctgggtgactgagccttgacactgtgtgcttatttcagcagaggagcggacaggctgccctgcaggagcttcagaagacttgatcatttcaaatgtcaccttaacattcatcattagttttctttatagttagttgcacagctctttttatttttactttatgaacacatctgtgagttacagtttaaaagttttatgtgtgccaagttggaaagattcagagatcatttttaaatgggcatctgtattgttggtttggcctgccttaacaaaataccacagactgggtggcttaaaccatagacatttatttctcccagcttgggaggctgaagtccaagatcaaggtgttggcagctctgctttctcctgagacctctctcctgggcttgcagatggcactttcttgctgtttccttgcaggccatttctttgtgtgtgcacaacccggtgtctctttctcttatagagacaccatttctattatattagagccctacctcaattcctcattttaacttaattgtcttttaagaccctctctccaaatacaattacaatttaagggtatgtcagttaggacttcaacctatgaattttggggggacactattcagcccgtaatagcatctttcatcaatttctgatgagcatgggaaagaggtgggatagagcagggagggaaatgaatttttaaaaaatatttagtgggacagttcttctaagctcttccttgagcccgaaacattcataactctgagatcctgtgtttcaagagagtggaaaatgaccctaaggtgtaggtagataattgtattttcagtctccatttctgattgggaggccaactacgtaggctgggaaatctttttaatcttagattaaaaagctgcctgcaaatggtaggtcttttctgttttgtctttggctttttgcttttttaaaagaatttgaccttgaagtgaaaggaattcctggaaacccaaaacgaagaaggaactgaaattcagacctttagcatgagaggtgggcccacaggaggcagggagtagccaaggttggatgctcagaggccacacccctggggaaaggtggaagagggaaacctgcccagtggccctaggagggccaggaagccggactgtgtcaggctgggctccacatggggacagaggtctccttgagaatttgtaaacaaaggcttgcttttacatgagttcagttcgtatttgtactgtttggcaatttgtcttctgagaaatctgccttgaaaaggattttcagacacctatactcctggcctgacaaaaacacgtgtagcatctccccagagggttgctgtctgcatcacaggccccatgagatccttactggtaaagcccagtgaagacagattcctcctccaagtctcccaggacaagagcaagaatccacaggcaaaaacagacagcaggattagactccagaggacttcagaaaatcaaataattggatatacaactaaaatgattaaatatataaaggaattgaacgcacaagaaaagaataagaccccatcaaatacctggtgaatttgagacaaaagctgtaggaatgaaaaatagagtgattaaaaatcaattgatgggatatagagcagatttttgagaggattactgaacaggattctgtttccttctgccccaagtagaatgtcctctccgttgagaagaggtgcgggcagcagggagattttagttctaaacccaagccagaggaaatagtcgtcattttccttgctctcttttgcccttttctaacagccagctgctggggcagtgctggtcctgggagcaaacgtcaccatctccctccagtcgggctggccaagtctcccagggaaattgaagaccagtacacctgaagcatgtaagccccaggctgcctctcccattctccttcccgttcatcagcagcataaagaaagttggcctgggttttcgtgactcggcagggtccactcagtttaaaatgccagaggacatggtgtggcaagttgactgtatcgtgatgttagccgtcttgtggcagagactcagagacttgaagggtaaagctcagtaaggcccacatccagagcctggggggccaatgactacaaggaaaatgaccctgctttctagccagcaccccactctcccgaacgcctctctcttcttaatagtctgaggaggtttatctcctttctgcagatgaagcagggaatctttgagaatctgagacactagtctgagaccacatagctgagggcgtggaggaacgtgccgaccccaaacacatgctggtggctaccatgcgaggctggctttttggatttagggccagccagcatttccaaattctgttcatggaacactgtagccctgatggaggataactggtattatagccaaaaaaaaaaaaaaaaaaaaagttgtgtggtcagataggctggggagagctggcaagctgtatgcctcctgtaagtcttcctcatgcaggtagcacactaagggccaagaaggtctctcttggggaaacctatttaattttgttcaacctggcatttcccactcttaatagatgctagattacccgaccccttacaacacagtattaacatattagccataaaggaattgcacatcaaaccacaataagagaccacttcacacccactaggatggctataattaaaaagacacacaatagtaagtgtcgggaacatgtggagaattggaacccacacactggtgggaatgtgaaatagtgtggaggctttggaagacagcttggtggttttcagaaggataaattcagaggcaccatgtggcctggcagttccatttctcggtatatactcaaggaaatgaaaacatatgtccatacaaaaacttacgtgtaagttcttcacagctgcattgttcataatagccaaaaaagtagaaacaacgcaaatgtctaattgatgagtggagagatacaatgtgatacatccatgcaatagaatatttgacaagaagaggaatgagatacttacacgtgctgtaacatggatgaaccttgaaaacacgctaagtgcaaggagccagtcaccaaaggccacatagtttataattccacttatatcacatgtccgaaataagcaagtccaggtgactggcttccaggagctgggaggggtggaatggagggtaactgttcatggctgtggggtttctgtttggggtgatgaaaatctcctaaaattgattatggcaatggttgtacaattctgaatgcactcaaaaccatcgaattatacagtttaaatgaatgaattgtattctacatgaattacatatctataaagctgttttttaaaactaagttaacatctgccagcggtagggtttcacagcacagtttgggcaaagctgcagtagaagttttgttgccacttgcctggactctgtgaaggcacagtagctgtcccatgtcacccatcaccatatcaccccatcaaaaacatcttcgatatttgagaaagtaaatttcacaggggagggttgaggtgagctcttgtgttgagactgtggagaactgaaagcagcagccactctctttgtgtagtttgtgccctcgttacactgctgctctgacaaaatacttgaaaggtgaccagatagaaaaacaagagccttggaaagtttctgagtggatctgtagtaagagattatgttgagtgctgtatcattttgaatttaccccgacaaccctgaccttccctagttaatcattttcattgccagattctccagactgacttgtggccactgagcaaccaaaacctttccagctggtccccctgatccacaggcagccccatttccacattaatcccacactctctgttttcatttcagtgaaagctggtggaatgcgaattgtgcagaaacacccacatacaggagacaccaaagaagagaaagacaaggatgaccaggaatgggaaagccccaggtgggatgatgctagcgactcttgagcatgttttccaaaaaccctattcggttaaacattaacatttgttctctgttctatgattctgataactcctgggctatgtggggccctgttctgtgtatttttcccttcctaatcagggaggagggggctttgttttcagtcaggggagaaaatagagcccctagaggtcctctttcctgagcagttgccacgcgcccaccctgttccccaccccacacccagggctggtgccccgtctgtctgcacagttagagacctacctccacctgcccaggtgcctgggtttagccagtgtgcctcccttcctggaagccagggcaagccaagccaagcaggagcagcttcctgtggctcattggttttctgatggtggacacagctgccagccaccctcttcccaaggctggaccaccagagtggacgaagtaggcaaattcttgcacctgtgagtcttttgtactccaggtttctgttgtcattccagagaaacaaatactaacaatttctgggcagtagtttgcaacttaggcttccatactgaaatcacatggagacccttgagaattgccgcactagttgaacctcaggggtggacctggctgtctgtgtagctggggcaagaacttctgatttcagaatggttgaagcatttcctccctcggatcatcagccagatctagaattacaaggccatgcccttatgagtgactgggtgtccttatatgatacctctgctgccaaccctcctggggcctgcacaggggtctccttgcagacccctcctcccctgctcaacacctattttccttaaaggttcagatttccagttgggttcagggaccttgaaaggaatccatttctctcgactttgcaatacgcaaacaggcaccactaacacacctctgcgggagctcgtccacgtagaagaaagcactaagctctctacttatacagcctgtctccagatgatgtctcagtcagaagaggagagggtgtggaaggggaaagaggctgtggaaagaagctaaccttgattcctgtggattaggcccatgcttttatttcatttcattccagcagtcctgaatagtaggtggtattctccccagtttatgtacaaggaaacagaaccccaaagaggatatcagcttgcccatatcatgcaccgtgctaggtaacgtagcaggaagttcaacccagttctcatggagtgctcagcgggctaggcttccaaatggatagttgccaagagtaggcacccacatgaggaagtggtgcatgttcttggtaaccctgcctgtctgcttctaagtggccttccccattgagtattgtctataaaacctgatacagtatgagttacggagcggccacgtgagggaagaacagcattttgggtgacatttctgagtgattattagtgattattgtccattttaaatcatgagattagcagtgtaaagattcagtcccagttctggtttaaaagaaggcagtttaaagaaaatgctagaattgtccgggcacggtgtctcacgccagtaatcccagcactttgggaggccgaggtgggtggatcacttgaggtcaggggtgcgagaccagcctggccaacatggggaaaccccgtctctactaaaaacacaaaaatcagtcaggtgtggtggcatgtgcctgtaatcccagctactcaggaggctgaggcaggagaaccccctgaactcaggaggcggaggttgcattgagccaagatcatgccactgcactccagcctgggcaacagaacaaaactcttgtctcaaaaaaaaaaaaacaaaaaaaaaacgctagaattatttttctcacttactgtattcacaaagctatgtttggaacgtaacagcatcagcaactctcctgtaagttcacaattgtatatctgtaggacttgcggcccgacgtattttagaatggagaaatttgggagtctaggaggatattactgcttttaggagaataaaaccttgcatataccacatagtaccccctaggagaataaaaccttgcatataccacatagtacccccagtggggtctcaggcagtatattgtaatctatatgtgatgttcaaaccgaattagataatttttttaaatttagggactagtgtcacttcaggttaagttttgcctccgtacaagttatgaggaagccttccattttctgagcattcttgagttgggaatcgaggctaagagtgtgtaagcctgtagtaatttccctctaggaaacctggggtgtcattgcccttcttcataaccatctgtttccccaaggaagaaagagggcaagagatatcgccttgcctggaaaaaaagttcctggaaagttaatgaaacactgcttttcttggtgagtttaagtggaataaggtacagatagctagttccctacctaacacagtgtcaatacaatgagagatagtaatttattagcaagtttagaaataaggacagaacagcccactagttttctttctgttgatttttttcatgagttgacatgcagcttttctagaagatgatcaatttaaataaatatgccagaggatgaacagttgaagaggaaagatcgagcaccccagcgctgtagattgtagcatcttatttaccttaaagatttgttctctatctctagagaaccagatattttgaagcaggccgactgcagggtatggtttgcaaagcacatgagcaaggcttttgttgttgttgttccctgcagccaaattgctaggatacattcctgatgagtgtgttagcacttgtcctcttgactttggcttggctgtttactgctgtgggttaaacaactcgacacagcatttacagaacggggtaagcctgtgtacactctttagctattgatgtaagttgccaaaacagctttttctaacacactccacgaggcctggtactctgtgtaatagtttacttttaccaccatgcactcccactccccatttctctggtggactgattgaataatcataatcaatcatcatcatcactcattcttacagagtgcaatgagctcggctctgttctaactgctctgttcatattaattcatttgatctgtgctactgctcagtttgttatcatccctatctcagagctgtttattattggctattactcccattctgaattactactccctcttcaagagctctgagagtgaagtgacttttccgagggcacacggtgggtaagtggcagtgccagcattccagtgctggtggcagcttctggattccttacgctgctccacgaggctttgcttagccattgggctcttgttttgtgctgggcacctgctaagtgcttcacgttgaatttagtgctcaccgcacctataagttggtattactgtgtccattatagagacgaagaaagcaaagcttagggaggtttccaacccaatgatatgtagtcggtcattggcctggccaggattcagccttgagtctgtcttggtttggaagcccttgcccctgatatgtcacgtaagtccctggatccacatagattgcaatcctgatctctctgtaaatgaaacttactgattctggggttgcccataaccttgtctgcgctcctcaaacccataatcctacccttttgcagcctcaccgtcagtaggtggtctaattatcactttacaataaggtttcaggggactaggctggttttacttcaggtatggaaaagcctacttacttgcagaatgtataaaacacttaattatcctcttggaaatgtcttatagcatgtgactttcctatccacattaccctgatcctaaagttttatattctttaattttgatcccagtgttgttcagatatgaaaatgagtacctaacaccaaatgccagtttccttcttagctatagatgtacatttgcaaaactttcttttccttgccagacattcaagactagttttaaatttactgactcatctctggtggcttccttccccattaattggaaaatcaagtactgattacagagaaaagggacaagtggaagattaaagatgttactgtgttgacaggaaaaaaaaagccctgcaacttttactagttatttttcttgcaattgtttatgcaactcttattccctttaatcttgtagctttccacagacttaaacgtaatttcttatgctaccaagttgttttgagatgctgtgttaaaaaaaatatagccaaaatgtgaaaatgctgccaaagaatttccgtcaacctgagttctagttactggtggttcttcatgtccaggaagagtaatagtcttcattattattagctaatactttcctgcgtggctgcttgattccatctcgagccgacccaattaaggaaactggtggtttccaagccttttgtcgagtgtcataagataaagtagccagtttcattatgtaaaggagagactgcagacatagaatggactttaggagtcagggttcactagagaaaacagtttaatgtcaaacatttgctgacattctgccatgatctgggcttggtacaagatattaaaaaggaatggataacaggaggggtaaaccagaaaagaacgggtttggtcactgacaagtggtggatggaaaaggggtggaaagaaggaagaaacagaaatggggaataaggaacaattcttccctgagcttgactttttgcatggttctgacctagaaccatggcactgtttcacacacctgacaagtaagccaacaattcacatcaaccaagaggtgggagggacccagaatggcatacaagcactgatggattgaagggagtgggaaatgcaattgcttgatataaccatatttaagggagtagggagttacctaattaactttggaaaacaacatttttaagtggatactataaggctaaagacaataaaaaactatgcataaatggtgtacttcagttagtaaacaggcttcttaaggggcatggtttagcaattctgaaattgccttatgtgaatactaggattcaacaaacaaagagccgagttcctcactgtcagagaaagaggttacaaataggaaagggagaagattgaaatgaacttggtgctgttggatgggaactagaagtatctgtatgaacatatggttctgaatggatagatggatggatggatggatggatggatggtagatacaaacatacctatacagatatacagaaatgaatatggatgagagggttagtgtcatacctgtatttcctagctttgttcactgagagggcctaaagaactgacgcccatgcagccataagcatccctagggcccagactgtggtgtctaaacaccattccccagtcagaggaaccacggttccttggagaagtagttgattccaggccaggacaggaaaaatactagatgagcctggaatatactgtagtgccagaacataaggaagttctccagaaaggtttggggcagggcagaatgttatagaagcccacctgaagaatctccttatggccttagctggaataatttgcaacaaagtgatagtattagatttttttgtttttgtttttgagatggagtttcactcttgttgcccatgctggagtgcagtggtatgatctcagctcactgcaacctctgtcttccggtttcaagtgattctcctgccccagcctcccgagtagctgggattacaggcacctgccaccacgtctggctaatttttttagtagagacggggtttcaccatgttggctaggctggtcttgaactcctgaccttgtgattggcccgtcttagcctgccaaagtgctgggattacaggcatgagccaccgcacccggccgatagtgttagattttaacccatacggtaaaataaatatccatgagtccatactgacataaataattgaattaacaagccaggagaacggatagctcttttttgtagaagaactccagttacttaatgtataagaaaggaggtaactagaatatcaccaggaggcaaacagcacagtaattgttatagacaagatccactgatggatgtcagaattaatgggtaaaagtttgaggaaaaacacgatatttacgtagtcaacaggatatttgcgtagtctcaaagtatcttccccaatatatctattaattacaaaacaaaatgaaaagagtgtctttaccgtggaagccatgagaagcacattgtgtacagtatgaaaacgggaagaaggcagagcaccaccttcagcctcagctgggaaaatgcaggttgattgtcacaaaaaatactacaaaaagccttcgctgctctgcctgtgtctgtgaatgaccacgaaggtgctacgtgtgtttgattttggggttacaaataaattttagcaagtaggcacgtttacaaaaatggaataaataaatagtaatgatggactgaacttattatctcgccctttatagaaaagctttgccaaccctcattttaacttagtctgccttcagaaactagtctactacttcataaacaacttaagaaacttacaacagtatacttctaattaccactctacccactttgtgttttgtcatatactttacttctaccaatactataaaaaataatgtgctggtgattacttatctcctggccctccaagaaaaaattttaaaagcccgatttgtagcatttgctaattttatggtgtgaatactcctaccacagccccccaccgcacctgcttttttttgagacagggtctcactctgccacccaggctggattgcagtagcataatcctggcttactgcagcctcagcctcctgggctcaagcagtcctcccacctctgcctcgcaagtagctaggactagaggtgtacaccaccacgctcagcaaatttttaaatttttttgtagagaccaggtctcaccacattgcccaggctggtctcaaactcttgagctcaagcaatcctcctacctcagcctcccatagtgctgggattacaggcgtgaaccaccacacccagctacagccaattttaaactaacaacatgacatcactaaacatagacttgtgaagacatgtgaacagtcagctctacatgccagtgtaagtcagctccaacacaccactggctacaacttccacttacattgttattgtttttaatagtagccttttaaagatgtttaaagaaagatagatatgaaatatcttttaaagattcattatgcacatctaatgttcattctgtctggtgtcctttatttcttcccactgggtttctgtctgttttattctctttctgaaaatatttgtgatagtaaatgtctgctggagatgaattcttccaggttttgtctttctgaaaatgtctttgttttgcttttacttttgaaagatgttttcactatatattgaattcctagttaaaaattttttctttcaatgtgttaaacacggcattccatttttttctggcttccattgtgtacagcgagaagtcagccataattcttgtcatttttctctgtatgtaatgtttctgtttacctatggttactttcaagattttctctttatttctgtttttcaacagtgtgtttgtgatgcaccaagtttggttgtctttgtatgtatcttacttgggattcactgagcattttttatctatggtttggtgtcatcagcttggaaaaattgttggccattgtcttttcaaaaatatccttgcttcatttttctcttctttttttgagactctagttgtacccatagtgaacatttgatatgttcacaggcctcggatgctctgtttttctcctctctgccgccgactcttttttcctctcctatttcagtgtagatggtttcttttgaacctgactcctttctcttgtgcccagtgtggcaataagtccagtgaaagaattcatctttgatatcctgtttttcatttccacttccatttggcttttaaaaatgtatagcttccatttctctgctgaaatttcctgtcttttcacagatatttatcacagttattttaaatcttcatctgatgagtccaacatccaggcttggtccctcattctgttaactgtttgtttctttacagtgggtcacatcacttcttcgagggtcttttaatttttaagtaaagtaaaacctggtgtgtaaaagaatgacagagacagaaataacactagaagctgaagtaaataatatttacatcagtccagaaaacagcatgccttttctgttcaaacccattcgtgtgtgtgtgtgtgtgtgtgtgtgtgtgtgtgagttaatttagtatttatagttgaaccgggcctgggctgtattgctgcttaagttagattcaagacctcacaaatatcaaattaattgaaggtaggattataaccttcccacttgtagtggcttaggatatgaatgcctggaaggtgtgtctattttcctgccctgccattggacttcagcaggctctgtgtgtgtgctgagccttgtgggcgagagcctttcagttccctcatccctttccaaccaagatggacctcttcttggtcctgggtgaggcctagagtgccagtgggaatcataatatttgcctcatgtgattataattcactggtcaattagacaacatataaaaacacctcaaccatctcagtcacgtattaagtgatagctgttattacatctgtggtgattttttaaaactttttgttttgaaataatttcagacatacagaaaaattgccaaaaaaaaaaagtactaaaaaaatcccatctacccctcaccatattcctcatatggtaaaatttcaccacacttgctgctcctcccatttctttctttctttttttttttttttttttttttttgattcagagtcttgctctgtcacccaggctggaatgcagtagtgcgatctcggctctctgcaagctccacctcccaggttcatgccattctcctgcctcagcctccccagcagctgggactacaggcacatgccaccacgttcggctaattttttgtatttttagtagtgacagagtttcagcgtgttagccaggatggtctcgatctcctgaccttgtgatccaccctcctcagcctcccaaagtgctgggattacaggcatgagccactgcacccagccctgctcctcccatttcttaacgctcacatatatctaaatctacatctgtctgtttatacgaactttcttctgaagagctcttttactctggaatgctttagtgtgtgtttactaaaagcaagtactgtataattatcaaaatcaggaaactaacattgaaacagtagtgttatctaatctacagactcttcagacttggcccattttcccactactgccacaaatttcagtccaggattataccttcatttagtgatatatctttagtcgcctttaatctagaacagttatccagctttttaaaatctttcatgaccttgacatgtttgaagagtataggtcatttattttgtaggattttcctcagttcaatttttctgatgtgccttcatgattggattcaggtcctgctttcagggcaggggctgcacagaagcgaggtcttgtccttcttgatgcattggatcaggaggtacacgacactccccatctcatggccggtgatgccagctttgattgttcagttaagatggcatctgccaagtttctccactatcaatttactattttaccctttgtaattcatacatatctcatgggggaatactttgcaactctatgagtattgtgtttctcatcaaacttttgcctgctactttcagcattcactgatgatgcttgcctgaaacagtaactactgcagatatactgtatttgtttcccagggctgccttaacaaaatgccacaacctgggtggctttaaataacacatttgtcatctcagttctggaggccagaatgctgaaagcaaggtgttggcaggttggttgcttctgagagctgtgggaagcatgtgttccatgctgctcccctagcttctggtggtttctgcaatctctggcatcccctggcttgtagatgcatcactccagtcctgtgcctttacatggtttctccctgtgtctctacatcatctttcctctttgtgtgtctttgtgtccaaatttccccttttcataaggacactggtcatattggattaggacccatcctgatgacttcattttaactggattaataaagatcccacttccaaataagctcacattctgaagtactgggagttaggatttcagcatgccttttttggaggacacaagtcaacccgtagcagatgccaaatggtgatctatagcaatttttaatggttctctcagtcaagttcattgctaagataataaatagaaaatttaaaacttcagttaaaagatggcccagcaatgtgccagcttaaatctcaggcctgtatgcctgggaatttttatctttagccatgatctgcatgtttgaactttaagccgtttggtgaaccaatttcaacattacccttaagttctaatgtcaccttttatatccaggctagttgccagctgccttttaagaggggcgtgtccctgttctctaccatgtgtgtggagatttcagtagaccagggatgctgagcaccggccagctctcagctccagttttttttgttgttgttgttgttttgtttttgttttttttttttttttgagacagagtcttgctctgtcgcccaggctggagtgcagtggcatgatctcagctcactgcaagctctacctcccaggttcaagtgattctcctgcctcagcctcccgagtagctgggattacaggctacatgccaccatgcccagctaattattgtatttttagtagagacaggatatcactatgttggccaggctgctctcaaactcctgacctcaggtgatcgcctgcctcagcctcccaaagtgttgggattacaggcgtgagccaccgtacctggctcagctccaatattgtgagtgccctgtgctggcagacagggcccaccacttgccagcagcagctgacccaggtgctggagtgccacgggccacagagccctgcactggccaaaggcagagccgcaacatggcccaggcactgagtgacatgtagtgtctgtttgagggggtaactggttgtcactgcttatggactgagaggcctcttccagggagaagctgtaaggaaggtacagcaagaccctcagaataaaaagcaggcctgatttcatggcagcataaaatagtaacaaatagcccatctgccctgggaaggagaatcaggaagattcccgttgctgttgggcagttcttcctgtcaggtttgtcagactgagactcagagaccaagtttgtaggcaaaatggggcattgctgaagtgtcaccgtttatgtgccagcaagggagtggtaaaaggaagcgttttgcctgtggcaacttgggcggcagaaagttgacagaacaagcacaagccctcaaaccccctgacggcagccgagtctgctggcagcatccgctgcgtgtgaagccccatgcaggatgacatctgtgcaagcgaggctgcccagggagggttggcgtctggcagcctctccagaggctgcaggctgtcctaatggcagcttcgagatctgccattaggacaaagccattctcatctccacccaggttagagtgggcagaacttccaggcaggctggctgcctctccaccaagaagcagcacattagttttcctagtgctcccataacacagttgcacaaactgggtggtttaaaaacagaaatgtttcgtctcacagttgtggaggccagaagcttgagatcaaggtgttggcaggaccacactccctctgcaggcgctggggaaggtctgtcgcaggcctgtctcgcagcttctgatagtgcttggctggtggcagcctcactctgctgcctttgcctgacgttctccctgtgtgcctgtctgtgaccaaacttcccctttttataaagacacctgtcctattgcattaggggcctacccttctccagtatgacctcttcttaactaattacatctgcaacaaccctgtttgtagataaggtcatgcccttaagtactggagcctaggatctcaacctctgtttctgggggaaacgtaaattcaacccacaacaagcaagcagcaccttgtgctactaggcgtcagctggcagtacctggctctgttggcattccaacagcaatgacagcacgataatttattaactatgatgcttacatggcaaatgattctctcttcccctatgccagtgtttactgttgctcaggctgagcactgcagcagcccattttcctgaccaagggcatgctgtgtacagtggtgtggccccaaatttgatcacacactccatcaattaagaaaaatgttttctgcatgcatccccagcatatgagtattcattttaaaagtatacatgtgcactgcattaccactatataagttatgaaacatatacaaaatgaatggtaagatatttgataaagatgaaatcagcagtattttaaatgtcttgctatttctagtgacttggtactatcattagctcatctcaaggtccagatacccttgagatgggatttctcgttaatgattcaggatgtaaatctaaatttctaatgggcttccaggcaatttcaggttttgttggggagagctgcttcttgtcacatgtgactaggttgttggtatttgtaacatggagaccaatgacgacaggcaggagcgcttccctttgcttatgttcacttgtgcttgtattgagattaacttcggcctccagaggttattttttcaggaattttttttaagctacttgtccattttgtaaaagttagcttaaattcactctaaattcatcatctgagcacagtttgaggcacttgggatatattgaggatgatactagagaattgaactcattaccccgttaaccagatggagtcatgggtatgttgcaagacactgaaagcagatgaagggcatggaggcctttgggtggcggccccacggcttccctgggagctctcaggaccaggaggccggtgagggacagtctgcctgggggccacatagtaaatagtggcaaagcttaattcattttgtttctttagataaaaaataaatgtaaatagaatatatcttcatgtttagctcattttcccagctaaataattgccttcttaagcacatgggactgccttaatcatggattaattcatcatggcccaataccacttttgttgttgtatataatagaaattaaacatttctcccaacacctgtggatatgtgtattttagcatgatcagtagaaatgacgctgtgagtattttaaggagttttgctcagagtcgccctaggaacacagggtaatagcactgtcaggattcccagtgaatctagcctgattcctcctgtcctggaggtggatgccagagaaaggcttgaggctggcaggcagtgaatcaaagcctcgccacagagcggcacagcatatgggtacccatatgtccgagatcctggctgaactccttagatttggggataagaaagaaagtgcgggcggccaggctttcctctagggccagtggcttctggtaataggctttgagacagtatttgtacaactctggctacataacggatgtggaaaccaggtgtgatttatgagcttccgaatggccccttcctgctctctctccctccacaggtcccagcctccttctaagattgccacactcctatctacaccggcaggactgttttgatctgatggaaggagggaagaaaggaaatggggctatcagttctcccttccaggctctgctctgtgtgtctgcactgcagtcatcctcttggaacggaggctcctttgtttttatggtgtgacttgaaaggttgcactatttatcaggagtgttttcttactacataaacatatgaactgaatttaaatcaactctccagtgcttggattttatagaatgaaatatgtaataataaccacatgaaagtaagagcccttattgagtttattacattaaaatgactaggcctgaagtttttaagtactttttatctagataagccctgttgacttcaattgtctcagaaggcatagcactcagaaaacacttgctgaatcagtaataattatcttggactttgattctctaaagataaaatagtcaattaacttgattacttcttattttccagttggtgaaaaaaggtgaatgcagtagtagccatgttggggaagaaaattctttatcctcacatgttctgttgggccttcccttctctctcggcagatgtttactttgattttttatagtgcacatcccctaaggcaggactgtagtcattactgtggaattaatacgggctggagtatcaagggtggtgttctacccaagggattctcatagaatcagcagatttagagttggacacaacctgaggatcacttaatccaggtgctcctaaatggaggccttgagaggtgagatgtcagattttgctaaagatccagaaggatctagataccaaaagtgaaacatatattgggtagcaatccacaaagttttttgtgttaaaaattagccctcgtcctcttctgggcatatacccaaaagaattgaaagcagcagggtcaccaagagatatctgtactcctgtgttcatagcagcactgttcacagtagccaggaggtggaagcaactcacgtgcccatcaacagatgaatggagaaacaaaatgtagggtatacacacacacacacacacacacacacacacacacacacacacacacacacacgcaggaatattattcaaccttaaaaaggggaaatcctgtcatatgccacgtcatgggggaacctggaggtcattatgcctagtgaaagaaaccagctaccaaaggaaaagtactgcatgattctatgtatatgcagtatctaaagtagtcagactcatagaaagttagaatggtgcttaccagggactgggggaaagggaaatgtggattagtgtttaatgtgtacagagtatcagatttgcaagatgacaaagatctggagatctgtttctcaacaatgtaaatatacttaacactactaagctgtacacttaaaatggttaagatggtaagttttgtgataagtgttttaaccataataaaaatatttttaaaacaaaaaacaaggcccttgctgctgtggtaagcagtttgatggaccctcaaaaagctaaacagcatttccatgtgacctggcaattcccttcctaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatggtaagtcatacaaagaatgaagtgctgattaacgatacagtcatggaggaactttaaaaacattgtgctacataaaagaaaccagacaccaggccacatattcaacaaggccatttatatgaaatatccagaataagcaaatgcatagacacaggcagcagatgactgattgccaggggctgaggagaaaaaggggaatggtgagtgacagcttaatgggtatcgattgcttttgaggatgatgaaagttctggaattagatggtggtggtgggttgcataacatagtgaatgtattaaaagccactaaattgtataatttaaggtggttaaaatggattttatgttctatgaatgttacctcaataagaaggaagtccttaggcatgaaaattgggaaccatggctaggttcagcctgcacattgtcatcactgagaaagcggaagctcactgtggtgacaggactttctggaggtccatggctgaactcctcagggacatcaggactcttcagggttggggagagaggcatctcatgcagccaggctgcaggcccaggcagcaaggacacattgactccttgaagaagtctcaggatggggttgaccacaggagaggtgggtgcctggggcttttccagggccacctctctgccctcctcctagagcagctgcctccacaggctggcagagggttggccatagtagatccatgcttcacacccagacaagtggcattgagaggaagaaacaggcatcttctctttcatctctttttaggagcaagtaaagcttcgccagaagccccctagcaaactcattggccagaatcaggtgacctgcctatccctaagtcagacattgctaagattgccttagatatgtggtttacagtggcatggaggttgggaagtcaggcacaaagaccagcaccacaggcagtgtggccgggcagaagccaggctagggaggtctcctggagtagtggggatgagcaggtggcccaggtctttacagaaaaggaatgaagtgcagggagcactgctgagccagatgttaggacctggagcctgggcagtgaggttcaggaaccctcacacagggctcgggatccaaagccaatgcagctggtagcaagagatcagaatccaggtccagggtctgaggtaaaactggcaccagccaaagccatggagagattcctccctttcctccacccgcagggctctcagtagagaaagattctccccaccagggctctcaatagagaaagattccccccaccagggctctcagtacagaaagattcccccccactagggctctcaatagagaaagattccccccaccagggctctcagtacagaaagattccccctcactagggctctcagtagagaaagattccccctcactagggctctcagtagagaaagattccccccaccagggctctcagtccagaaagattcccccccactagggctctcaatagagaaagattccctccaccagggctctcagtacagaaagattcccccccaccagggctctcaatagagaaagattccccccaccatggctctcagtacagaaagattccccctcactagggctctcagtagagaaagattccccctcactagggctctcagtagagaaagattccccccaccagggctctcagtagagaaagatttcccccccaccagggctctcaatagagaaggattccccccaccagggctctcaatagagaaggattccccctaccagggctctcagtagagaaagattccccccaccagggctctcagtacagaaagattccccctcactagggctctcaatagagaaagattcccccccaccagggctctcagtagagaaagattcccccctaccagggctctcaatagagaaagattccccccgacccgggctctcagtacagaaagattccccctgacccgggctctcagtacagaaagattccccctaccagggctctcaatagagaaagattccccccgacccggtctctcagtacagaaagattgccccaaccagggttctcagtagagaaaaattcttctcgaccagggctctcagtagagaaagattcccccccaccggggctctcagtcccccactcttgtagtagatttgtataggacagggtttcgtgtcctcataattttttcagcagcagcccttagctgttttccctggcacgcacatctgagcatccactcgctgcacgtgggcatttgcttattcccctgatgtctgtaagtgcctcgtctgtgccaggtactctacacagtggggacacattagtgagcaaaacaaaatccctcttctcacagggcagccatgccactgggaacaacagatgataagcacatggacagctgaagatgagctgtggcaagtagacttagcaatgctgcaaagaaagcacagaaggcaaggggcagtgaagggtctttatctcctgagaaaaccgcctgtgaggacagcctgattgaattttcgtaaccaccattaatggtagccaaggccttctgcagaatgcatgtggaaagaggaaatgaagacagatgctagggtagctgtcccaggacacagctgtgcaggcagggtcctcgtgggcccacaagtgcatgctggagctcgccaggcaggctctggcagttcctggatgtctgagcacttctgcttcactgttaacttggggtcgccgtaaggatgaattttctgttaaggggaactggagtagcatctctgtggacatggcttcaggatgtatgggcaagcctgaggctaaggatcctgcaaactaggcacgatcaagagtgtttggtgtgctagtcagaatgtggttggctgtagttgctctggcattctaggtagggacaaccgaagaaagaacactggaaaataggggacatctttggtattccaagaatttgacaaaacctctaactagatcactttgaatttatctaagtcaggaataaagaagattataaatgacatctgttgagcattcctttgtagcagtttcagagtgataatgaaatttagggcaatcttggccaatctaaattaagagaagtaattgctgtttactttttgggggagcatcgtgggaggtaggaaatgaaggggagggaagctaagatgatggagtagaaatacacatgttctgatatgggtgcctattttcaaagatggtggtggggtataaagtttgtttgattataagagcatgaattcattgcatttatctaacattcctacctacagaacagcagagcatgacctctgtagctaaggttaactttcagctatacctggcttcagtggaaagtgggcatgagggaattgttttgacatttttgaaacctacactctttgtgggaaaagggttgttgataccctgcaatattaaataagttccgtgggttgagaaaaaaactaggacaattaacaacatggatgttgtcaattaacatgctgtttaattaacatgagaaagttgatactctttgaacctaaaagagcacatagaatttcgataggtggaaatatggtgaatctgtactggttgggggaacagcatcaatgttcattttgaaaaaagcagaataaatgatgtcattgattctggggatggggctgactggccctctccccctgcctcttcctctccgcatctctccccccaattcattcacactttgacacaagggtgccacgtaggggtatctctccagaccttcttcgtgggttagcccctcagccccctgtccagtgctgtggtcgtgatcgaaagttgtatctaaggcaagacatgtttttcctagtgtgtgattaatttgaacccaggagtttggtgattgtatctgtttacttggacttactggaaggtcaagttttctcaagaacattaacaaatcagtaaaattatcaattagtagcactgctttaatttcttaaactcagaattgacttgtccatacatccgtttatatttaatttccctgaagctctgaaaatagggcaaaagaacatagtcttggtccatcagaggtcttcttttttgtctttttggcctatcctttgggctcagtctaaatctttcccccaggattttaagtaactccacacttaaggtttctaaaaagtagcagtgatagctgaaaacctaatacagactgaaaatgaatgggaagttcatataaatcagtcataaacacatcaaattcccagtgaattcaaaagaagatgaacaaataattctcaaaagaataaatatttgtaaacaaatattagtaaataaatacaaaaaaatagcatttcactttctgatatccaggaaaaaaaagtaagttacaaccgccttcatgttcttttctttgcctgttaatcatagacagtcagccttctgtatctgtgggttctgcatccaagggttcaacccacggcagagtcacccaactgtgaactgaaaatattcaggaaaaaaatggatgattgcatctgtactgaacaggtacagacttttttttcttgtcactgttccccaaacaatacaggataacagctatttacatagcatttacatcgtatcaggaattgtaagtaactggagatgatttaaagtatatgggaggatgtgtgaaggttatatgcacatactacactattttatatcagggatgtgagcatctgtgggattgtggtatccacaggggtgctggaaccactctcccatggatgccaagggatgactgcatagattggatatctcaatttatactcccagaaacatagcagattgcctacatacagcacaccattttcgtccctcaaactctgctcccctttccatcttgttactaggctctcataacttggatattgagttgtccaagccagaaccagggaatcaacatgtatttctccctctccccagtcccccccatctaaaccctcagaatgaagtcgggcccttgagcatcaggagcaaggcagcaggccccatccccaccaccctctcacggccgactgtcagggcttcctgcctggcactcagaaccagccaatccaaacgtcaagtctcagcttggaagccagccccaggaaccctttcctgacagccctgccttcatcagggtgtgctgacccctgtgcgttcccacaggcacctgggacttcccctctcatgacactgtggttccattgtgggtggttctcagactacaagctcccccggggcagtggccaggtactgttgcctgctgtgtgccagccacccattctcctgacacatgggcacattgagagacagttcctatggacatgtcatgtttctgcacagtccaggtcctctgagcaaagacatttacagccaagttaataatgttcgtataaggagacattttaggacaatacagcttacagaagtttcccttccacttccctaaaacagttgcttacattccaggatcaagctaagtctctgtctctccctctcgacagtggagagggaaggtcaccagcagccctgtacaaggtcagcgttccctaattctggggcttctcttctgtgatgattccactacatgcataagtgacacttggccctcaccatgtcacatcactgtggggactggcacttagcaaactagtgctaagatgtcgttctttctgctctctctgactcagaggtcttgcaccttctgttgtgaacactcatactcacacacacacacacttttccacacacatgcacacacagtggcaggctgacgtattagctgacaagtgacataaaacctcaggcccttcacaattttggatgtaacgagggtaagcttggagggtgatatgactcgcctgttgtccctcagctaagctgaagtggcaggggctgaagagcagtcagaaccccgcctcctgggccggggccggcaccttcaccgtcacacctctgcctcctctgtgtgaccaaggagcctcccaaacttgaatgcacttgcagatcacctgagaatctggtcagaatgcagattctgcctcagcagggctggggtgggcctgagactatttctcatgagctcccagagttagtggtgctgcttgttccccaccacgctgtgagcagcacttatctgagacacacacaccatcccagtctctgcaatgcaagtgaagcctacacatttcagaaatgtatgaacactgtgttaaagggagaaaatggttcatgaacagtttattctttcactgtgggtgagtaatgataacttcctaattggccaccatatttataaggactccagaggggaggcggaagagagtataaatgacaactgtccaacaggcagaattgaacatttttttccatgggacttgaatctattttgaaagcatctgtcatgtgtcctgttgactttatgattatgtctcaacttaatcggtccttggggaatgagaagtttagaagattgtccccagtatgacttaagcaattcagcagtattcaggaagtctaatagccaaataacagcaaatacagctacctttagaccaggtgctttacatacttagtcttattagtcttcacatcctacaaggtaagtggtgggactctcttttgtggtcaggtatatctactgagaaagactaatggcatgcctaaggtcattaccaaagtaactgacaaataagatgtgaatccaaatgtgtgactccaaagacttccagtctcctgcccaccgtttctgctctgttaactagtcaccttttcccaaagagttgtggggaaattattgagaagaaagcctaaaatcctacttcaaatgtttaagttgagagacatcttttcagcactaggattgtattattagggactgctttccatcaagctcatttaagacagaggagtttcagtgattttccttctaccccaattgtcaactcaagctttgtggctttataagacaccacggcagtgttggagcagctctgcagcggcaccggcttctgcagaggctccctgcctccacctgaaggtcagcagctgccctggtgagtcttcggatcttgtgggcaggagcctcagaaccaggaacacaacaaccactcagaaacccctggcccagcgtgcaggagcccacacgcctcaggactggagacagcccgagctcaggacccggcataaccatgtcagaggctagcgattggagactttcaaggcgctgcaaataaaggaaattagactggaaaagtacaaacgagaggaagctggagccagggttaaaaccaatgactcacctctaccaaattcatgatgacgataagtggaaaaaaaataagcctgaaatgggaagggtggtgccaaatgggcccaaaacaaacacggctgaagaatggaaggtttgttttcactttgccagggattccaaatgtgatcagagatagaaacaaatgcagccctttcccagccttagcgaggccaagcccatggggtgttgggtcagaggggagcctgaaggggagaggggggaggaagaagctcaagtcagcacacagctgcagaacccccaccttctcctcctggggggagtagagagctacaccccctggcggctgttgggtttgtcagagcttgactctgtccagatggctgcgcacccgggttgagaggccctggggagcaccagcactcttccctccaagtcactggagccctcatccattagggacacagaaccagaaaggaggaatgtttcctctgcagctttagtttgaccccacctaggctgagtctttggtctgttagttcatgtgctggttatgactttttgaaaatcttggaccacatttatgactcttaagcaatttaggtacacatagtccacaagagccagcctcccctggtctacctgaaatgtgtgtaaagcatttaatctaggaaagccctaagctgatgggccctggggtgctggcctattgctcctgggtggcccctggtaaatcatgaacctttggtgcctgtttcctcatctgtagtgcaagatttgtgcatgtgtctctttctcttatgggacttttatagagaaaagaaaatgagggaaaaatatgaatatctgtaagctttgaaaagaactaaaagcacagcgtgaattaacagcagtcccatattcatggggtttctgttatagaggtggaaccttgctagactctggagaaaataagaaaggataagttagtcctcaagaaccttccagagatggattaatcctcactgaggccatctgcattcctttggtggcagagtagttcctgggtaggtatttataaatcatttcaggcttaaacaggattagaggtgctgtgcttttaaattgttttaatttagagtttttaccagaaattattgtataacattttgagggtagcacaaggaaatggattgcctttgctgtatggtgccttgaacacatcccacaggtttacttttttgctatatgtttttttctgcacccaaacaatgcaccgtttgtattttggcatttacttcaataatcttccaaatagacacccgcaagtacacttggatagcagacagtcccctaagatacagagcaagatgtgcgactctccttctgtatccttaggagctctgtcaacatagaaggtgtcacaactcagcattgtaatgaagacgaagataatggcatataataacatgtagggccaactcagaccagagatctttaatgaggtaggagtttggtttcacacattcttttgctttagtatctggcctggagcctgtgatagaatctctcctcagaaagggctatgtgttaattagtgactgtaacatgctgcctttttctttacttaaaatgctcaagaattgttttgtttcttgcctgggtcttcttaatgattgtttcttatgtgcctccatcccttctctgctatttctttccccaatatcccaatgaaatgagcttcacgagagtagttttgcttggatgacccaaaggagttaagtactatttccaaggttttgtagccactgaattgttcttacaaggcatcgtgctgcaaagcaaggactggcctagaagacctgagctgatcgctgtactaatagccagctgaggagctctgtgcaaatcaaattatatttacaggatagactatatatagggcgttgaattaattgccatggtttttatcattcttatgttctaattttttgacctgatgtgctattaatacagtatcttcccttttctatcagtgtgagtttgttattgtaaatggtgttttacagggactgaacatttagcttttcttttttagttgcttactcttttagaggagactgtgatggcaagagggaggagacatggcaaaatacataaggcatatctgtctatatttctttggcattgacatttcatcaagggacatgactctgaaagatggctgtcccttctaatggctggactttgcggctgtagtggccagaagcataaagacgtgtaaagaggatttttcggtacatcgaacactgaatgtctggctatgcagcttctgtgattgatattcggttctgtgggctccttccttcttaagtgcagtctgtaaaggatggtggggaatagtaatttcaagaaagatttggcatgagtatcagtcgttgggtggtgggtgtgagaagggcgttgctattggtgggtgaagtgttgtcacttagatgttgtcattttcccccatatagttttcattaaggtgacattgctgtggcatctgggtccaggcagggtatagcagccagcatctgaccacttgcagtcgtgaacatatatatatatgtatatatatgtgtgtatatatgtgtatatatgtatatatatgtatatatgtatatatatgtatgtatgtatatatatgcatgtatatgtatatatgtatatatatgcatgtatatgtatatgtatgcatatgtatgtgtatatatatagagagagagtttattaagtattaacttacacaattacaaggtcccacagtaggctgtctgcaagcttgaggagcaagaagagctaggtccgagcctcaaaactgaagaacttggagtccgatgttcgagggcaggaagcgtccagcatgggagaaagatgtaggctgggaggtgaggccagtctctcgcttcatgtttttctgcctgctttatatttgttgatggctgattagatggtgcccaccagattaagggtggatctgccttctccagcccactgactcaaatgttaatctcctttgacaacaccctcacagatgcacccaggatcaatattgcatccttcaatccaatcaagtcgacactcattattaaccaccacaagtccatcccttgtcaacttgaacccatacacatttcctgagatcatacataatcttcaaatacaataagatcataattacacctaacataatacaactatcctttgtactaccagaaacgcactgatccccaacccaaatactattacataagattagcaatacttaaatgctgatatgaagtcagtaaatcttatgtcacacaataaaggaaaaggaaatacaataaagatattttcttagtacaagtgtatacatgcacaaacatgtttttagcaaaagaaagaggaaatactcatgacaattacagtccccatttctggagccggaactggtcacatggtcgtagctggtattgatgactaccttcttctacccaatctgtattccctttgccttcagcaagcacctcagcaggttgtggttttttccctgcttcattcttgaggggtctgagccatttgtagtcctgcctgggttgggctgttgtagtttcccgtcgaccttaatcacaggcaatggtaagactaagagacaccctaatggatctcctgtattccatgcatactcttccttatctctgttgtggagttgtagactgatttcatctagagagtctgggtcaatcaccccagccaacactgtaactcccttcttaccctgttgacttaaggtaataagagcccaaagtgtccaggcaatcttaacttcaagtttaatggaatcattgttgtgtctcctggtagccgcgttcctccctttggaactaagacctctaggccagcagaacataatgttgtgggaacaggaagcaaaaattttgccagtggatcattaggggtgatggtgagtagtgccacttccacttccacctcttagttcctggacccgtgaatcctggctgtgggagaaacagtaacatatattggaggctgactgagagcatacacagccttttggagaactttgccccagccctacaaagtattgtcacctagttagtgttgtaattgtgacttcaaaaggccactccactgttctatcaatccagctgcttcaggatgatggagaacatggtaagaccagtgaattccatgagcatgagcccagtgtcagacttctttagtcataaagtgcgtgccttggtcagaggcaatactgtttggaataccatgacagtggataaggcattccgcgagtccacggctggtagtcttggcagaagcattgcatgcaggataggcaaacctatatccagagtaagtgtctattccagtgaggataaatttctgccatgatgccatcttccatgatggaaaaggtccattataatcaacttgtcactaggtagctggctgatcaccccgaggaatggtgccgtattgagggctcagtgttggtctctgctgctggcaaattgggcactcagcagtggctgtagccaagtcagccttggtgaatggaagtccatgttgctgagcccatgcgtaacctccatccctgccaccatggccactttgttcatgggcccattgggcgatgacatgtggctggggaaagaggctgagtggtgtccacagaacgggtcatcgcatccacttgattattaaaatcctcctctgctgaggtcacccattggtgagcactcacaggggatacaaatatcttcacagtttttgaccactgagagaagtccatccacatacctcttccccaaatttctttgtcaccaattttccaatcatgcttctttgaagtccctagccatccagggtgctttctgacccatcaagccataaagtgggtcatgcacagcagcattccatcatcaaatggaagtgatgtaagtatgactgggcttgaggaagtcctgaaggcacaagtaagttacatgaggaagtggctcaaatgcccatggtctccttggtcagaccatatggtcaaaggtattatgtataaagtcaataaacttgcttctcacaaacggtgaatcagaccgcttggaatgacctccctgaccatccagccaaaccattggctgcagcccatgaatcagtatgtaatcacacatttgattatttctccttccatgcaaagtacacaaccaggtgcactgctggaagttctgcccactgggaagatttcccttcactgcatccttcagggatgtcctagaaaggggctgtagtgctgcagctgtctacttttgggtggtgcctgcatattgtgcagaaccatctgtgaaccaggctctagtcttctcttcctctgccaactgatcatagggaactcctcatgaggccatcagtgcaggctgtgggagagaaggcagggtggcaggagtggagaccatgggcatttgagccacttcctcatgtaacttacttatgccttcaggacgtgctcaagcccagtcacatttatatcacttccattcgatgatggaatgctgctgtgcatgacccactttatggatagatgggtcagaaagcacccagttcatggtaggcagttcaggtcacatggtgacttcatgacccatagtcaaatgttcagtttccaccaaagcccagtaacaggccaagagctgtctctcaaaaggagagtagttatctgcagaagatggcagggccttgctccaaaatcctagtggcctctgctgtgattagcctatggggccctgctgtaggctccaaacagcacccctatctgccactgacaactccagcaccgttggatctgctgggtcatatggcccaagtgacagagcagcttgcatagcagcctggacctgttgcagagccctctcctgttctggaccccactcaaagctgacagcctttcgggtcacttgataaatggaccagagtaacacatcaaaatgaggaatgtgttgcctccaaaatccaaataggccccctaggcattgtgcctctttcttggttgcaggaggggccaaatgcagcaacttgtcctttaccttagaaggaatatcttgacaggctgtacaccactggacccttagaaattttactgaggtagaaggtatctgaattttagtcggattgatttttcattctctggcatgcaaatgttttcaccagtaagtccaatatgtttgctacttcctgctcactggatccaatcagcataaggtcatcaatgtaatggaccagtgtgatatcttgcagaagcaaaaagcaatcaaggtctctccgaataagattatgacacaaagccagagagttgatatacccctgaggtaggacagtaaatgtgtattgctggtcttgccagatgaaggcaaattgcttctggtgggccttatggacagaaatggagaaaaaggcatttgccaagtcaatggctgcataccaggtaccaggagatgtgttaatttgctcaagcaatgaaactacatctggcacagcagctgcacttagagtcaccactaggttaagcttatgataatccactgttattccccaagatccacctgtcttctgcacaggccaaatgggagagttgaacagggatgtcatgggagtcaccacccctgcgtctttcaagtccttgatggtggcactgactccgcagtccctccaggaatgcaatattgtttttgatttactattttcctagatagagacaactctaatggcttccatttggcctttcccaccataatagccctcacctcattagtcagggagtcaatgttggggttctgccacctgctaagtatgtttatgccaattatgcagcctggcactgggggattgaccacaggatgagtccagggacccgctggacccactgtaagtcagatctgagctaaagctccgttaatgacatgaccttcataagcccctactttaactgaggaccacaatgatgttttgagtcccctggaatcaacgtcagctcagagccagtgtccagtagtccctgaaatgtctgatcatttccctttccccaatccacagttactctggtaaaaagccagaggtcaccttggggaaagatgggagaaagatttgttgcataaattgttggtaatgtagtagggtccttcctcaaggggacccagcctccccttcattcaaggggttctgggtgtgtaaactgactcaagtctggaaattgattgaggagccgtgattctgtttttctaattcaaattagtcttttatccatttcacctagaagctttccgcttgtataaattaagtaggaatgcagtaagcttcctatcaatttcacttctaggaacactgtgattaattagccaatgccatagctctacactagtcagactattctgattgcctcattgcctctgccgttcattgtcgtagctgcacccaccttgcctttgatggtcgagtgctgccacttggcccctgccaccttggtatctaattagcaaacagaggtattggggtggattctgaggagaatcaacattatcttgcctggcaactgcctcagaagaggtcatcactgttccctcaggcagcgcagggtttatctcctcagacagaggtgcaaaggctggtggcagcatgggtcgggaaggggatgttgccactactgggaatagggaaattccttctggcaaaaatggttcatcagagtttacaaactcagtgtgcccagcttcatcagggtcctcccaaatgtccccattccaagttgcagggtcccattcttttccaatcaatgccctcactttaacagtagacacctggcgaggctgtgcacgaaccttttgtttcaggtcagccactcacatcataagggcttgtgtctgtttttccacaatttcagcgctttctctacaggaggtaagactctcactcagggcaatcttagcagatttgaggttcagtatctgcttctgaagcccggagacagaatccctgagttcatcattttctttcatcagtttgtccactgaacttgggagcaaccaacaagctgcattatgttccttggttctccacatatggtcaaaggtattatgtatagagtgagtgaactccttgcttctcacaagcggtgaatcaggagtgccaaatgcatttattttgcataagtctaaacagtttccgcctaggacttatcagtattctccatactattagaagcagagtccttagcattttggggtctaatcatattaagcaaccaactccagaaaccccaaaaccaatgaaagaactccatccttaatattctgttcctctacaaccactcctggtaccaaaatctgtattcctcagagttccctagagggacagaactaataggtagatacatacatataaaggggagtttattaagtattaacttacacgatcacaagttcccagaataggctgtctgcaagcttgaggagccaggagagccaggtccgagtctcaaaactgaagaacttggagtcctggagtccaatgtttgagggcaggaagcgtccagcatgggagaaagatgtaggctgggaggctaggctagtctcttgcttcatgtttttctgcctgctttatatttgctgatggctgattagatggtgcccacccaattaagggtgagtctgccttctccagcccactgactcaaatgttaatctcctttggcaacaccctcacagacagacacaccaggatcaatattgcatccttcaatccaatcaagttgacactcagtactaaccatcacagttagtataggggtggagggagagaaaaaatattattttttcttactacccacagatatctagacttcgaaggagtttactctgcacgatagatgtgttcctgaaaagttcattgaaagcacaatttctcttagtcgcattttatcttcttaccagcagtttcagggcttatccagcttcattctgcccgctgtttcttcaccgatggagctcaatgtctgtgtcccctgtcacgttctcatcactttgaaaatgggaaatgattggcaggcaaccctaggacaccacacttctaaaactggccacagctatcagctaaagggagcaatgccaatatgaggtgggcccacattgtgtgagatggaaattaatgaaagcagccctgggttgatactcacatcctctgctggagaaattaacagcagtgtttatctctgctaaatctaggcatggtgtattatcgagaggtttcctgtcaggtccaatttgggatcatcaaattaattgttacgtgtgacaagctgacatgcaaagaaagcaataaatacctcagtgccagctccttgttggaattccatggtgagttcccagggccagggggcatgaatgataaatgaggctaacggcctccctgcctacagcagcctgccctttctctccgtggcatcggaagactcacccctgttttccttgagaccttagttaactcactcacttcctaacaactgcgttaattcttcttagcatttttcttttgcttctgagaggtgctatgtacctagaaatgacccagcagcttcttcaaaagtacctttgctgggtcttcaggaactgcctggtaattgacccacaagacattgccagtttgcctgcgtttctcaagctcagaagattttgctgtaggaagcccccggcagctcaggcttctactccatgtccccaagggtggagtggtgcaaggtgtggccaggcactgtttagaactggagtgagtggcacctggaggtgggtggggcatcagcctgatgggttggaagttgctcctgttgctgtcctgggccctgtaatctggctgccattcctattacttcacaaatactccctagtgcaagtacagcagcatccttccaaggaccaaacccaagggacatcaggctactgtgtctttaacctctccaacattttacatttggggcctcctcctctcctccaaaaacaggaactcagcaactgtccatataactccctgcactttggacacaagcaaatttaagtcacatttgtggcacaactctggaagacacagagacccttatggcgtgcatatctgtatattcgtatgtgttagtccatttttgccctatagcagtgcaaatacctgggaatacctgagactgggtaatttataagaaaagaggttgaactggctcatggttctgcaggccgaacaggaaacatggcaacttgtgcttctggggaggcctcagggagcttccaatcaggcagaaggcaaagggggagcaggcgtctcacatggtgggagcaggagcaagagagcaagaggggaagtattacacacttttaaacaaccaggtctcacgagagctcactcacaactgtgaggacagtaccaggggggtggtactaaaccgttcatgagaaatccacccccatgatgcagtcgcctcccaccaggcccagcctccaacattagggattatgattccaccatgagatttggtgggacacagatccccatatcaccatgtatctgcatatctatgcttcctcacttttcaaatccttttgaatttttttctgtatatttttcctgactttgtttttatttgtattacctgttttcttgccgtaagaagtatgaggtacagttatcaaaatattactttaaattgtaattttttttaagatttaataacaaggtctcctgataggtctgatcactgccatcactttagagtagtgatgaatgtcaacggtaattctaggtatgtgcaacaacaggaatgtgatataaaactattaatatctgtgatttctattgatgaaaaaattacaggcactgctgatgctgctgagttcaccctgagaaggccggctaaatatcagtcagatgtcagtggagataaagatgtggggttggctggtttgttggttggttttcccccagcctagttcatgggtgtcctgaattttatttctgggcccattagattaagaatctttaccttatacctcctagatctgtgttacgtcaaaacatatatgtctactctcattttttattacatcagacaactttccaaaggtgtggatctcagcgtgactctcacggttctacaccccatatgccctttccatgtggaaagaacccacggcctagtttaagtgattccattgcaaggctgctttgctgcgagtcctaattacccttttcattgtcaaatattaagaggaaatacatgggcagcctgatgggatcttgactgctccctgacgttcagttctcagacctctgctttcttctgtttaccgtccattagagaacttgcatgttcccgcctttgtcatcacccgaatgaggaataaacacagcagcacttgcccagccccgcttccccgccagagcacaccaggcgtgcctgctggctggagggacggctccttgctggtccagctttacctcagcctctagtggacggagtgcacagggcttggggcaggagacttgggtttgagtaccagctttgggacctgttgcctgtgtgattgtggaaaacacttcagctctcaggggggcttcttagctggaaagtgggggtaaaacagtaacccctgtcagatgagaagatgccagccttgagcaagataaagcacgttatgaatggctgttggtggtggttctctgtttcactcttctgcctccctcattccctgctcctcctgggcttgaaaatcagtcattgtgatctcctcctctgctgcccagcccagtcctgctgtcgtgcctggaacgtaactcccacaaggaactgctctgactgccacagatcctagacttggttagccacagaacctcttattggtcaccttgtctcagtcttgccctagtcagttgaccttcgattccaatgttaggttgtcttgctgagattccagtttccccaccctgtaacctttgcttcctaggaatcgattatggagcctttggcttgggaaggttgcctgtggagttcatcctgagagggcatgttaaatatcagtcagatgtcaacagagataaagatgtaaggcagattggttggctggttggttggctggttggtcggctggttggttggttttccctcagcctagttcatgggtacatgtgtcgtatggaggcctgcactaatgagtagatgccttggggtccacctcaggcttctccctcccccacttcaataggagccccacctagatccatttgatatcttgaggttccattcagatttgatgttttaaaacaggatctactgctacagacagagaagttgataaccactgaaagagttcaatgtagtcattctgcaactgaataacagaagccctgagaagctaagggcattcccgccagcttcaaggctaatgtgtagacccacagggcttcccttgccctagtctagaactctctcccctgtgccatgttggtcctatgggttcctgccctttgtaaccggtcatttaaggccctgcccagtctcccccaccccatccagccctcctcacagacatcaatgtctaccttttccatgaatcaggacctgagaggccagaatctactcggcagaatacaccgtgctcagtcctcctccgcacctctcctgcccttcctatgtggaggggtctcccagtccctccataccctgaattgtgccggtccttccaggccccactgaagcggctttttcaaagccttaccttatgaccccagcccacaggagcttcccccatccgaattctttctgcacatgctgtgtgtgttgctgtgttagtttgctagggttgccttaacaaagtgccacagactgggtggatgaaacagcataagtttgctgtctcacagttctggaggttgaaagaccaaggtgtcagcagggttggttccttctgaggcctttctcattggcttgtagatggccgtcttctccctgtgtcctcaaacagtcttctctctctgcctgtctgtgtcctgctctccccttatagggacaccaatcatattgggtgagggtccactctaatgatgttgttttaacttaatcacctctttaaaggccctgtccccaagtagagtcacactcagagattctgggagttaggacttcaacataggaatgtgttgctgggaaggacgggggtgaaattcagccagaacagcctctcacttggcacacagtggttgcctgcctcaagtccttcctgccctgcctggtcctgcgtttgaggaaggattatgtagtatattactttgtacccacgcagtgcttgcaaatgctagacacatgtcatttttcaatgaaaaactaacttgctcttgagtcccaaacttgggtttaatgaagccagtgaatcagcagttcttgaggctctattcagagcactgtgtgagaaagagtaaacagacgtcccacccagagtaaggtggctgaggtctcatcaggaagatggggatagacagttggagggcagggtggtgagaagcaccgactccaggaaacacaggaagcgctgtcagagttcagaggatttttaatgccgatagagtaagagagcgtagaagttatggctctcacagagcataaacgctggaggtaggtgcacgtgtgtcctcagaggaccagtgtgggggcagtcattaggagaatcctgtaaacactgctccttcctcaaaccagggcagttacgccccggtgagaccacctttgtctccagtcccaccctgtctgaggctggccttcatagagggtggatgcagacatggatcgcctggcatcagggcaaagttcaaatgaaattctgatgaaggtaaaagccccaggccaccccgggtgagcggacttcagccaccaactgggagccatgcgctgctcttggccctgctgatcccgaggtctgctcacacctaccttccccttgctgtgtacagcagagcaaaacccttttctctcccctcatttcaaaacatgggagtgtggaccccatggccatatttatttcacgttgacaacttcagatgtttcaagagttcaagtcttagattcactgatgtttaattaaagacctcagttgttatttattagctgcactgccttttctctttgtctcttctgtcctcacacaacacactccagggtaaattcatttcagccacagtttctcacaccgtgcctctgcggacaacccctcagccctcaccacttcccctggctcagcttggtattgctaactgggcagcttgatgcagatgcctgagataccttcagttgtcccagacaattccatttgcccctccctttcatacctgcttctcactgactccacagtgtcccttaacacccggtgattgggactcaggcacaggtgcagggctgaaggacactcccagcctgcttgccctgtcacccgcagaagtcaaggcacgtcctgccttcagggcaccttctccagccaccctcccaggctctgtgcttcccaccagcccgtccattggtgtggaccctcgtgccttcctctgcaccctccagagcacacccatcatcccaccacacttccaggcccgatgccagaggcctcctgacctcactcagagcgctctgtggcctctaagccccatgaaaggcttctgtggccccctcatggttctgtccgtattggggctgtggacacgtttcccaggaggcctctcagtgcagtggggtgaacacagagaacaggagctaaacctgcctctgccagggccattctgtggcttgggtcagataactgcaactccctgagcctcagcttctcatcttggagatgggcctgtgatatccgtttacaggacttttcaggggatttggtgtgattgaggctgtgaaggcttccttatggcccctggccaaaagcaggccctcagaagggccctagccacctctccctgaggcttcggggctggattgttttgtagccgagggaaggggaggggtcgtttgctgaggaagtgatttttccctgttttgtttctgaaggtggaggtgacggaaactcccaggcagcccctttatgtgggcacttctccctcatcacagagcctggcaatcagcctcgagcagcgccagcatcacctggggctggttacacacagatcgctgggcctctgtgtttgaggaaggcttatgtagtatatagaaatgtgcattctgaccagtcccaggtgaatccataccgatgccctgggtcccaggacatcattgccctaaagaatacaagaagggctgcagtgcccagcactcttccctttgggggtattccctgggacatgttccaggtgggtaactgtcagcctctggtccattgcccgcattttcaatgcccttgtggagggtgggagccctgctgtgcagcagagttccaagcctgctccttggcttcctgtcatgtggtcagaggcaagcagcctctaggattctctcctggaaattcattatgcaccttagcttgtgacctggcctggagaccatgcctcggagaaagccacacagccctgtttaaccatttgccaaacccatctgaccacgaggcaaccctctgggcagtgcagtgggatgttttgaacacacccaagcaatgaggttggaattgaaaatcctttccaagctctccccagtggtgggattgatgtactgggctcccttacctacctcgttactctgggagtgtcctgcgtttgggtctggcacaccacaccatgcagtagtcacactgtgtgagctccacggctgcagcatcgcatagtcggacttttattcatcttctttccccagtaactcacctgggtttttataggaatgcatgtacacgtcctgaatagcaaacctaaaaacatttataatgcatacctcatacagtagaacttcagctatttgtgttaattatagtgaatggtagtcagatgtgctttttaaaaatccagattattaaatacaaagaaatatggtggtactttcatgatcaagccatggcacatgcttgtctattccagaggtgccaggtgaattcctcgtagaggagatgtgactgaaagcacaaaggaggattacttgtaatgaacgtatcaattatttgtagattgagggtcttttgattttaatattctttctactatcttgtttatgttgcctataacctttgacccaatgaacatgaacttcaaattagtgaaatccaacgaaataaggttttactctgtcagaaaaatcactcacccaacaacaggcacagctgtgctcctgtgctcctgcaccctagttagaggtgctgagaacatttcacagcatccagagccttatctgttgaccccaaacgcattcctatatgggcctgcagtgtaggagtccacctgcacaaccgcacaaggactttcccccattgcttacgatgacaaagaaaagtggaagtgtggaaactgttatcattaataacatggtttcagagtcgctgtgcttttcacactgtacgctatagcccgttggtgggtcatgaagtcagttgagtggatggagatcagcagggatgggaccatacagatcccatattacatgggattagtgcatcccaggatacaaggggcagaattgtttgtttagggagatatgtgcgtgtgtgtgtgtgtgtgtgtctgatatgtgtatatgtgtatgcctgtgtgcgtgtatgtgtctgcatgtgtgtgtgtatgtatgtctgtgcatgtgtgtatgtgcgtctgtgtgtatctgtgtgtgtatatgtgtgtgtctgtgtctgtgtgtctctatgtgtgtgtgtgcacttgtgcccactgcatcacaatgtaaaatgatccaggtttttattgtgggtcatactgaaaatgtaggaaagccatttgatagaaaatcttttaagcaattccagagtagagaagaattaataatttggtttaaaaattttcctcctcaaagtggtcatttcagtttatattctcccaagttatttctctgctctgacagcatatgccctttataatctgcctgttggtatatctgcctggagttgtaacaatgctcaagtttgtattgcccgtgaaattcctttgtacttaatattaaaggatgattcagctcttcagtgtagcatccaactcttaagaatttcaagcctaaataagaattagagccacttggaggtagcgacagcatggggtgaggcaccaaattaatgtgattcatggagaatttaatctaaaagagaactggatgatgagcagagccagtactcatccagtgccacccatccatcacaccatctttgcaccatagcacctgtgcatcacatgattcctatgccacgccacctgtgtgccataccacccacacaccacaccacccatgcatcacaccacctgtacatcacgccgcctgtgcaccacactgatcgcaaatcacaccacccgtgcatcacaccacctgtacatcacgccgcctgtgcaccacactgctcacaaatcacatcacactgcctgtgcaccacactgatcgcaaatcacaccacccctgcatcacagcacccatgcatcacaccacctatgcatcacactgcctgtgcaccacatagtttatgcaccacatcacccgtgcatcacaccaccagctctcctgccctcagctcagtgctggggccacattgttacggggttttgaatatgaatctttaaattactcaagtttgtgctgctgttgagaaaaggcagaatgcacccttgggcagttctcccattcccgaacccacccacatgtctgcctctcaacacttgctcagctgactaagctacacctttcagatatcagctgaaatctcactggccctccaaaccagtttaaacccctgctgtgtgctcctttagcaccttggccttccccttcatagcacttggcttaaatgtaaatgcccagttgagttttcattattcatttgacattgagccccagccacctcagacgttgcaaactggccgactgacttggggacagacccatggctttttttaaggccagtcccctctgacttctccatgtgggttttgaacttagcctgccatccttccctcttatagttgtgggaattcagatcaagaaaggaggaagcgcgtgaccaggttacctaattaggggaggacacaggatgttcgtgttgttcatgaagatggacctgaagcatgccgtgtgcatcgggtttttctgggcttttctggaatgctgagcccttttctcgagggcagtgctcccacctacagcataggatcaggtgcacacatctgttggcctcttcattaggtacaatttaatgtattaaatttggatactgtttctaggttagtaaaagtgtgtctttatcaaatccgatcatcatttttgtctcataaacaagagacaagaaattcttccaggtaaaatgtttctcaactgcctcgtcactgattagtaaagtgagtttgtcttaacaagtccatctctgtccgattttctgacaaaccaggtaacatttgaataaattctcaagattgtgcccaagccatataaggcattaatgcatttgaggtttggatttgaaagcatcagctgcagttaggagcccaggcttcggtgtcacacttgtgagtttggttcctagcttctcctcttactcactgtgtagccttaggcaggttattcaacctctctgtgcatgtgtccttatctgtaaactgtgattattaataatattacctaagctgactgttgtgaagattacatgagttaatgtgtctccagtacatagaatagttctgggcccagagtcagaaagaaatactagctattattagtagtatgttcattagtagttgatgtatcgccatcattttatagtcaagcacctagaactaaaagttatcctaacaccctgtaagtggatggctgtggttaatacagaatatttaggcaaaatgtgtttatgaagacacttctgcctgttcttgttgtgtactgctttccatgttgtgctgttggatgcaaatgccgatgtgagctaagctctctgcagtccagagggcggaggtgactgtggcttctttctcatctacctaaaatgatgcatatttgagaaatgctttgtttctggggctctcacatgattcaggggcagtaaatccccaaaggaatgtcactttttttatggctcatggaactaatgtctcaccaagcacacctggtccagcatacccacctaaccaaggatttcataatttgtggaatttttcaacacataggtatatcaaatcataacaaaagaaaatcagcactcaaaggtatgactgcaccttacatttaaatctgcttctctccccatgaaagatgatactgagtaggaaaggaaaactgcaggagggcagagagcatcttagaccaaagttgagttctcctttctctatgaaaaatgcccgttgtctgacaggtttcgcccagatagtacacaccatgagggcatgtggccctgcatggaactgcttctgtttcatcacaaatgacaaggcagctgaaaggctggggccaaatgcacagccttgttctcacacagcagtggagagagcccaggcttctgccacacagacttgtccttccagtgaccaaacagcacgtgacccagtggtggagaaaaggaggatggagaaatggattccctagcctgggcctcccactagatcactgtgacccctatttagcctccgaggtaaaactctttccaaaatgtgtaaaccaccttcacctctacataaaatatggaacacaattgcaactcagcctttaatacatgtgtcacgaccgtgtgtagtgtgggccgcggtgggctgatgctaatggaagttctgcccaaaaggcttcctgattcaaacgcatcaggaaatgggtgaaaggaagttaatctggtttccttaagatgactcagagccccattacactaaggggcatttcagtctctcagaggaggatacaggaagtagtgtttccagaatttagttgaccacaggctactcaaattgcattgcaggatgagagccaggcagaatgtattttgggccacaattctgaggttgtgcatccgacaggtgtaggaagaccagagctagccagaaagtttgaggacccacgtgcttgtcctggctccacttcctcccattccctcgaccacagggactgtctacctctaagctgctttctcacctgtatgaaaaggaggtcagtgatgcttgtgggctcctggccctgtacactgcgcaggaaagactgagggatcacaggcaacgggctctagaatcagtgaaaggccacacaaacagaagacaggtgttggtgctcagttctattaacccagaaaagaccaagatacaatttggggaaaattccctgattacatttgttctattctgctttgccaagggtttcacttaattgaatgaatccaattttactctatacagataagtgtatagagctgaccatggcatctccatgtaatccaggagtaatctttttacctcctgacagttttaccgtcttacctgtttctaatccatttccctttcttggcagcagactgggcgacagcacagagacacataggaagtggtgagcggaaagtgcccatgtctccaaggcaaatacacattccagagcactcagaaaactgcagagggctttatgttttcacactgaaactcatggtggcaaaaattgagctgatgtgaggatatttatggtccctaaatcctacttagtgtaatatccatacattttgctgtagaaaaattaatgggtttgaatatggggtgctgcccaagcccctccagaactgttcactatatatgatttttataacatattgcctttataaaacttgaaaaatcctgaattctgaaacctatgtagccccaagggctccaggtaaaagagatcagggactataaaggaaactctggggtacaaaggcacctgtggagatgaaggtcaccaggctggctggtatttgacaggcaggacgccctgttcccaggttcaggcaagaggttgcccagccctcgggatgctgctttctgccacagcatggtgctgtgaattctccccctcttcaccgctgctgtattttttgtgaagccatagagacaagccagtgcctggcccccagcaaggctggagaggcagtgaaggcacatccccacagccacgccctgcgctgtcctctacctggagtccttgggcagccagccaggggaaggctccctgtgccccccacacccaggctgctgtgtaaagaagcaattggcatgagccccaggacactagctactgccaaagccagcagtattttatgagccttaaaaaatcttgttgtaccagtccgttatgaattattgaattaacactgcatatttatagcaacttcttaatagtttaataatttattcatcccttatggatcctttggcatatttcttttaattgttagagtaaagagtttttttagagctaacttcactggactacttcctcaatgatgcttccagaatactaaaatagaatcctgcacagttgttccgaagcttaaagcacctgatgcgcagcaaagacctgcccacatgcgagtcggtgacaccccccctgcctgtgcacagggctgcaactactctgtagaagcccacagccagccaggcccagctctcagccccaactcagcacactagcatttcacagcctacacttggattacgtgtcttctgagacagtttaggaacctaagcatcattcatattgtttctaaagggaaaaacatcttactgtgtcccaacaagtaagctccctattttgggagcacccctgctttgtaagatgtgtcctactgcccagagtgagtcattcctcacagagccctgctcctaggtgcttggtgataaggggaatcaacagaaacaggctgtttcccagcattcacttgcagatgactaaacccagaaattgtggagtagccttaggtaaggagacgaaagttgaaaacttaagacccagattcttcaggcatttgagactctggctgaggaggcaaggcatgccagatcgtttatgctcagggtaagggtgcacatctgtctgcatgttactgtcccttttgcaagggtttttttggtcatgagtgacatcgcactttattaaaaagacatgctttcttaacaagatgagctacctttgatgcttagtctttctctggtttaggcaagagtcctgcaaagccatccagctgttgttggcagctgccaggagttgccataaagaaggtagatggagtttttcctgttgaattcgttaattcaggctcgtgaatgtggtcattgataacaccccatccctcttttccttaccgcctctagctaattgtgcttatcatttaagcttcagctcatggctctatcaccattctcaagtttgccttgaaaagatctgaagaagtacctgttagcctgagctccctctaaagagggagaaaagccaatcttccaggtcagtctggcaaaagctggaggaagggcccatttgcttggggactccagatatcaacccatggccagcagatccagctcagccagattgtcgggtcacaaaaataaatccactatctctaatcgctcttttgcctcttttgcaagcctttgaggcgggcagggcatgagagttactcattcctaagaaatgagcaacaaacagttccagctaagcaccctggttcattcactgcctggccacgaccacaaacttgtgctaagctgagggtcgctgaccggtgatgtcatttggtgctcaaagcatttgttgagtatgtgtgcgcaccagaccatgtgccaggcgctgggcacacaacaaattccaccatggtccttgaccttgaaggggagccatgcgtgcagaagcctaaagctgtgttgtgataagcctaaagccatgttgggaagttcttatggcaacacagctgggaaagtataagtcctgcccttggaggggaaggaaagtgatggaaagagaacatgagccagccttgaagttgctgtttatcagctggctcaagtatcaaggtggaaccaagcacaggcaatccgagcatttcttccatgaaaaatgaaacttaagtgtcccggaaaagttgaggatcataccagaattctgtgtctcagcttggagtgaccatgcagcatatttagtctgacatgctttgagagtgaaagaaagcactgctagtaataacaccaggaccaatgcctgaacccagaccgtcccagggaatcagggacataaccatcatcctagggataacttgaggcctaatttgctgccctgaatgaagttcattctccctctactggtcagagacgagatggcaggggattggttgcaccacccactgcccccccgccccccgtccccctcaacctttttatttatttatttattttaagaaactgatagaagacaaatacaatgtcatctgacattgcaatcattattggaaactacaatgcacagtatgtttgtacttacatccttgaaaaccattttagggctctcagccccgttactgaaccataaagatgctgggtttaaaaatattcaaattggttccttattgaggcaaatgctgaggaaaagcagcagattgcatcttgagcttgaaaagaactcctctttgacttgcgttctccatgatacagctgacttcttttaaatcggtgttgtgagttagtgctcctgttccatcttcacctgcctttattaaacaagcaacacagaggcagatgacttctctgggtgctttatgcatgtatctcactttaaacactgcgttttttgtttccttgggaaataagccctcatagccaatggttgcttcaggtcttgaccaagtacccggatgccccagccagatgccatggtttgcctcctgggtgttcacctctctgtgggcttcttccctctggtttctaaggtgacagcttgttcatcagatgcatggaacagcacagacacaggcatttcacacccgtctattcagagcaggggccccatggcccagattttctgggaaagttctgttttcacacattctgccttgtgctggtcagccaatgtattctggtttgagataacagaatgtaaaacagtagggccatcttacctatagcacgtgacccagagaaacaagggccctgggttagtttgcaaagcaggtcaagtcagccttgagtcctataatgctgcagagagcccagcaccctcttgccgcagcaaggccggccccatctgggtggtggctcctgggtctccagcacccagcactgggcaggcactgggtggttgctcagtgaatatttacctgatggaagcgcccaggcacagtggtggtgagcacagatccatgcacgctgactaccatgccccacacatccacgctgcccctggggcgcaacagtgccagtgagaactccccaccagaacctgtgcctcagctgaaaatttccttcccttctcccatccctaacgactccccttcctacaggtcccagcagatgtgaaaaggagaataaagagcctccagttcctcctttggccccaaccttagtttgcattctaattcattaacatttgcagggtggcttgcagctgtccttagagatggtggtggcagttctcctgaaatgcacctgtgttgttcttgcactttctgtcacttctcagtgggcctcagaagtcaggtgggtggacttatctgcccagccatgtggaagaaggaaggctctcatgtagatgtctacgtgtacatagcgcctcaaagtgaggattatacactacacatcaattcccctctgacgtcttagtggaaagtttccattgagccctaatgctccctagaagtatgtcacatcctgcccgcggaggggcccacccagggccccattctggttaccctcttcatgctcgaggttgtgccctccaggtgcatctcagctcggagaggggccctcagggtcgcagcttgctctgtccatcatccagcatctgcctcctcactttgtgaataacagggcacatagatatcttcactggtgagatttgctggtggtaaagcatattatctggctgtcctcatggaaagcaaaggaagctccctcaaggcaggggacaccccagggaacctttgggagaagcaggaaggagtgagagccgtgggcctggggcctagtgcagcacactctggacattccccttgcttcctgcccctgccctttcattcctctctggaaaggctcattcaccaagttcacagagattctgtggttccctgcatgtcctcaggaatagctctgcgggaattctcatccctgatggaggatcagtcttgtggaagtccttcctgtcaataaggacattcttagttttcatggggttgccacagagaccggccacatcaaaatagagacagcccacttttccagaaacccatggtgacctgctttcgcattagcttctggtaaacctcacaggtgtggcctgttggcctcttgctatttagggagccctctgggaccagtcttcacctcagtccctaacccagcgtcctatacagtgtgtgaacaccaaatgcctgttagtggagaggaggaagaagatgacagtgataagaagcggagacaagctcctatgtccctccagcaactggacaggcaggaaaaagtaggagatgctccagagattgtgcaaatgcttccttattttcaggcatgcttgatacttataaacaccgtagacagacagacagataggtaagtaggtaggtaggtaggtaggtagatgtgaacaaatgtgaacctggaagggccagtcttccaatatagatccttagtggctcactgggtccagatttgaaatagagccaagtggccatttgccgactaggggtcatacaggtatgctgagatcccccccaaacctgcacctttttatctttgggacttttagagctcacctgaaccaaccaaccagtactcagccgtatcagccaatcagaactaagcaaatttcattttttttaatttgaataaacagacctgattgggaacctgggtgggaacttttgctctaaaacccaagtcttcctttgttctttggaacataccttcattttatattggaggctgtgtctccctggtttgcaaactgttcactggaataaagtctctttcctccaaattcctttttcagagaacttttgttgacagatagatggatgattgatagatagaatgacactctacatatatatgtatagtatgtgtgtgaataaatgaatgaaaccaactaataaataaaccacaataaaccttagggccctgaatattaatttacccaggagagacccagtcactagagatcagggcatcatgaatagtcaatatcagggagtgagtgaagactttaattagtggctcacagtgcatttctcgaaacccaaactttaggggcctttgatgctggtctataccacagcctgccctgctgcgctcccattgtattctaatactcggcggtgtttgctataaacgtgggtgaaggtagggttgttgggttgaacgtaagttatcccaactcactagctggttttggaaagtaagcagaattggttgtgagtttagttttctgtctacttgaccttgctctctttttttttttttttttttttttttgctaagtctggaaaaggcccaagtgcttggtatgatctgaggaagggccttaggagggtccccagagctagcatttccagtcaggtagcagttgaatttgcagatccagagaccactgaggacacttactgcatcagcctggctggctggtgagtagctgtgctctcagctcaccaactccctcccttgctgtgtgtgggaaaggtggactaaggacataattcctggtgaattcaggaattcagaaagcccttgtccatcatgcagtgtccctgacctgagtccacactgtgcgtggttctcacaggccaggctttgattcttgctagatgcgtagctctgtgactttccagccagacacctggctggaaagtatcctcagtgcaagttaactctggcatctctctaattctgttgctgggttcgacacaaaaacatcctagtgacagctggtcccatttaaggtcagccacctgtgcttccggagatggaagtagactcagaccagatgagttttttggtgtctgtattggattaatgtgtacttctttctaataggaattccaatgacagttgtcttgttggatttttttctacctacatgatcattttcctttttagagccaccatagttttatcctatttaaaatactttgtactttgaaccatggacacccacctcccaaaaattaaaccatttataacatgacccttgagcctgaagattgcatttcaaaatatagacaataaatagagtgatttttaaagcacctgtctaatcagcattaagcagtcaccagcacctccccataattgaaattccaaagagtgactctaaagcgtggacgtgttcagaatcaaagatggaacggtttttagggtaaatgttacatactgaaatcaagcaacatgtaaagtttttaatacatagatgatcgttatacagactaataatcataccaattgtcctcaggccctgctggacagccgcgcatctgtcttgtaacgagctaaccatgtaataaagcacggtgagcaggcacttcctagggcagtgccaggagcctttctgaatactgcaaaggactatgtccaatgcctgatctagcgtctttagagatggcccacctacagccaaggtctcccaacaatgtagctttagagctaagcctaggcgggcttccccccagtatgttccacattgccatgtagttaaacatgcacccttttttttaagtttgccccttgcccttaatgataacctacattcttcctaaaagttaccttctctggaacatttcattaaggaaaggaagcagtcatttttgctgctttatactgtttgaattgttcaggctgctggcagtggaggtggacagggattcccactctttggtgctgggggaaccttttctcatagtaatgccctgaaaccctgcgccatggcacagcgcaatgcttagaacaaaggagtgaggaaactcaaggtgggcccgctggcattcttcaaagaagccctgagaaactctgaaattccccagtcttgaaagaaatgagagagagagaaaggaagtgttatgctttagaagacaaaaagcaatttctagactgtctttacataggaaactaattcattacttattgccactaaacatgagcttgtcagtggaggcctattccaagcacagtgaatacattattttctttaaactccctattctacaaagtaggaatcattcccatcttacagatggacactgaggctttgagaggctgctcatctgaactgagattcaaccccagaaccatctatttcctaagcccaagccctcaaacgtgccatgacactgcttttgtctgtggttctgaatcgcctatgactcctgtggagatggcagcagaatgtctgggatttctacaccaggctgaagcctcccccccgccacaccccctattccctggctcactttcaggaagtggtgcctgggctgtgcccctcagatgtggtcgcttctgtatatgtgatgaattttgagactctcagtggcccaggaccatcactacgtattaaatccataagatgtgagaagggtaattaacacttcctgttgttatttccccttctttgcatccagggaaaggggtacaatagggaagagcaggaggagggggagggaagatccacacgccagaaactgaagtggtctggaatgggaagagtgctgggcacacaggagctttctggagctgtgtctagagggaaaatgaaggttccctcctgtttaaaccagactcccagtctgtggctttcacactacatgcagagtgtggaacacgtcatctactgatgagccctattcacccaacacactcagaacttgggggtttagcctttcctaactaaaaaaaaaaaaaaatctctgtgaagttttgacatctggatcaacaattagccaaatatctgtgggtggaatgctacctggagagaaatatttcagaacccccaaatgagagcatccttcccacacagacccagacctggcccagacccagaagaacaggttgagatgaagttttgtcctgaaatcacagtgtcctggaagcagtagttctgaggaaggggcagattgccgtcccagcctcttcactgaaggatttgaaggctgattccagttgtatgaaaacagcatctcactgcaaagaaggtgctgttagaccaatgtgaacatgagctcaagcattctcacctagaaaagcacctctggttgtgcccttttgaaaaatgttataaatttcttatgccaaatttagaaggaattaggttccagattattttctctcgggtttagaattgtgtttacgacactgaagttgagttttatatgcctttggtcagactcgtgacaattagccactcctggggagaaggggcaccctcgtgcccaggtgccagcagccctcgcccgcagtgcctggccggcttccatttctccttgaggtggctgagctggccggagcgttcgcgggctgagaggaccagcagtgccatcttgtggaaatgttgtcagtgctgaagccaggctgaaggagggagacagcctcgactgtcacactctgaagaatgatgttatccagaaatgtctgggtgcaatcgagtgagacgtttccctctgctcaccagccatgctaattattattttgctgtccagaaaattaatagcccaaataaattaagaccaagccaagaaggtatttcaagaactaaaaatggcaggaacggatttgttttccatcgacttactgggaaatgtttaaaaagtcaccccagctgggaatatattttctgtaaactctggaagcacaaagctatggattctgagcagagtcaaaacaagagttttggaatttgcttctaggctgccctgcaggctctgtgctttcctgaggagactgcttttcccggtcaatgagcgcatgtgctgggccacaacctatgtcacccccttcatcagtgcatgagaagagcccccagccccattcactttgtatgggcagaagctgatcgagggtaccctgtcctcccactgcagtgctctagtgtcgtgtcctctctgttacacaagtgctaagcacacactgtgactacctttcatcagcacacagtgggtgaggcccaagggcctcttcttctgcactgacagagggtttgatttgaggtgcggcccagttctcaaggtcattaccctggaaaagcagtctctttgcccaccctcctcaggaaagcacagagcccgccaggcagcctagaagcaaatttggaaactgtgtttcgaccctgtttagaatctgttgctttctgctgtgtgtatgtgcgtgtgtgtgtgtgtgtgtgtgtatgcacatatatagagtcacctaagaaggtagggtctgttgctgtccagttttatagacaaggaaactaagcctcagaaaagtcaaccaccagctcaccagcttgtccctggcagagtcaggatttgaacccggatcatccaacactctagcccacactcatggtgtccatttgccacggtccctcctttgcgtggttctgaatcgtctctggccctgtcggctgcctcgaatctgttaaatggtttgaagcctcccctgcattttgttcccgagactgaggaacagagtcgtctgagatggtggagatctcagacgacccgactgaagagcacagcccttgcgcttcctcccgggctccacccccaggaccccaagcaaggttccagcctctctgaggcaccatttcttcctccgtaaaatagaacatcacctgccgaaggaactcagatgagctaatgatttatgtggaagtgctttgtatgctagttaaatgctagagacataagtgatcatttttcaggaaaaaaaatccactatcaagtcagaaagtaaatctttaggtagatttgaatatattgtactgtctggttgaataaaggaccctcaggttacatttagattgcttaccttaaaactctgcatctctaaatcatatacagaagacaagctaaaactctgctttaaaatgaggggactgggcttggagccaagattacatgcactatacagccctcgttccaagtctggttcccagcacttattactgtgcaacccttgggcaaatgactggtcctttctgatttaccattccaatctgtgaaatggacagttcctgcctcacaggaccaagagagttagatacagcacttctaaggggagcgcctaactcagcacctggtccatagtacatagtggtgattgataaacagtagcttttatcaacctgagatcatttctatcctttagggaaaatagagcaccagtggcttattaaaggccatgtgtccctgccttctgtgtacatgcttcctgctgatagagtacatttacatgaaaaggagacagcatttgcagaggataacttgagtagacttccatgaacccaggtcaaaactaacatgaaaatgattctgttacgtacaactctccagtaatgcctttgctgccattttgattactttcagtgggatcagagatttgaccagattcccagtttcactactactacgcacgtgtgtgtgtgtgtgtgtgtgtgtgcgtgtgcatgtttctccccatcccagaattcaccttcgtggtaactaagctgaccctaatccctaccaggatgcttgggaaggaagaggctgaccagtcagatgcacatcggaccctccctgttgcacagaatcctattttggggtgaagaagggcactgcatttttctaagagtgcagaagctctccagggttaagggaagaagggtaaggaccccacaaaactagctgtggtgagccaggctggagcagggcagcagatacaaattactttgttcacaagttgcctgtcagtagcagtcctatttgaagattactagcaatcggtccttttggggagcccggattcatttcctggctgacctgctctctgtagcccaggggaaagtattattgcaatatcggtgtcctgtggggactgagtaggtacatgtggggtgtcgcgtacagttctaggcaaaactctagaaaccgcactggaatgcagttgggagaatagctgagagagtgaaggaatttgaaatcatgcctttgagtctgggaaagggatgttctgggggcttgtggtagccttcttcaaataccaaaggactgtcctgtggaagagcgttagacttgggatgggcgctggactaagtgcagggagacagaatccggcccacctgggagacatccaggcggcccccactgaaggcccttaagctctcaactgcgaaaggatgaaggtatagattgcagcagccgtctgcctggtagggaacctcctgtccagctctaactcacaagagtgcatcgctttacacctctcagaactggggcagaaaccaggctgtcagagcaccacgatgatgagggagggtgtaaagccttagaacacaaaagaatgttaaaagtcttctcaatttttatatgagttacatgttggggtagcagtaacttgaatatattgagttaaatagttgctgtttgggagtttagggaagttttaaaactatgaatttgggtttctcagccctttccacattcctttaaagatgagaccatcaaactcagtcttgatgatatctgcattccacagggttactcagtcactgagcgtttctggcattttatcctgtctgtctgcagtttccacagaatgccaataaggtataaatcttcattaagaaaatttagaaaataagtaatagcaaacttttgttaaggacaaagggtccttttaagagtttgatgtggtccttgccagatggacaatagagacccacgtgcacggacatcaggtggctgcttagtctgggtgtgaaaaagctgcagtttctgctagtgtataggaagtgttatctggattctaatcctggctaattctgcctggcttgcagttcttttcaatttaaataagtgtagtttttaaagtctggaaaggcctgaggatatggggcgggcagggttgatagttttcactctctgtttcctgagagaaaataatgttgcatcttcaaaacagcatctgtcagaatgattttcatcagattaaataaatcctcaaagcagctatcatacttcttagacttgagaaatgtaggttatactttgcatggaagcctaatggcatttaaaataggtgtgttttgcatgtacagccttacacccagacctttgactggggtttctcgcttgtgagattttgttcaagctaccacatctcaaagagtttagtaactgtttttactttataaacgtcataaataattatttgccaatttaagttgctgttaattatagttggaaaaaaggattgggctctgaagcctttgggccaaacttgatgaaaaccttcaacacaacatacgctctgtcacgggacaagttacatgaaaatacatatcgctgttagacattttggaagaggcctgccttttgccatcttttcatgggcagctgccatatgtccttacagccaattatggccttttcagttttagagaagaattttgggggcgacttttggttcataaagacctttaatgaatgatcaatacagattgatatttattattctgtggcagggaagcttattcttaaaattagttgctaaatctaaaccacagtacgatacttcttcacacccattagaatagagcctttatccaaaaaaacagaataaaacaaaacagaaaacaacgagcgttggcagggatatggggaaataggaacccatgtgcgttgctggtgggaatctaaaatggaacagccgctgtggaaaacaggttggtgattcctcagaaagttaaacacagaattaccatataacccagcaattccacttctgagttacacacaaaataattgaaagtagaaactcgagcacatatttatacacccacgtccatagctgcaccattcgcagcagtccaggtgtccatcagcagatgaatggataagcagaatgtggtctgtctgtacagtggaatgttattcagcctcaaaaaagaattcccacacattctgcaacataaatgaaccttgacaatattatgctagatggaataagccagacacaaaaagacaagtactgtatgattccacttacatgagatccctagggcagttaaactcacggtgatggccaggggctgggaggaggagagaatggggagctagtgtttaatggggacagactttctgttgggaatgatgaaaaagttctggaaatagataaaggtgatgatagcataataatatgaatatacttaatgccactgaactgtatacttaaaaatggctaaaatggtacataatttttttgtaattagttgctgagctggctggggtttcaaagcgaagttagaagggagggagagcttggactgtctttaggaagaacgtttgccttgagcagaccagagctaaaggagaccctcagtctggtgtcctgtcacttcccgccgagtcgcctcttgcggctcgataagactttctcatgcaacacaattcttgaatattgtgtaaaaagtgcagtcttaaagcaaggacctcgcctgcggaagtgctggacacatggggttcttttctttcagtgccttatttcttaccagtgccaaacagatgggggcgctggagcacagcagtgcaggatgaagtctcaggccttcatgttgttcttccccaggttaattaggtggaatgcacactgttttggttgtgccccaagagactgctctgacctaagcttgccactgagtgacattccctgtccctgctcctcagctcggagtcagccctcagggtgtgcacaagggcaagttcacggcctttccatcctgagtgagtccctttgactgcggcatcagaccctcagtcttgccatcactcagccaagtcgccagcaccacatccagcagaatgactagccactttgtataggatgcagcacaaaggacaccagtccctggctcatcgccacacccggcgggcctcacctcacccctcgccacccagtggttggcagaggcacatttcttatgctgagcctagcatgattttcattgacatcctctgtctttatgagcagaatccaccaagccactaaagctcagcagattcagtcatgactcagcacaaaggagctatctccgtgaatttggggtttcacaaggacagcgccatctgtgaatgcctcctgtggactcttagacgctgcaacctgcaaccatggccctggacactcctggaatgagctgggcctgtggggggagggtcattcttactgctgggggtctcctttagcccccagggtctccatggccattcagcagttgcgatgggacagtgtcttgagcagctcacatgggagtgaggtgctaaatgtgggtttaggaaaggaaagagcgtgccctgggagtcagaggctggtttctaggcctcagcttccgtgtgtgttttccagcactcaggctagagcagagctgtcatgatctcatatcatcactgttcacacacatttctccgggtacatactcgaggcatagaaccccacccttgtcgtgatcaatgcaggagacgcccagaggacagcacctctgaggagcaccgagggcagggaggaagggcgggactgtggcaggcccctgggctccagactcccgtcctcagtgcacacaggggaccagtgctggagacagattcctgatagccaggtcccccgagagcctcacgtggcagctactacacagtggggctgggctcaaccaaggagcctgtcaggaacacccaacatggaggcctctccaggctggcgccctactgctggatggcgcctctgcgtcctggagttccactccacctctgcaaagggtggcgtactcacagggtagaccaccctcattgctggggatctcctttagcctccagagtctccatggccattcagcagttgtgatgggacagtagttgtgtgtgtgtgtcaatctttataaatacacaggtacagtaatacagaagtacaagtgattttaacttgttttgcttgtctgcgtttcaataatgaatatgtacaggcagacctcagagatattgcagggtctgctccaggccaccataataaagcaaatattgtgataaagtgagtcccacaactttttggtttcacagtgcatataaaagttatgtttaccctccactgtagcctattaagtgtacagtagcattacgtctaaaaaacaatgcataacttaatttaaaattttaaaaatttaaaaattctgtatgctaatgatcatctgagccttcagtgaggctcagtctttttgttggtagagggtcttgcctcagtgttgatggctgctgactgattggggtggtggttgctgaaggttggagtggctgtggcagtttcttaaaataagacaacaggccaggtgtgatggctcatgcctgcaatcctagcactttcggaggtcaaggtgggtagatcacttgaggccaggagttcgagaccagcctggcaaacgtgacaaaaccctgtctctactaaaaatacaaaaattagccaggcatggtggtgtgtgcctgtaatcccagctactctggaggctgaggcatgagaatcacttgaacctgggaggtagaggttgcagtgagcagagatcacaccactgtactccagcctgggcaacagagtgagaccctctccctctgtaaaaaaaaaaaaaaaaaaaaaaagacaacaatgaagtttgtgacatagaacatagatcaactcttcctttcaggaaagaaagatttctctgcagcatacaatgttgtttgatagcattttacccatggtagaacttctttcaaaaatggagtcagtcatctcaaaccctgccactgctttatcaattaagtttatataatattctatatcctttgttgttattttcagtgtttacagcatcttcaccaggtgtagattccagctcaagaaatcactttctttgctcatccatgagaagcaactcctcatccctgaggattttaatcacaagattgcagccattcagttccatcttcaggctccacttctaatcctagttctcttgctgttttcaccacatctgcagttagttcctccagtgaagtcttgaaccccctcaaagttacccatgagggttggaatcagcttcttccaaactcctgttaatattgatattttgacctcctcccatgaatcatgagtattcttagtggcatctatagtagtaaattctttccagaaggttttcaatttactttgcccaaatctaccagtggaattacttatttcttaaataataagacttgaaagtcaaaattacttcttgatccatgggttgcagaatgaatgttgttttagcagacatgaaaacaacattaatctccttgtatacttggtcttgggtggccaggagcattataaatcagcagtaatactttgaaaggaatctttttttctgagcagtaggtctcaacagtgggcttaaaataagcagtaaaccttgatgtaaaccaatgtgccgtcatccaggctctgtcatcccatgtatagagcacagacagagtagattttatgtaattcgtaagggccctaggatgtttggaatggtaaatgagcattggcttcaaattaaagtcatcagctgcattagtccctactaagagtcagcctgcccttggaagctttgaaaccagtcattgacttccctctctagctgtgtaagtcctagatgacatctttttccaataaaaggctgttttgtcaacattgaaaatctgttgtttagtgtggccactttcatcaatgatcttagctagatcttctggagaacttgctgcagcttcttcctcagcagttgctgcttcaccttgcacttttatcttctggagatggcttctttccttaaacctcatgaaccaacctctgctagtttccatcttttcttctgcagcttcctcacctctcttagccttcatagaactgaagggagttagggcctttctctagattagactttggcttaagggaatgttgtggcttgtcttttatccagaccactcgaactttctccatatcaacaataatgctcttttacttccttgtcactcactccagtgctcactggagtagcatttttaattttctcccataactcttcctttgcattcacaacttggctatttggtgcaagagaccagcctgtctgagcttccgacatgtcttcctcgctaagctgggtcatttctagcttttgattgaaagtgagagacatgcaactcttcctttcacttgaatacttccaggccattatagaccattgtagagttgttaattgccctaatttcaatattgctatgtctcagggaatagggaggcctgaagagaaggagagagacagggaatggctggtcagtagaactgtcagaacacatatgacaagtattgattaagtttaccatcttatatgggcacggttcgtggtgccccaaaacaattacagtagtaacatcaaagatcaatgaccacagatcactgtaacagacataataataatgaagatggacacccatagacttgcttatgcagagttgccacaaaccttcaattcctaaagaaacacattacctgtgaagtgcgataagcagatgccataaaacaaggtgtttgtttgtgtgtgtgtgtgtctgtagaggggagggtgtttatatatgtatataattactcaagcttcctcagccaccttttagggctcagtttggtgaggaagctaattccctttattatgcatgtattcttactagattgactctctatggatgacattttatatcaagtttctggagtggggtgatgtcctgcatttccgcctttcagagcctcagcaggttaaaaaacaaataggacatggagacagtggaagccactgtgcactcctgctacggaaagacggctgtgccttgttgaagatgatactatatgattcgctaccagagtggggccatccctgcttcaggctgttcctagatgtttaaaagaacattccaaacgacgttaagaaactttgtgctgccatttgtgtattcctttccaaatcttttctaaaatgttagaattcagaccacagttcctgagctttggatgcaaactccttggccctgaatccctggaagccctcccctgtggatggtatcagccatcacagcaggatgtgctttaagaatccaaatgaattcagttataccacgtggcgggacttttaaacttgagctgagcttactcatttctggccgactattaatcctatagctaaatcatgtacgtaaaggaaggggaaaaaaatccaacctgggtaaccacacaacaaacactaaataaaaccaaggtaatgtatggggcatctctgtgctgcttagtaaaacttgaagtttcttaatgtcgcgaagtaacagaaattacttgggggaatttcaggtgtttttggtaaactctttggggaagtaaacagtcagtgaactttcggaatgctgggacttttgactgcagcaaaacaaagctaagacaagtggattccttaaaaaagaccactggcagcagaggagaagcagagctgggaagagacaggctggtgagctcaggggataaattctaccccctctacccagcaggactggccttaagcaaaactgaactaagagggagatgcttcccctccacccacctccgtgagtgtccccgatcgatcgcgctgtcccagctgggctgaccttgtattcacctccaggtcttgggtgtctgtacctcttggtggaggcatttggaagtgcacacaccttgtccactacctcaaactgtgtcctgatgtttttaaattatggcacacgtagccataaaaaataagtgtacagaagagtatataattacatggagagatgcttgccatagccttagttcagaaggcagattacaaaacagtataactatttttgtaagaaaaaagttaataagaagacaagcacgtacatctgtccatagaaggaaagcctgggaggatagccccacgttaacagtgtgtgtttccaggtggtagacctgctggcgatttgagcctgtttgggcttgtctgttttttcacactgagctgtactgctttggtactgcatccattccctcaatactcggcagtttaggtgagctcagtgtgagttaacatgtcaagaggtgacatgtttcccaaggaccttatatttgtaatgctcagggattgatggggacgggaggtttgtgttggctctagaatctcccctgtgaggacgctggaaggggaagcctagggttgaggaggcagtgagaaagtctccaagtccacaccatgtaaagctacttctcccctgctttagggaagcgcctgtttcacgatctcattaaatccaaataaatgggcttgcccatagttaaaatgtgttgatttaaccaaaaaacaaaaataggctgggcacggtggctcatccctgtaatcccagcactttgggaggccaaggtggaaggatggcttgaggccaggagtttgagactagcctgggcaacatagcaagaccctgtctctacaaaaataaaagaaaatagccaggtatgatgctgcacacctgttgtcccagctactcgggagactgaagcaggatcacttgagtctaggaggtggaggctgctgtgagctatgatcgtgcctctgcattccagcctgggtgacagagaccctgtccctaaaaaaaacacaaatagaaagtggttgaaggcaattcactcgcagttggctgcagtctgtttctctctcgtacttggggctgaactagcctcaggagaaggaggctcccgagccccgtagtgtgatcattacaacaaataacgcagaggagaggtttgcttcccattctgcctccacgccctccagcctggctcatccacatacacatcgtctgccaccgtgttccctgttgtggactgttttgttaaatctgccttttcccttctttttttccagtccacctaaacccactgtgttcatctctggggtcatcgcccgggtaagtctgggagtgtctgcggtgggtttgaggcttttgcatggcagcatggagtctcctggttgcttctggttttgttaaactctacctggaataacccagcaccactgctcatctcctctgtggccatggctctcttcattgccgcgtttccccagaggctgcttctgcagaccgcaggccagactcgcatcctttacctttccagagccgccgtctggtgagacccaacattgtgacttaagcgcagacctcccaccagtgaactcccatcagcaaacccccgcagtgaaccccacagtattgccgtccatagggctgctgttctcagaacattcactttcttatcagaggatgcctgaagaaagtgccagtgttggggacagcccactgttggtggagctgtgaccgcagccagccaacctgccagccagagaagtgtggctccagcctgcccatgtggaccccaccctggccacacccacagttggcacagaagcccattgatccctctggaaaatagggagtccctcctgagactggacaggccgaacctggctctgtctcgtaggcgccctgtgcatttccttcccagccagcgtcccaggcctggctcacagctgtggtggcacatctgaacttaagatcctggatttggttctgtcctgcccccaatttaaatagtcacaaatacagatgtagcagaagaaaccccgcagcatccaagtcagttctgtgggagtcgcatgttcctgtgtctcacggcatggggcagagccagtgagcattcttgctgtcctgccagtgtgtgggcctcagtgccacctgccattccctggttttgattgcccaggccccctaacacccacaagggacagacttccaccttcctttatccattcacagtccacgcctgccctgcagggacgctggtgggtgctggcctgggcttcctcacatacaactgccatgcttcctgcagggacgctggtgggcgctggcctggagcttcctcacccacaaaccccatgcttcctgcagggaagctggtgggtgctggcctggggcttcctcacatacaactgccatgcttcctgcagggacgctggtatggggcttcctcacccacaaaccccatgcttcctccagcgacactggtgggcgctggcctggagcttcctcatatacaaccgccatgcttcctacagggaccctggtggacgctggcctggggcttcctcacatacaaaccccatgcttcctgcagggaggctggttgctgctggccttcggcttactcacatacaaaccccatgcttcctgcagggacgctggtgggcactggtctggggcttcctcacccacaaacaccatgcttcctgcagggacgctgatgggtgctggcctggggcttcctcacatacaaaccccacgcttcttgcagggacgctggtgggcgttggcctggggcttcctcacccacaaacaccatgcttcctacagggatgctggtggctgctggcctgtagtttccacacatacaaaccccatgcttcctacagcgacgctggtgggctctggcctggagcttcctcatatacaaccgccatgcttcctgcagggatgctggtgggcgctggtctggggcttcctcacccacaaacaccatgcttcctgtaggaacgctggtgggtgctggcctggagcttcctcttatacaaccgccatccttcctgcagggactctgttgggcgctgtcctggggcttcctcacatacaactgccatgcttcctgtagggacgctggtgggctctggcctggagcttcctcacatacataccccatgcttcctgcagggacgctggtgggcgctggcctggggcttcctcacccacaaacaccatgcttcctgcagggacactggtgggtgctggcctgggggttcctcacccacaaacaccatgcttcctgcagggacactggtgggtgctggcctgggggttcctcacccacaaacaccatgcttcctgcagggacgttgatgggcgctggcctggacgttcctcacatacaaccgccatgcttcctgcagggacgctggtgggcgctggcctggggcttcctcacatacaaaccccatgcttcctgcaggggcgctggtgggccctggcctggggcttcctcacatacaaaccccatgcttcctacagggacgctggtggatgctggcctgaggcttcctcacacacaattgctatccttccgcagggacgctggtgggcactggcctggggcttcctcacccacaaaccccatgcttcctattgattaacctgagctttccgtgtttcctgacagggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctccagctttgttttttcttatagatcagagattcccttttacattttaccagggttgccaggtggtttcagtagaaatacaaacgtgtacatgataggtattttcaaaacttattttccagatagaaaagtagaactgttggacacctggtgactggagtctaattatctacttaaaatgtcagaacatggaaaaagcttaataccattgattaaaacatattacttgggcccagcagctggcctgtgccaggtaggccctttgggaacagatttaagagagaatgatgaatagtaagcccaggggtgacagtgagcagcttttgatgtacaagatgtttgccttaatcagaaggtctcctgtaacccttgtgagaaaataatcacaactattacactggcaatccagaatcaaatcagaatttgagtgggaggggcctgaggttttctcacccagggccatatttgtcagggagcaccagagagagcaccaggggccacattcagagccccggcttgggagtggctggagcccacgcctccaacaaccctggccttgcctggtgttgcctctgaagctgctgcttgtattcctgcctcctgtctcccatgctaagctgaggacaggaaccagggccatactcattttctgtcactgggcagagagtccattctcagtaaatacattgtggtggccagaaatgccaagcatccaacaagcatggaacagaaccacccccagggctctccacatcattcctgaacatcattatcctgtgtcagttttctattgctgccttaacaaagtcacaaattaagccacaaactgggtggcttaaaacaacaggaatgtattctctcacagttctggagaggtttgaaatcagtgtgttggccaggccacacgccctccacagactcagtgggagttcctggcctcacccagctcctggcggctgtggccatccttggcattccttggcttgtgggcagcatcactctggtctctgactccgctgtcatatggccatcccctgtctatgtgtctgtctccaaatctttcttgttttctgaggataccagtcattagatgaatgcccaccctatgccactatgacctcgccttcactaattacacctgcagagactctgtttccaattaaggttacattcagaggcactgagatttaggacttccacatatcttttggggaaacatcgttcacccaagaacatcacccatgtgctgaaaagccagaaacctcactcccagctcacaccatttgaagaacagttcacttagtgcatcacttttctgcaaaaactttgctgggagaaccttcacctgctgcaggtttcatgataaagcatctctagccgtgcagcagcccaagcctggctgcaggacgtacagagaaaagactggaagcagagacatgaagggacaggacccttggctgcagaggctgcctgtccctgggtccagtggctgtgggattacttgctgtcgcatgtgtcctcagcccagagagtcgcggtgttgccactgtgctccatggatggtggttgtaccattttacaggaggaaagactgaagttcagcatccagtgtcaaagccactgttagcagttggccaataagcacatcaaaagatgctcaacgtctttcgtcaccagggagatgcagatcaaagccacaatgaaataccacttcaccaagatggctagaaccaaaaagtctatggcacaagggtactgacaggaatgcagagaaattggaactcgtacaatgctgttgggagtgcaaaatggtgcagccacttgggaaaacagtcccaagtgaaaaaacagaaaaacagtttctcaagtgagaaaacagttcctcaaacaattaaacatagagttatatgacccagcaatccactcctaggtatatacaccc

SEQ ID NO: 16110 - DNA, 231129 bp, Human
ttggaggcaccatatgtgaaacgctgcattcatggtttccaacttagggatttagagtccaagagtgctctgaagatttccactttttctgctttcatttgctgatgaatgaaaataattcccgtaggcatattcggaatcatcagaggccaccctgtatgaatgaagcatgctctattttgtttgtaagccggattggaagagctgcagggctgaggcctctggatacatccttggctgttcacaaaagaggtgtttgtttgtttgtttgtttgtttgttgtctttaaagagggatatttcttcattttgaaaacactattttagcaaagctgagcaacaccaacgtagcaagtaatatattaattaaccctctccattcatttgacaaatatttcctgaacatttatgaggtgtctggcattgcactgggtttagggatagggatatataacagagacatttcctcccagaacacacatcctaacaggagaagacggacaataatgataaacataacaaataagttagaacatgacaaatcctatgaagaattcaatagcacttgaagataaacaagaatgctggcttggggtgagggtgtggttctaagtgcagttttaaacggtgtggttagagtcacctcacagagcagcacttgggcactactgaaagagcctggggatggcctggcacggtggctcacgcctgtaatcccaacactttgggaggctgaggcgggcggatcacgaggtcaggagatcgagaccatcctggttaatacggtgaaaccctgtctctactaaaaatacaaaaaaaatagccgggcgtggtggcggacgcctatagtcccagttactcgggaggctgaggcaggagaatggcgtgaacccgggaggcggagctggcagtgagccgagatggcgccactgcactccagcctgggtgacagagcgagactctgtctcaaaaagaaaaagaaaaaagaaaagaaagaaagagaaaagaaagaggctggggatgtagccaggtgtcccagcacatctgtgacatgaatgagtttttctgtaatcaaaaaattaagtagagaagatgctaatccttcgatccctgaagaacggtgaagcataaagtgtaaaagaagggtattcctgcacgaatcatgctctttgtccatatacatgcaaaagttttcagatgcagctttgctaatatagcctgtgtgttaagtagccactttattttgtttctaatttaaattttaaaattgttccccaaatcaaagggcagccaggagaacatgcatctcaaaatacacagcaaaaatattttgcatttacttataaaagattaaaattttcttttgataaaaagaagagtaaaatgtagagtggttttgttgttgttgaatcaaatacctaaattaagcataacgtgccttggcctcacaccttctgtctctcatgtaagagacgttcttatttccgcgggtcttctgagataaaactccttgtgtcaattcttccagtctctcgtttcgcttctgattcctttgaaatgtttagagcatatccctattaagcataattttaacattttgtgtatcattcctgcagccctttaagacaatggttaaatttaataagtctagggaatgaggatcactctaatgccttttatttcttcatgtgcttcatccatgaggttgtggcatattttatggagagaaatgtctaaggcactcaatatgaagttaaaatcacctttccaaaattctatagttcgaaagaaatacatttggatttttattggtaggatattaaagcaaataccggcaatcaaatataaagcaaacacttatttttttcttgtttccttttgtatgccttaattcagtttggtgcgattaattgttagcagatactttatatgaaaaacatgttttggtgtaggtagggaaaccttacactgtaaagcaaaagtggtgtcctttgctctttcagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggttagaatcattattaaattattatattatatctcaagataaactttccattatccaacacagaggcaaatgtactaatcaaataaatattgtggtgttctaataacataggcggtctcaatatgtgttttcaaatgagtaaacaactgaagaaaatggtatcagatgtgacatgcatggattcatattcaataatccagtaaatgtaatcctcactaaaattctgtgatcatgaacagtttttgtcagtggatgaagtagtagttgagcatcgtacaatacccagggctctttattagaatagcattaataataattgatcaaaggacaaggtgtgtcagtttttgctaataaggtatatattctggtttctagtgtgtttaacaacagacggcttatcctacttagcagttaattttttaaatgaaatattcatgtctattaaaagtcacaattattacatattaaggaattttcaaaaagggaacattaaagctttttcatgattgtagaacttttgggcttagtaaaatggagataattatagtagccacaccatagtcgtgaaggtttcataaatgagaccctgtaaaacatttggcacatatatggaatacatgtaaacacagtccgtgttagccataagctgtcatccctcccttttaaaatgtgcagtgttacttggagtactaatggcccaggtggcctcaatacagcatttcaaataactctgctgcttactcatcttaatcaggctcactgccattctaggtgatatttggttttcagttcatcaaaaagtaccccatcagcaagtatttagcaaatggattgcatagttgactgtctaaaaagatcttttaatcatctgtgattccgtcgaccttctgtcttaactctaaaatttccttgtagctatgctgatgaagtagatgaaaatgtgtttttaaagaaaatacattattcaagctagagagtcataaatatttgtccagtcccgggtcaagactcccaactttcgtatattttcttaaatgtacactctttgagattattgtcacatttctttctcactcttggttgtattagaactagatgtaaattggtttttttcttttgttttttctttccataactagaaaatcatctttgtggaaaaaataataattgttaaaattgccgtgctactaaagcaatgtttcacaccaaactaatgtggggagacatgagtcagggaaagtaaaagtacttttatctacacagtatgatatctatgatagtttaggggtgagttatgtaactgaaaatatttcctaccattatggttaggaacacccatccttatatttgtgggttgtgcttaagttggaactgcctgcaaaagaaagagctcagtgcatgtgatggggacaggaggcttccgtgcagtaagactccaccaacagatacatgaagccacgagaaaggaagaccagcagagcaccttctgtgtacaccgtatggattcatttatgatttgaaaagaattggatttgactacaatttgaatttgctccaatacaaaattcattgtgtagaagaacccctctgttgtggcttccctgattgccagaaaaactcagccacgtgccaaaggttgagatgaatgatggcttaaaacagaatggaaatcccatacccctgacacatgacatcttctgcagcatgtgtcttatcctgtgctgccatttgaagcagctgtaaaggaactgaccgcagtctactccattgccttcgacattgcttccaacagcttctgggtgtcggccgttcacgtgtgcctgggcaacatcagaaattcctatgtgagccccatttggaaaaccaaaggcataacctcttgtttcttttcctggtgaaacgcaggctgtaggaaggatgcttgcttgatgtatggagaggatacactcttattccacttcttttaagaagaaggaggtttgcacccactgtcatgtcttgacccactgtgttttcatcagcatgtgctgggggtttgaggctctctgtctgtctcctcctagacgaaatgctgtcttttgccgtgatagccacatccgttaagatggacagtggttgttacttcaatagatgttttctgcctttctagagcattttcatgttgtgcttggctgaacttcagccatcagtttcacctttctcaaagaaaaacatatcagaacatgttgacaagctgaacttcatggtttctgaagttgccatcatggattctttagaaaatccacaagccacttggccaagcttccactctagtaaaggaaattggaagagagcatctaggagaacattctagtgtgaaaagaattgctactgtaagccagtctagtgattggctctagacaaagccttctgagtttccttactgacagaaacctgagggggcctggaaacctgcaggactcagctgacatctgcacagtcattgcctcaatgatgtaaagcaagccaaagccagcttcactgcacaaagcaaacctaaaatgaggcaaaaggaattcacctcagagaaagcttggattctgttgaccaagccttggatgccctcagttgaccacacagtgcagccacggagatgtctacaccagtgccccctacagtggtgaggctctgctctgaatggtcaggagtgtgcagcactggctgctaaatatttaaagcgataggcctgacaaacatgtccacattttgggaacttgctagatgagccgcaagggagtggatgactccaagaggtggagtagggtacaagaagaaaggctggcttcacgtcttttgtcgcaaggagccgctgcaaatctgtttaggaattaggtcaggtatccatgcatgaattaaacaaaacaaagatctaagtgtaagaactataccccttacttcctttgcaattctcccgtggatctaatacagagctcagcaaagaaaaatgacttagtacgttacaggagccccaccagtacaggggagttttttctgatcactttcctacctattatctcatggatgagagcaaatgttgaacaaaaaattacaggggaaggcagggtgaggtctccctttgaatttcttacttatttgtagactaggatatattataaacaaatattcaaaagaacaattttagtgatttttaaaaaactaaagcacagtttataaaccagattttagattagacctagctgtatatccagaagaacctatgatgtcaagagtgccaaattataaataagaaagaaatgatcttgcagagttttaaattatgtattgaatattgcttggcaaacaatttgaacaatgataaagagttaaaattgagatatttacatgcatttacattcagcgcataaacatgcatgctgaaaaaaacagctccctgtttgcacggcaatatctcttcacagcagaatatattttgctgcctgctatgtcttgcaataaataattttcttcctatgcaataattactatgagatgatgatgataattttatttaaatccaatcgaagctattgtatgctagccattgcttgaaaagctccgaagcaaataaactttgattagaaatgctgcacgtcctttgggcctgactaatataatttttctctctctaaatatggaaataattgaccaaaattttgagtatgcccaactaaagatttcagaatgctttacaaattataataaaatggtttttattaaactatagaacttagtaaataggtttcattttggtgaaagcacgtgtcttgagagctctgcttctccaggagcacagtgtccatccgtctgatgcttcgcatatccagatggcctttccttttagttaaggagtcgggctgaggacttaaccttgtccttcatttcgggcatcattaattccctcctttctccatagaagtcccttccagaatcttctgtcttcaggacggatttggatattgctctccagacctgcacagcaatcctggattagaacttctgtttccaagatcctatgccctcttctctcttgtttttctctctcataagttcctgaaaagggatgcttaggacattaaattctaaaaaaataagtctttaaccctcacacatgagtgatgtttactagatacacaattctagatggaaaattctttttctcaggaatattttctataatttaattttaaccttaatactattaaattctcttgtgatatatctaggtgtgtgcctttaaaaaaatcgttgaacattttcaatttaaagagtcatgaccttcttcagtgccagaaaattttcttcttctcttttaaaataattcttttgtctccatttcctctgtcctctctttctgaaattagtcagattttgagcctcttggattatttctcttgtattttcttatgtaatttggagccctttgcctttttatcatatgttctgaaagaattcactgatatccaacatttattttcccccaatttttctgtgacttccatgctcccactaccaggggcccaagagaatatcatctctttaaaagaaaaattctaagaattctcttttgtgttttttaatagctcctatttttgttttatgaatgtaagatatttttgaatttctctaaggatattagttagaactgaagtttgtttttatctctttggcatgaattatctcaatttttttcattgtcagcttttctttttttatggtgggctttttcactgattttgcaggcttacttcaaatctgtggtggtcttcaagttttctgcttatttttaaaatagtggaatggagtttttctgagctctctgcatgtcggtgaagcttgttcacagtgaagcttcacttcagggcgaatgggtgggagggaactgttgtagtggggagtcttttaagtgtcttaatcaggagggtttttctctaaggcccaaatatcctcagtacctttttggttctccccatcacaatccatctctgtggagattcttctgagttgtttattttgtttgttggcctggaggaaggggacagtactttcctgtctgctgggtattctttcaacctaggtgaaagtggagaatgagaggtgactacttcctttcaatcacccctttctagcttgtcttcccatttctgcaccccaggtgcctgccatctcttgagtataaatctttcctagtgttccaccaggaaagttagccacctccctgggatagggtcccctctgtgtgtatcctgggctatgctggcttctccctgagctccatctgtcagctcacctctggctgttttgtatcttacagaaatgtgatgaaatttcttgtctgaattactccttccattctcttctctattccattatgtccatggtaaataacatcttctgtcctgtatgagttcagaactcatacagtgaactctgaacagttttgaatattaaacaaagtataaatatgtttacagatattatctctgttgctgacagaagccaggctggaggccttctttaaggtcagccaagtgaccttgctaatttaatagaagttcaggtatagcattaatgaagcaccctgcatgaaaggagacactggaacagagaggatgcatttatcccactaacatccccagcctatttttccttcaccctctttgttatgatcacccagaggcatagcccctctccccagagcaggagctaagtaatttgtcaagaaagctcttcttctatcttgatggcactttttggggatcacctggaattcttggtgggcaattcatatattacaccaagaggcaccaaaaggggtcagaggagcaaattatttaaaccaaattcagggttactatgttcccaagatttaaaattaagtccagttttatttcttattccaaataatgtccaggtacattgtccaacctagcaaattagaggttctatgagaagattaaacaacatcccaaagataaaaatgaatacagacatttcaataatgaaatgccagcaatgtagagatgcttcaaattttaatataaaccctaccaaatatcaaattcccatggagaaattaaaaatcaaagtttaaatccactttcatgttgaagtccgaagacattaaggttcaaaggaattaaagtcaaagaatcaatacctcttgccattgtgtgttaaagttcaaaatccacaattcttaagttagctgatgtgtaaaaatcatcttctcccaattttttattctgcacagtctcagccagggggattcttgtgcctctatggggcctgggtcctttagcagcctgaattcggggctgcctcacgctggaattggccacatactttcaggacctcagaggatgcaagattgcattgtcagttctccctcctctcactgttcaaaggtgtgaacaatggtccctgcccatcaaatgtagcaagcaagtcattgtgaccccctaagggaaagtatcccaggcacaggcatgttcccagaagccagccctcaccaggtttgcctagggtgtcagtggagtttgtattggtcatctgtggctgctgtgacagttcaccacacatttagcagcttaacacaaggaagattgattttcttacggttctggaggttacaggcctgacacagactcacctggctacaatccagctgtcaccggggctgtgttgctttcaggacgctctaggggacagtccatttcctcgccttttccagcttccaaagctgcccacattctttggctcatgacccctttccactgccttcaaagccagtagcattgcatccctgatgagtcctccatggtcacattttcctctgatcactgccagaaatgattctctacttttaaagccccgtgtgattagattgcgcccaccgggctgatccaggattctctccatgttagtctccccattttagattctttaccttcatcccatctgcaagccccttttgccatgtaaaggagcccattcataggtcctgaggagtcaaatgtggacacctttggagaatgattattctgctccccacagtgtctgagggaagtgagcacatggagaccccttggatttagtcgggggatgccagcctggtgttgtgtggctttgagagtccatcatctgtggacttaacctgaattgggagaaataagtccaggcaaaggttcattctggcatgatgcatttcccactcgaagggagattcctcgattcccattgtctcttctttaggaaactggaatcacaggaattgttgccaccttgcaacatttagatactggcagcagaggcagcgcctgtctccaggtgcatcatggtttgaccagggaggcagaagcactgtagatgacatggaaagggggacttgttatcaggattagacctgacaccacggtgagagctggtgaaaacgcctgtggaaggctttgccgctgtgtctggtgatgggcctgcagttgacacgggccagcaggcagcagtcagaaagaacagcaggatgtgaagcaggggaagccagagccagctgccactcatggggacaaatggcacccctcttttgcctctcgctggctgcaaatctgccacatgagtgatacacaaagctgccgctctttgccacggaactctgcatgattattcctggccaggacctagggaagtggaaagaggggatgtggtgggagctgtcagagctgtggcctaaaaggtggagcagcagcagggggtacgtgcacacactgcagcagccctgatgccctctgcccgcagccctcagagctcagcactgtgcttcacttggacctgccaggcatcccgcagatgtctccatggacagtctcaacctgcaaccaagcagggagggaaatcctgggaagcatagttgcagttcagctggggtgacacagcacaaacccaccactccaggtcttatatgaggtggtttctttcccttcctacataatggaaacctttgattttggatttcctctatgggagtcaggtgttttggtccagtgtcccatgagtgtgttctgtcccgtgacaagccttccactgtcctgtggtttgttagcaggttttcctcaatcctatggggcaacagtgatttctctgctttttatgatggaattgatttgctcccctatccctacgaagattgcaaaatcaccctcaacagactcctgaattgaagctgctcttgccattgggggaacctgctgcgccttcaagcccagacctctgctgtgtgcactgcaggccactgtctctgcttgctcctgctctaggccctgagaaatgcatttttccagcacttctttttactgctgggatgggatgtccttctgggattcattttcctctgctttccttctgcagatctcaggaaggctcagttctcttgaacctgcttcctaagttggacactttgcttttcagcacttggaagtgtagcagtgtttgctgaaattgaatcctgcctgccttctacttttccgttgttcgtgaacctgaaagcattgcactagaggcaatatgcttttctaccattctcttctagattctagaacaggacttggcaagctttttcagtaaaaggacagatagaaaatattttagcttgtaggccctaggtctctgttacaactactcaactctacctgtgctggatgaaagcaccatagataatacatcaacaaatgtgtatggctgtgtattaaactgtatttatgcaagcaggtagctcaggccatagtttatagaaccttctatttcatactgtcttctgcaaccaagttctaacagaataaagaagaaggccacattgtcacctcattactgctaggggttgggttggaggccagactccaggccttttagccacattggtttgctcacacagaatgccagatgccagaattagttagacttatctaccatggcacaggcagccgttggatcagggcagcttcccttctcctctgccagccactagggcacatcttatggagaccaggggaagcagagttcctcatggcctttcatcccaaagtggaagaagctcagagctgggccaagccctgcacgcttactagtgccttggacaagttcctctacctctcaggggaagagcaagtgaggggctgggagagtccagtgttacataattgtgctccattcgcagtaaggaaacatcaggcctggggaagaatccttcccagtacattgctgttaattctgatggatcaatgatgggcagaggagataagtatttggtctaccttttgatggcaagtcatctcctaaccagctttgtatctcatgccttctatgctgagacattgcccattcttgtctcctgtcattttgaacattttaggattatctcttcacagaggcaagcccaaatcatatgcacaggcagagggcaaaaacttacaaccctcagcactgttctgattcctaattgcttccccaaacagactgactgtaatccaattaggaaatccacacctttaactttctgtatactccaccctcagtcctagagacagaagccattctgtagactgtgagtctcattcattcattcattaaacaaattgctgctgagtgcctactatagttaacccttgaacgacccaagagttaggggtgctgacaacccctagagctgaaaatttgcatacaatttggctccccaaaacttaattacaaatagcttactgttgactggacaccttaccagtaacataaaaagtcaatttacatatattttatgtacatattatatactctatttttacaacagtgtaagctagagaaaataaaatgttattaagaaaattataaggaagagaaaatatgtatgcactttattaagtaagagtggatcctcataaggtcttcattctcatcatctttgtattgagtaggctgaggaggaggaagcagagaggttggtcttgctgtctcaggggtggcagaagtggaagaaaatctgtatataagtgtacctgcgcagttcaaaccatgttgttcaaagtcaaatgtatatggaagtgaagtttaggtgcttgggatacaaggagtaaggacccaggcaccttacagccatagaccagccttccttatgatatggctttcttcctaatggtcaagatcatggcacctgtttttcaaggagccacatggaggaagggagaaaagaaggagcagcattgagaggagtcttggtatttccattgattcatatgtagaggagtgaactgtgtcaagacaataagtgaaatttcataatctattaacagaaccattgtgggctattagaagctggaactcgtagacctgccctcctaacgcttgtgtcgtagtggacaagacagacaataaactgagacaaataaatctgtaatttcagcatgtgacaagtgctgtgaagaaaaatcaagcaggctaaggagattagaaagggatagaaatttactacttagaatgaagtttgaagaaaggaaaagccccggataatgatctgttaaactagaggaagttttgtctcccatacgtgaaatctggagttaagtgttccaaggtgataacgcagctgtatcccatagagtcttcagaaacccttctagccatatggcttcttccagccatagctcccccttccttatgggatggctctcttaccagtgaccaggatggtggcaccagtgtctcagtgaacaagacatttccatatacagtatttgtttttaatttttaaattttatttattttaaagttccagggtacgtgtacaggatgtgcagtttgttaaacaggtaaatgtgtgccatggtggcttgctacacctagcaacccatcatctaggtattaagcccagcatgcattagctatttttcctgatgctctccctcacccaactccctgactggccccagtgtgggttgttcccctccctgtgtccatgtgctcccattgtttagctcctacttttaagttaagtgagaacatgcagtgtttggttttctgttcttgtgttagtttgctgaggatagtggcttccagctccatccatgtttctgcaaagaaatgatctcactcctttttatggctgtatagtattctatggtatatatatataccacattttctttatccagtctatcactgatgggcatttgagttgatttcatgtctttgctattgtgactagtactgcagtgaacatacatgtggatgtatttttataatagaatgatttttattcctttgagtatatacttagtaatgggattgctgggtcaaatgatatttctggttccaggtcttcatggaatcaccacattttcttccacaatgattgaagtaatttacattcccaccagcagtgtaaaagcattcctgtttctccgcagcctcgccagcatctgttgtttcttgactttttaataatcaccattctaactggtatgagaaggtgtctcattgtggttttgatgtgcatttctctagtgatcagtgatgttgagcttttttcataggtttgttggctgcatgaatgtcttcttttgagaagtgtctgttcatgtactttgcccactttttaatggggttggtttttttcttataaatgtgtttaagtatttttgtaaactctggatactagacctttgcagatagatagactgcaaaaattttctcccattctgtaggttgcctgttcactctgatgatagtttcttttgctgtgcagaagctctttagcttaattagatcccatttgtcaatttttgcttttgtggcaattgcttttgatgtattcgtcatgaaatctttacccgtgcctatgtcctgaatggtattgcctaggttttcttctagggttttttatagttttgggttttacatttaagtctttaatccatcctgagttaatttttgtgtaaggtgtaaggaagcggtccagtttcaattttctgcatatgtctagccagttctcccagcaccatttattaaatagggagtcctttccctgttgcttgtttttgttaggtttgtcaaagatcagatggttgtagatgtgcagtcttctttctgagttctctattctgtcccatttgtctctgtttctcataaacagtctttttaagggagttgtagttagttgtgctatggtaagattagactgctaacatttatatatgggtaagtcaagcttaataccccttctttattacctttgtcacagagtaggactttgcagatgcctctagagccaatatgtcacattatttcctgtgttttacattcttattgttgtccaatgtgcctaacctgagaatccaggtattctctgcatttctttcttgtggaccaagaagagataagcatacatttacgaacacccacacttaccggtcatagtgctacgtaccgtccagtctatcattgccttgaatactcctgaggtcctgtgaggttggatgtaaggggcatgcttaaagtcacagctggtctgtggtactagtgtagtccttgatttccaaagccagtctgctttacaccagtgattttccagtttctccaatcataagagtttctttggaggcacttgataaaacaatacatatttctggaccctagattttcacgataatagcttgggaatccacacatttagcaataccctctcgaggttcttaggatcatgcatgtttgagaaacaccactttctactttaacaggaccaacaattacagtggactgcagaggggtggaggattaggagacatggatgtgttttgagagacgccaaaataatttgacgctaatggtaactacactatccaatgaaaatatatggcccgtttatcacttttttcaaattagaatgaatttgaggttacctcatattacagtgtgcttcctcaagtgagagagaaaataagtggaatcgcttccactggatatagaagaaatttcctgtatccccctctgacttacagccagcagtaagcaactgttactgatggcagtgttaactggggtggagcttgcatatattatagtcctttacttccctatgaaaccttgtgaagtttcatcagaaccttctgtacaccgatcagagagtgttttgtgagcatgatccattttacattctgcagcagtaaaatgttggatgttcttgaaccgtctgaagttgccttcagttttcacctccgtgatcattagggctggtgacgtgagatgtatctgtgcttatctctaattacatttcagagcatgccaaaattgtataaaggcttaaaggaaagtttttctgggtctttgtgctttgttttgtatttgccgagattgaaatgtacagcgcatttccatttgttaggtctgacaatgcataactgatttgtggctttactttgcaactcacgagttacaagttaattagaaacacttttccctaattatatttgagagtttgctctatttgctctacaattatcacaaaaattacattaactagtgttaacgaacacaacatagcaatccccactggatcctggaggagaacaccaaattatataacgtctacatcccttgcccaacacctggtttcctttccaacagatgtttttgtttgtcattcctgatgaaacgtttgaaataaacttcctttttggttatccgttagaggatgaaactcagcctagaggaggagaagcttcagttttgcacatgcaaaactcttttcacttagcaactcgctcttccatcatgacggctgttgtcgttgccatcatggcagctgtgtacatcaactgtgtgccatccccagggaatgcccagaagaagaatctctgtgaagtggtttcctaaaataggagcctgtatcatgaggcctgtaatcccagagaagtcaggaaatgggactgcttagaaggtgaccttcttgtcttccttctttcttctccagttcacaatagatgcctgagcagcactacaaggttgctcagtcagggtagacaagagcatatggaaatgatgtagatgtgagctctgttctccaggagcagtccactgagttagggagagggagatagagaactgttctataagaaaagcatggagagagggccagaggagcttagaggaggaaagagaaacttcagttgaagagatcaaggaagactttatgaagaaagcaacatttgaaatgggttttaaagatgcatatgggtttggcgtgcaggtaatgggagcaggagaataaaacatgggccacgaaggttacaggggcaaactctctttgcatgcttctttaataagaatggattgagaactgagtcatccgtgtgcatgcaggggtgggcatgtgtgttcttgcacacctgctcagactaaggcacaagcactcctgcgcaaagcagcttccttctgcatatctgcttgccactctccttgcattgagtccgagtgctgcgggttcaaacagtctggtcttctccttccatccatatttgccttttaatctacaattcttctagaagttaagggcctttgggtggaaggaataatgaggaacgtgcttgataagtttctacataacttgattcacttcacacaaaaattgctagggacacacccagagtcagctgtgtcctcgttgatgagacaaaataattccacagactattaattcacaatagtgaacaaggattaatctactatgcaaatgacagtcggccaacttaaaagttaggacatattttcaggcaatttaaaaaccatggaaccttgagcataaaagcattcagtacttcaagtacagcagtctatagcaaacacagttagcacttaaaattatgatacatattagttaaaagagctgcttgccctacatagtatttggctttcatgcatgttggatttttttttgagaaaatggattttaattcataagtgcaattctgttttcaagtggcatacctgctctgttcacaaatttattttctgaggcttatctgtgcagttaattaaaagcaaacataaacatgcgctcttatctggtttccagatatacttaacagtgaaccacatttgcattcacaggtatcagtagaaaaaaggctactttcatttctcacattttatgtcaaatgattctttttagattagaaagaaccatcccccatcctttattcttaaaaattattcccctccatcgttagtgagaggcagtaatatgcatggaaatctaagactgcgagatactgatttcaaagcattcagaaacacttttattaaccaaaagaagtcttggacattaactttagcggtttttgttatgtttcagtctttgccttttaagtgagtttgcagttttgaagcagatgtttaattttatattggttctacgcatgcttgtggtaatgaaagaaaagagtttgagagaaagagaaagagggagggacagagagagacagcatgagcgagtgagaaagagagagagtacacaaaactaggccaggcgcggtggctcaagcctgtaatcccagcactttgggaggccgaggcaattggatcacttgaggtcaggggttcgagaccagcctggccaacatgataaaaccctgtctctactaaaaatacaaaaaattagccaggcacggtggcaggcacctgtattctcagctagtcaggaggctgaggcaggagaatcacttgaacccaggaggcggaggttgcagtgagctgagattgcaccactgcactctagcctgggcaacaggagcaaaacttggtctcaaaaaaaaaaaaaccaaaaaaaaaagaaactaaattgatttgctcttctttagcagtggggccttagctgctgggtatctgtacccgctagctggagagtgtcgatgccatcctctctacttttgaccttggggcattttctgatctgtgtaatcacttatgcacagccaatcacgtgcatcctttattaaggacacgtatgggtggaggggcatgttaatatgccttactttccatgcctttttcaggagacttcctaaggcttcgttaaattaacaggagatagaaatttgtatttaacatacagttgtagttatgagatgaacatggatcatttaggattttcaagcagtctatcaatttaataattttctgcaaaactgcccttgctattaacttagttattgaagtgtataaacacagatgtgaaatttttttgtcatgtataaacttcacattgagcatggctaggtatttataatttgaatctaatgaaaatgggattgaaaagaaggaaatgatcaggtgatctcagaagggcaactctcccaaaagcaaacactatgtctgattagataagccacatgcttagtgaatggaaaggaatatctctaaaatttgctgatccaaactccaaataccaggatcttactaaaattccctttacctccagggggctccctcaccatctctaggtagctttcctaaagctgcttgccattagggctgcagtgtaatgaaacacaatctgagttgctatggaaacagctatatctatgcaaattaccttttaaaaaatcattaggccacagaaagtctgtcagtcatatgaaatttgcaaggacaacagcccacagctacccttggcattgcttctccccattgactgttgccagtttcttttgctgtatctcttttatacaaagatagtattacccaatccttgggggacatggctagtagtaagagttgcgggtgggaagttgagggcgggaagttgagggcaatcacctgcaattaagagttttgaagccatcgtgggcagtggaaaagctacctagacatggatgggggaagagagaggttgaagttgaggcaaatttacttaaaaccaagtgtctcacatccatccctctcctccaaaaactaagtcactaactttacttgcacacacagacatatatatacaggtgtgcacactcttagatgtgcacacgaaggtgggtgcatgcaaacatacctgtgcaatgtaggcatacccacacagaccagcacatgcaggcatgaacatacatgcccgggtgtgtgcatgcacacactacacacgtacacaccacacacatataccacacacacactacacacacacccacacacacataccccacacacaccacacgcccactcacaccacacacacaccccatccacacacacacaccccatccacacacacaccacacacacactccatccacacacaccccacacataccacacacaccacacacaccccccacacacaccccacacacaccacacatacatcacacacgccacacacacccacacaccacacacatactacacacacaccacacacatactacacagataccacgcacccccccacacacacaccacacacatagcctccacacacaccacacatacacaccacacacatccatgcacacacgccacacataacacacacacacatccacacacacatgccacacatacacacacacaccacacgcattcaccacacacacaccacacagacacacacacagacacacacacacacacatacacacatccacacacacatgccacacataacacacacacacaccacacgcatacaccacacacacaccacacagacacacacacagacacacacacacacatacacacggagcctcctgggtttttggctatcacacagccctccctaccatcctgctctaccagacgcagttccacactggaagcactactatccccgacttctttgtgtatctgttctatacactgggcttggcagaagcttccacagtgcttttagagcttgcagttctctcagctggtcaccatggctccccggggcacagcctgtgtgctctgctggttgtcgccatctcacctgctgcttcccgggcaaagtggccccacatgtgtctaccctgagcccccaggagactgcagctatgaggtagtaggtaagccagagagaaagaatggctcactgccccttgcattacaatttgtactagaatccctgaagagcacttcttataccccaggcattacagaaagagcttttcccaccttagcctctttcccgggaattgagacttgcctctctgttgctgggctaagggcgagtcaaataatggctcccactccagtcattgggtccaccctccccgccactgcaccctgctcctggtacccgctggctggtttgcattcacatcagttccctcctaggagcttttcctgccccaccagtcagcctctgcccagcctgcctaacctgcccaaacacatcccagacctcaagtgcacagacttggttcttccccagaacctccgggcccacatactagtagactctgtcagctccacatcctcaggcaaccgggagtgctcagccctgtctgaactctgaagaggacagagacatcaactcagatgggagccagcatccctgctacatgggaactctttataggagttgccagttggcatcgttaggagtgatgtatttcagtttggttctctaaagagccagatcacattttcactgttttctacgaggtagcaggatctagagtgtgttgctcagctaagccctagggcaaatatggaaaagagatcagtgttacagaccctgtccccagcaggataagtgaggtccttcttcactctacatcctgccttgggggtcagggacatgaacagaggagcccatctgcttgcagggaccatgatgctgagactctacaatatgtgaggcacataagccttgcttgtgctttcagtgtgtgaaacttaaaagtgagttctcaaccaatcgctattatgtttctttctttaaatgctttaaatattaacctaggactctgcttccaaaataacatattacatttaaggccacatgacccttgtattagtctgttttcacactgctataaagaacttcctgagactgggtaatttataaaggaaagaagtttaattaactcacagttccacatggctgagtagtcctcaggaaacttacaatcgtagcggaaggccaaaaggaagcatagtggaggagagagagagagagcgatgcgggggaagtgccccactttaaaaccactggatctcatgagaattcactcactatcacaagaacagcatgggggaaaccaccccccatgatgcagtcacctcccaccaggtccctccctcaacacatggggcttacaattcgagatgagatttgggtggggacccagagcaaaccatatcaaccctgtttttattgctagttacagaattagtgctctagcctcagcgatccctcaatgaaggtcattgctgtgagttatttcttcaatgagcagagcctttagtttattatttccagcaaataaaatgtgtgtcattgttatccccatgttaggttgagaaggaaatattaaaaggttaatgtaataagcaccaaaccaaaagttcttccatgtttacgcagcatcattttggaatacaaatacctgctttctccaagccaattacatatttttttaaatattatataatatccagggttatctattctgagagtcatttaagcctttaataagagggttgaggtgtcaataggtcctcagccctcaaatttactaacttttagaagtggaggtcagaaaatgattttttaaaaccatatctcttataacaaatatatctcctatctcctttgtgaagataactaaaaatggagacattatagaatgtcagggttaggtacagataaatatgtatatttagtccaggcatagtggcttatgcctgtaatcccagcactttgggaggctgaggtgggtggatcatctgaggtcaggagttcgagataaatatgtatatttaaaggcatggttcatattttctgtgataaccttgttttaggaatatagtacagtgctctgttttatgtttttttgttttttgtttttgtttttgtttttttgtttttttgttttttgtgcttttttttgagatggagtctcgctctgtcacccaggctggagtgcagtggtgcaatttcggttcaccgcaacctccatctcctgggttcaagcgattctcctacctcagcctcccgagtagctgagactacagggcacctgccaccacgctggactaattgctctgctgtatctttaagaataaaggcccatgtgatttgccttgaaatgtgtccatccaagagactgtaggcaactgaaattgagaaaagttagtcaagctatgaaaaattatctgctcattgttgaacataccatcttcataattaagaaatagttgtaaaatatatgcactgtcatctcagtggggtaattttaaataagagttttctagctataagctattgtagttccacagtatcataaagatcagtaggacatatgtctttctaagagttaaatttcaatataaggcgaagaatgtattgtatatgtcttcctggtacactaaattgataatcatcattacattctttgccaacttaaaatgattcaatgttgtgagtgccctgagtctaattaattttaacaaaaccatttatataccataaatttccaattatatatatactttttaaagagtaaaattctgctaggctctactgatgtcttacatctcaaatttctcagacctccataaccagcatttgcctcattttgttagcatcatcttccattatgacgcattgttaatcatactcctcctaccaggactcatatcacagattttccattcaagttgtatcatctctgcctctctatcacctacattaacctataagctccttaagagtaggggaagtttcatagtcatgattgtttccatgatgttcaacccagcatatcataggagttcaataaatccctcttggactaatttggtggaaactatattccaattttccccacattgagctgcattcccaggcttcaagagtattcctcaactaataaccactgttgtgttctccttttaacctactgagaaaaaggcttaggtcagtagcagacttattggtattcactgatgctcatccatctttgatttcatagtaagacttgcttaatgtgtgagtcatcatgggtgacagtatgttaacacatctataaagaatacttgaacactattgcaggaatagaaatgggcattgagagatcccatttctatcctaaacaatataaaaccagcttgaatcctaagccaactttgtgtcttcttcaagtcttccttttctatttctttgccttcgccaacaccactgccagaatatcagtagctaccaggaaccaacaagtatcatcttatatacattcctctggtataaacaacttgctatagtatttaaattaattgatgcatgttttcttgcgatggaattgaggatactttttatctgatgatatgattttatcatcacaaatcataattcacctaaggaaataaatggcacttctatctaattattgccataaagaacaacttaatatcaaaatgacaaaggttgtttttgcaatatattattcagaatttagatggatgatataaatttccatctaacttgatccatgtagtttaatgagagcattttgtagatctaattatctgtgaacaagaccaaaaaaaagttcctcaaaatttcacttcctttaaatatttttttagtctccaggaggtgataggtaaaagcttctcttaataacttataatacatatattttatacatatattttgattaatttttctatattaaaaaattctggaatcacaaataaggagtgccttagagtcttgtataggccaataattttttagctgttttttgtcctttctttctgtctaagaacaatgggtgtcctgactatagacagtgttaggtatcaccatgttgtagatacatagtaagaaactgaaaaccaaatgccttgaattttataattgaatatcaattttcctatctagacacctagaaacaaaagcaccaggatttcccctgagggtaaaacacagaatgtctaaacctcactctcttcttggggccttaccatcaacttatatagtccctgctgagaacctgagtgcattggaaattgttgacgtgaaataagggatgtaatactcatgcatctttgcaggaatttataaactccatctgttcataacattcaatcacaagattatgtacctggacctcattagctcagctcccagaagagaggtcatattttaatgttattactcttactcttattaagagtttatgtaagaaacttatatgaaaaacaagtcagcaaatcctacaaacttggacttttagatgctgttatgtcatttgttgctaaatctgtggaggatgggacaaacagatggttgttgagtagggcagtgccatgaatccctcctgcagggtaggaacattaatctgagagcaatgacatgatagattggaataaatagccagttgagataaacagagggggtgagcacagtcaggttatggttggatttttagctagaaattatgaatcagtcatgacagtagagcccaattcagattttgctggatcttgagttcccattattgcaagttaggataaggaaaccagtcttcacagagtaaggtggtttggagaaagaggtagaagctactagatagttcaataggatctcactccatgaaggaattcatcttgttttcaactgtatcagtgcttacattctcaacctccaaacacagtaaaatggataaacttggtaaagtgaatgactagagctttgcatccttagactagcaacagagacaagagtttgccatggaaacagtgtgtgaatattaatgtccattgtcaacaatgaacatgtcggtggctacatgtttccaaagcctttttacaccttgtgtttataatcgtcaaagcttgctctcaccaagacagaagatgggggaatcatgtcagtgggaaacagcaaaaataaatgtcccctgaatttttaaatagaggattcactgtagaaaacaaatgaattaaatgataccatgaaaagagaaatacaggtgtcaatagactaagggtcacaaaaatgataagaagaaggaaaaataatgatattgggcatcagtactagttctgataacttctcagttctttagcgtctctacagctctgcaacttttagtagcttaacttatgtgttcattcccatgcatgacccaactgggaaataaaataacaaaagaaatgaattggcatttcaaaaaacaacatgcaaccagctactacactcataagaagaaggttaattaaaaggaatgcgcatgggaaggagatgccatgtctgctagtagatctccaaagatgagaatgattgctggcacccagggttgctgaggggcagcaacacacactattgggtgacagtgtcaagagggtgatctttctggagagcattttggcaatatacctcagtatttaaagtgtgtagactctacccagcgatccaagttttaggaattcatattgagagactattaagaagcatctttagagcagatgagttaatatatggaaagcatttcaaacactctagtacatagtaagagccaatgtcagcaaaaaaaaataaataaataaaaaaagaaagaaacaacttaaatgtccatcaatacacaatcagataaaaatggaccatcaaatagagcattaccaggcattaaaaattaagatgtggctagatgttgatatcaaaatatatccgtaacatgtgttgaatgcaaaagtcaagttaacgaacagcgtgcgtgctgggattctatttctgtaaagtgacatgtgagtatatgataagaatagagcgataaacaagagcttgtctcccaaatctcattatcgctgggtgattttattcttactttattctttatccctttttaataggctgaagattttaatattaccatgtgtattttataatcatagaaaataatactattatgttcttctagaaaacttgagaatatataccaaaaacatgcactttttctgaacctaagatttgataaagattaattataatataaaatggaatttattttataccatatatatccatacagagaaattactatgtaaaaaaaaatagaagcaatctaaaatttggtttgaaatacacaagcatagaaattccaaagttttggtatcacaactcaggaaagtcaccttccattctcaggaaacaatgtagctttatactaacctaagggttagttaatagataaatgcattacctgtgttcagcatattcaataatatcttgaaaagccagtttatcagttttgtaattttacctcaaggagtagtgctgaatgtcacatagcatttaaataagcaagattgtcactttttctaaattgttttctgaaaatcctattacactttacattccaatcataatagaggctgcaccgttctgcgtgctttgccacgctctgctgatgttgctcctgccttgactcaggaaattcctaaaataagtgatttttatcccctcttgtgacgtgctctgcgtataatcactgaatacgtgccataatgatcaactggctaacgcatttttatttgtcctcaatcaaccctctgatagtcctgaaacagatgcttttaaatgggaactgcggctcagtattttttacaaatatgcacaataaaagagaaacagtttcaaattacttgtgatatttaaaaaaaaaataagtcagcaactaacagaagaaggtttccactgacattcaagagtagcaaaccatcccaagattaacagtttgtgcaactacatttttttacactgctttttcttctttataccaaattaccttcaccaccagactcttcaatgcaagaccagccctgggctgctggttcttaatttgaaccctttatttctttacttctgtgacttcatccagtcccttggctttaaataccatttaaatgctgaaggctctacatttctacctttgtgcagcactcaactcatgcacccagctgcctcttgatagtgatgtctgattggaatctcaaacgttaacacatcccaaactggagcccacaacttcctgccaggcctctccctcctccagtgttcctcacctctgtgctcaaggccagaacgtctccatctccctgcacccccacatccagccgagctgccagccagccagtgttacgtctgaattacgtctcagacttgaccacgtccatctctgctggccatttctcccttagggttctgaagtggcctcctaccttgcctgcccacttcttttcaccacacttcagcctgttctctgctgcatgcctccagaatggtgtttaaaaaccaaccatccttttggggtgacagaaatgtttgggaagtaggtagaggtaatggctgcacatcgctgtgaatgcactaaacaaccctgaattgtgcatgttaaagctattaactgtatgttatgggaatttcatcttaagttttaataaaagatttttcaaagcctaaccttatagctccaattgggaatttatcttgtactttgttatttaatgctattgatccaccaagaaggaatgaaacattataaaacaaacacaaaaacccaattatgacagttacctgcttaatggtatccctcccactgcacttggtggataaaattgaaacttcttatagtggcctctgaggtcctttttagaaagtgccccctgcacatcagctctcatcaaggtttccacaggacatgaaaagaacactcagctgggattctctacagaatccaatgcagggactcttccgaggagtcgacagggttagtatactgatctagagggtggtcagcagcgggaagcagtggaagcaaacacagtctccagaacttgggaaaattgggagccgtgaagagaggctgctctagccacaaggcttcccagccctaggggcacagcagaggagtgggcataacattccccagctctctctcctcctgccctctgactgcctacttattcttccattagctgaaccctgtggttggctgcaagccagagggcacgggtacccgggaagttcggcatgtgggcaaagttgacattttttatgacaatgtgagtcctgactgtatacagtgccagacattacagtgttgtatatatggagctggtaggaagctgaaaattaaatgccttgaatttgatcattgaacatcagtttcgccatccagacactaaaaaacaaaagcacagtgatttcccttaggtccaaaacatacaatacctatgtcccactctcttcctggagtcctcacttccactgtatagtccttgctggaaacctagctgtgtgcacagggagtgaattcagtgtccatcataccttctccaacactctctctccatgcagaccttccttttatttccaaggaggacgttctctctgcctaattgatattatgagttttgtgacatcctgttcttggtagtgccaggaagctccacgctgcatcttctcttaacgtcaacctttgttatttcctccccattggcgctctccatccttaaccacataccacatgtgtttgctttcttgttttatcctctatcacccactgaagctccttgaggcttgagaccacttctttcattttcctatcattgtcttcccagctctgcagaggaactgaaccaaaattgctgaatgtttgtgagattgaattctttagtggtttgcttgccctaaggcttgaaacagttctggacccaaagaagattttgtcaactgaaaggatggataatgagacaaatgaacaaataaataaatgaatgaagttgttcagtcatgattaggctaaagtatgaagatctcacatatgaaactcagtagtcactttcccatagtcataacttagagttttttttcctgtttctcaggaggaagctgatgttggtgaagtcagttaaagtcaccaggactaagataaaataactcccagccccagtggtccctcactctggctactttttaaaaaaaattcttaggtagcaggacccaccccagatcactttccagattttccagaggtgaagctagtgcatcggtatctttcttaatgccccccaggtggatcacatgagaaatattatggcgcgaaagtaattgccatttttgtcattgtttttaattacttttgcaccgacctaatactattctagtgtaagaccacaattgtccgaatgtaagtataattttgttgttgaacttttttactcaattaatattttaggtggcatctactctacaattaggcccacggtctttaggattgttatccatcaccctttcttatctgtaagcctttgctcactttttcttgatacctgaatgttttctctcattctggctaattctgctcgttcttcaggggccagtgaagacctccctctcccatagaaccttccgtgatgccctcccatggtgacttttcactgtcagaattttcatgacacaccacctctgacagttgatggactttagcatctacaactctataaaatgtgttttatttttccctgggcaagtgtaatttggtctccccaagtggactcttactaatttactgcgtattccttagagtacctagcaatgtcttgtctcaacaggcattcacaaaatacctgctgaaaaaccaaaaggaagaagagaatatgtttggaggaaaatatgcagtaataaatgttcacattcagaattatagaaatgaaactcagaaatataaatttgagcatgatcagcagaaattaaagatgagtgttaatattattatccagtgatagcatattttccatgaaaaataatctcttattagaatgtctgtaagaaacaatataattggaagtgtgagagcctgtgtttataccccagctctctctctcattcattacctgtccatgggagatttctgtaaccactttagcctttggtttccttcacagatcagtacccctcttctaaggttgtggtcaggatttaattaaatagtgcatgtgacatggtaatgtctcaggaaatgagggctcatgatcatcagtgacattattatgatagagcaacagtatctgatatagtttggctctgtccccacccaaatctcttcttgaattgtagctcccagaatccccacatgtcatgggagggaccccatgggaggtaattgaatcgtgggagcaggtttttcccatactgttctcatgatagtgaataagtctcccaagagctgatggttttataaagggcagttcccctgcacgtgattctcttgcctgccaccatgttatacgaccctttgctcctccttcgtcttctcccatggttgtgaggcctcctcagccacgtggaattgtaagtccattaaatctctgtttctttataaattacccagtctcaggtatttcttcatagcagtatgaaaatggactaatacagtatcagacaattttgatgtaactgaaaaaaagatctagtcatgaaattagtgtggtgaatagatgaacaattgggttttttgattaccccaaatctcaatctgatgtttcttccatgcttcccacagaaggttgtagctgtgtgtgtgtgtatgtgtgtgtgtatgtgtgtgtatgtgtgttttagtagaggtcggcagaattaaatgcttgcaagaaaaattagttgtaaaagtagtttcaaagctgaaagttctttttaattaactatggttaatcattacacaacgtgtatatacttcaaaatatcatgttgtatgaagatacatacatacaattgtatctgtcagttaaaaacatataaaactgaatgttcttccttctgtgaactcaaatgccttctttaaatttctcaagctacattacctgggcgaaaagggaactggcaaaagatgaaaagcagaacattctcttgtgttcatatattctgcttgaaaggatagcacgccacatctcttccctccaattcaaatagcaaatttatgtgtctgacgtttgtctgattgttcatatgcatcacagtcagactcttatctgaccttcattttccccaaaagttgaatgactttgacaggtaactcaacttttctgtgtctcagtttcctcatctgtaaaatggacttggttgaaggtttacacaagttaatacatgcaggtgattaacaaaaatcctagtgcatgacaagaactcaaagatgttagatattttcggctacaatttgtgttgtgtttttttcaatgtggtcttgttttggacatgtagttcagtgatgctctgtgaaaaagctgttgctctttttactctgccaccatatcttcatcaaggttgctttgcttttctttgaaagccgtagaacccaagatgctctttaaagtggccccagtgcataacagggtctccaatccggggactcttggataagcaagcgtccacgaattcaattagcgcgcttatgttgacatcaacaggacctatgaggtagatgtgctacctatattataaaaaaagaaaccccaaggcaatagccgtctctatctttgtaagaggttatatatgcatgctcactcgagacccagagagtttggaatggcagctaggggccttgccaagatgtgtgctggctgtgtaacttctgggttatagtacttaatggaactgtaaacagctcaataccctttgttccatgcatagagataaggtgatgaatttatggataatggatcccctgaatattcaagaatttgccagactctattttttaccaaagatgacattagccatccacccattttcagtaatttatatggtttgtcagctgtcagctccccaaagactaccataaaaacccattgatcagcaaagctgggtttgttagacatactgcagtaagtatcctccctcactgcagtggatctaaaatgctcccttgaaagagtcttagtgtcaaaagggaaaatgaaggcagggtatttataaggctgtaggtccttggctgggagattttaaggtgggtattgcaaggtggggaaccatggggattgggcagagttttaactagtagcacagtgaggggagggtcttgaaatgggtcatgatgagcaaactattactcttgataagccagctctctagttcacagcctaaacattcacaggcgagtgtttcctagagcaagcacttaaattatttttgatcagtctcagcatggtctaacacagggataggaaaatgtatctgtcccagtatcgtttaacccagggccaaaaattatggtgatttcacctcctgcatttacttttttttaatcagatagtgggggtattttgtctttaaatctctctctctctctctttcactttctctctctcctcttcctcattatgctatttattgaaaagtcaaacttaagttactttatttaatgtatgtaattcagggcacaaaactaccaagaaacacaacaaagtataagaaatcattttacacatagaagaatatgacagctgtcagataaaagagtatagtctttaactgtcataacttttaggaaaaaagttccaggaccactttccagagattatacaactcagccttggtgctttggtgacattttttcaaagttcttgcacacccaaggtcattgaggaaggctatagttctaagcaagcctaattttgtattcctaactgttgatctcttggggcctgagaaatatgaaattctatggttcatttataaaatgctgtgatcaaagatgaacccatgacttttacagatggccactaccaaacactgacatacaaattattttcaattataattacttaaaaaaactactgtgtgaagagctttctacttcttgtagtagctgcattgccagttgcagataggcatccagtttgggacaggcatcattttccattaatagagcctgatctgttgtgcctttttggtaaacatctaatagaagaattctaaagaaactaggatatgtatactccattttagaatgaaaagagagatcatagatacatctgagttttgattttcatttttaaaaaaatcagtcaattatagtcttttgtctgtaatattaactgattttaaataaaattaattcaggctctgaaaacaaaagtgaaggttattttttaaactaatcaaaaatttaggtgagggtcaggcatagtggctcctgcctgtaatcccagcactttgggaggctgaggcggcaggatcacttgagtccaggaattctagacctggctgaacaacatagtaagaccttgtctctaccaaaaaaaaaaaaaaaaagtcaggtatggtagcacgtgcatgaagtcctagctactcaagtggcggaggtgggaggatcacttgggctcaggaggttgaggctacagtgagccatgtgagccatgatcacgccgctgcactctaacctgggcaacagagtgagactctgtctgaaaaaaaaaaaaaaaaagtgaatatgacttctggcttcttgccatctaaatgtttatcatcttgatctaaacttttaatgtttgctgctggtactgaaatttgaacatcagaatgttgctgggatcagttttggcttcgaacaagacagtaccttagtattgatggctgtatcttataacaaaattgttttagaatctgcagatttaaaacattgcatggagacccaggtaaatttagtcagtttaagccagaatttgccttgtatgcaacagcaaagatctgaattactttcaaatgtcaaggacaactcattcttcatccattctggggctaaataaattttgtatgtattttgaaaatgagcaagaataattctacctaattctcaatatttgtgcctaagtgattctgtttaaaaaattctgtatttggacctgaagcgttatgtggcaactgtagaatgagagtttacggtgttatggaccatggcactccaattctctctcttcacctcccacgcctatcagcctcagaggccctttcttcccattgccggctctctgagactcagcctagaatgatgattcagcctgttgaaattctaaaagaatcgacctttgtgtaatccccactgcaaaggcaacagcaggttcctcttctggaatattaaagaggaaaacgtagaggtcatttgttgtggccaaccaacccctgggactcctacaagaagccttggcctaaggagctgttattacagcaacatttggtaaactctatctaacatcgactcaagataaacgctttaattttttaaaagcattcagtgagtgtggtataggaatgttttccatctagaaggactctcaaaatgatctccattagcagccactccagagggttattgcttctcggggccatattgagagtttatatgcatccaaatactcgtttgtatagcagatgcacacacacaatagtataacaggacttcagggcgtcctgggcctctatattttaatcattcaacctccacacactagggactcaaagtgtgaatgggtgtgggtggaggaggtagtggtgacagcccctttatacccctccccctcccactcccaccatcaaccaagcctaactctggtttttttaaaaaatgaactttttttggccgggcgtggtggcgggcctgtaatcccagcactttgggaggccaaagcgggtggatcatgaggtcaggagatcgagaccatcctggctaagatggtgaaaccccgtctctactaaaaatacaaaaaatttagccgggcgtggtggtgcacgcctgtagtcccagctacttgggaggctggggcaggagaatgacgtgaatccaggaggcagagcttgcagtgagccgagatcacaccactgcactccagcctgggtgacagagcaagactccatctcaaaaaaaaaaaaaaaaagaacttttttgtccccattcttctcctttttcctccccctccccccaggtacacaaactgtcactcccaaaagaaatgacaaatttgtttaaaataaatcctcataaatacactaagtagatgccttaattcactaattaattgtaaatacatttttataaacatttatttaaaatgaatgaagcccagctttcctttgggcttggtttgagcctcacccacatgagaggattcatgctacgtctaaagagctgaaagcaagccagtgggctgtcgtaaagtcctgcatagccaccaggcagtgtttgattctaccatcatttaaaacttgcttttattaaaacattctttttgttcatctggggtttttttaaccaagatagtcttcatctctttcagtaaaaagaaactacaattaccctgtattaaagcattataaagaagcaaatgaaagtaattaaggttttattaaggaatttttattaaaccaatcattgctcatgaatatggataatatcaaggaaaagagccattctgtgcctgaaataaaaataaactatatttttaaatatctttagtatacgtaaatgtcttcgcaattaaactttcaaaattatatttggaacagcaataattttacactgataaaggaaagctattggatggaaataataaaagaaagatgctaataaaacaaatttgtcacagattataatctggaaggaattagcatattttcatcagggaaatttaaattttctagtgaccatcaaccaaaatattaaaccatttttcatgttatcctcagatataaacaaacagggtaatttgttatgaatgctgaaaattggtgtgaatcccatcagttttatagtttttcctcagattgaaattttagtattacctgggctaatttagaattatcagggagttaatataagaaaattacccaaatgaagcaccagagataagccttttaatacaaagcagattaatatgtttcagtgctataaatttttctctactagctaaaaatggaatttctgtagattcaaagtaaataatcccacttaaataacatttttctattcttgtttggatttattatttgtgaaattacatcttgcagctgctgttttattttctctaggcatgacgtcattttgctaacgctataatacttacagaagtttcgatgcttacagcacatggcatcctataagatcataccatccagctgttattttttatttttctttagtgcttgtttggttcatgtttgtcagggcatattctgtatgccagggattctgtagctctgtgttctgcatacgatgggcattcagacaagtgtctgctttcattttatgcctgggaccctgttggaggatggaacagtgatcaaatgacagaatgagttagtgttgaggtttctgctgaaattaaataggagatctgacagcaagcatctgggaaggtagactagactgatccaggaaagcctctctgagtttagcacatttaagttgacgtgaatggaagaagtattggccatgaaaagatctaggaaacaatgttccagaatgaggcagcagcaagtccagggatctgcgacacaaaggagcttgtgtgttcaagaagaaacaggccattttggctggagcacagtgactagagctatatggtacctggcccaccagcacagggattttttgttttcttcactgatgtctccactccacgtcaaacagaaccatgcatgtactaggtccttaatattatggaatggataaatgaatgaatgaatgtgatcaagatgaatttagagatttagagaaaggcctgatcatgaggctaccataggaagtttaattttattttaagcataacaggttatttttgaagggatacgtagtagactgaataatgtccctaccctgcaaaaaaagcccaccccctaatttccagagcctgtaaatgttacttttcatgatgaaagggactttgcaggtatgactaaggtaggagggcttcaaatggggagattatcctggattatccaggtgggctcaatgtgatcagagtgcccttatgagagggaggtaggagggtcagagtccaggaaggagatatgatgatggaagccaaaatcagagggatgtaagatctcaagccaaggaatgcgatgcaggcagcccccaggaggttgacaagatgaggaaacacatcttccccgggatcctctggaaggagccagccttgccagcccatttcagactccagccctccaaacacaaacctataaatttgtgtttttcaagcccctgtgtggtgatttgttaaggcagcagttggaaataagagcaggattattccaaattaaagaaagtgttgggtcacttattgaattgcaaacgtgaagaatgatacatatttttaaattaaatacttgtcacttaaaatgcattttaaatttagttacaaagtgtagctggatcatccttgctatatcttgtatactctcacattggaatttggaaggaataagggaacaagtggatttaggtaagagaggagtaagaattaaagtgtcctgggaaggcgagagggaaaaatgagtccatccattgtagaaaggcaaagggataggaaagtgaagcagagagaagaaagcaacagagagagtgggagcttcataggaaaggaaaggtatattgtctattgctgcataacaaattactccacaatttagcagcttaaaacaaccaacatttatgtcacccactgtctaagtgtgagggagtacaagtaggagccacagatttgggtggtcctggctcagggtctgtcatgaggctgcagtcattcgaaggcttggttggggttggaaaatccacttccaaaatttcggctgaaagccctagttcgttgccatgctggtctctctataaggctgcctgaggatcctcatgatggcatgacaattggcttcccctcaaataacaatctgagagagggtttggagggagccacaaagcctttttaatgacatagtctcaagtcacagtcacttccaccatgtttcattggtcacaaatgagtcactaaatcaaatccccactcatggagagaagaattaggctccaccatttgaaggaaatgtccaagaatttgtggacatattttaaaccactatggaaaaggggagggaggagtgaagtaaaagtttgaggaaaaaatttattttccatttgttcagaggatgcctagatacgtccagttctctccactaatctctcttccgtcagtcaagacatgtgtgtgtgtgtgtctgtatgtgtgtgtgtgtgtgtgtgtgtgtgtgtagcaggaaagatgtggaattcccagttgtttcccacttgaactcctgccagatgatataaatcttcatctcagttgtctccagaaactgctgcttctatgcttaaacctgtctcatgtccaggtaatctaaccaaaactcaaaattttgacgaccccatgcagctggtttgctgaattccccctcaagaaaatctgccgcgttccatccactttaccaagacttcatcaagaggtgataaagttgcttgatagagattcattgcagttgtaataagtccaggaagcattgtgcattgcagttataaattgagatagatggttcagagatatggatcaagtactgtgatcagttcactggaatgtgactcgcagatggagacagcctggaagggtggaatgaatgtgagcttctgtttgttcgtgattctgaattaggttacactaattaactaattaaggaaaagtgaaggagatagaacagcctataaaaagatattccagactgcatctgcctttccattctttcacttcttgtcaggtactagatttggcctttaggttttctttgatttccttcctccctttccctatttcttttctgtttgtaagaaaacagtaaaaatagctgtattctcatagaaagccttgagattttcatactcactgcatgtaaaaaaatgcaaaggtttctctctgctattttgtttgtttgtttgcttgcttgctttcccgagatggaaccttgctctgtcacccaggctggagtacagtggcacgatctcagctcactgcaacccccccccactcccaggttcaagcaattctcctgccccagactcccaagtagctgggattataagcacacgccaccacacccagctactttttgtatttttagtagagatggggttttgccatgttgcccaggctggtctcgagctcctgacctcgtgatccacctgcctcagcctcccaaagtgctgatattacaggtgtgagccattgcaccctgcctgctatttagtttttaaaggatatataccatacagcaaaatatgtcacccatattttaaaacatttataagcctcaatttttagatattggtattttgagtctggatttgggaatgaaaaaaatgcacattttgttcctatattttcgcattgtatactttgaagagcagacacaaatgtcttaacatggtattcctgaaagttatcctcaaatactggggtagatactaatttctttttaatatactatttaaaactgcaaaatcaattattttactctaaaaattaacatttttgtgaggctggaaatgaatgaagtcattttgattatttagattaccaaactttggcaaaacatttctcaatggatgaataagcagctttgtgttttatttaaaacaagatagatgcatatgttaatattcctagtatttcaaatcagtccaaatcagaatatattctgagcaccttctgtgtaccattgagcactttttgtgtactcaatttaggatactaatggcaatacaagcacaaatgaaagtgtatataaaatggtcaaattcactaaagcacagttggacaaaatttttctgtaaggggacagtttgtaaattgtttatggtttgtgggctgtacagtctctgtcactaatacccagctattccttcataggacaaaagcagatgtaaaaaatttagaaatgaaccgacatggctgtgcttcaataaaactttattcataaaagaagagaagctagatttgccttcaggttaaccccctgtactgaaggattattttatgcatgctgggcactaaaaacattttgtttcctttgcattcacttcaataaaatttccagtaaatggtatttctaaagacagttgagtttgcctctgtagtcacatttttattgaactttatagttgctttatttttatagtcacttatttagttattaacagtcagatttgtattattaatgtccttggatagttcaacatgtgcaacgcaaggaaccaataaaacaaattttggaaataaacatgttctgtttgttctattcataacacagtagatggaacaaaatcgcatttcgttaaaatatatcgaaagctcattaaaaacataagctacaagttctatttccaaagacaactatagtgttttatttccaatatctgcagtgatggtacgtgtttaggttcagggtgtatacaggctttctttcaaagaaaaatagaatgttattctctgttcctttttttctttatgtagactgtcctaacaaaaaaagaataattatttaaaagcattttcaaatgatgttataatatatatgcaatgtttatgaccttttctagaacatctccttttaaaaaatatttaaaagcctaaagcattctatttgtcgttaacattttgcattgctctgcctgcatgaattactgtgacgctctgtccattgtggacatgccctcttcttctcacctctccctttgtcattatttaaggaggaacattctgtaggtcctccatgagcattgctttcagagaaaagctgacaaaacagtcacaaggggcaacagtttaaattgcttgttgagccagttgtcatctgacctgatgctggattctcataagggtcctacccatggtagctggttgtttatgaaagcacttagctttcatggcaaccacatgtgcacactgaggtcttgggtaagacaaagatgctctactagtccatttcaaataactttcacatctctttggtcttggttagaatttagcaatttgggtccattgtattaaaatggaacagaagcgttgttggtagcctcagttcaatcagacctcgcaaccttgattatgctccctgaggaaataaagataatcatgtcacagttcctctgctcactcatcagatttttcacagaatgcttttaatgggttcacacgaatgttctaaaattaaggacacactctaggatgtgtgtccacagtattttcatccttcctgccagttccgttaactcaaataaggaagacagttttggagatgagaaaaacttgtggccacccaaaacctctttttgtgtgtctcttgcaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggtcagtcctgtgtcacgagtgcctcctcccaccatcttcccctggccagacactgtctctttccataactttagtggctcttttactgaggatcagaccattctgaaaacatgaatgttgatgtggcaacggagtataagaagttaattttaaattttctaaccaggtaataaagacatataggtatctttctctacctaattaatgttagacttacttcacatgatttcttaggtctaaggtgaaaaacaaacatttttattccaacccaaaataagtcattttctttggccgaaaacaatagttcttggtaatttcacattatatcatgcatatagcacaaccaggcaggctgactggttgggcagagttcataacagatacatagggatctggttaactgtcacaagtagccattttttaaaaattctcattttaaaaattctctgtttgactgtaagattctataattcttagaaatagctctttaataaggcctgttgtattaaatggttttttaaataatgaaagtagcaaatgtcttgtgattctctcctgatgcgtttttcacaaaaatcatcaggaatctattgagatttcttagaatcaactttatgtcttgtttaatttttgctcttaggaaggaaagtagttaccaagatatgattcttctaaactctagaaactgtgctcccaaaagtgttgtattttgtaccaaagttgcaaatctctgctggatgaaattgctgggataggggcaaaaggggtgattgaaaacacctagccaaataatctatattttgaaagtgaaacatacaggattgttttagttgaaatggttcaaagctgccatttctcctacagttgatcagtttctaggtataacaaccagtctctactgagaaggaacaaaatccacctcagtggcattaataatcgtcatctcatgagtattcatcccaatgctctcagcctccagtcttgagaggcggtatgtgtttgtgtgaaatgtgtgtgcacagagcaagataagagcctgcctccacgaatatctacatgcgttcatgggcaggaatgggaatcctctgacaattctgcttttcgtctgagtcacgaaatcatgaacatctgacgtgatttctctggataggtgctaccatatggcaaatatacagtactctgaaaccccctactgaggcatccatttcataaccccttaaattctgttatccttgggcaaacatctgtcccaccagaagaaatataactcctccaaagctaaaattgtaggctcttctgaactcccatgcctgatttttttctatttcacttattcacaactatttaaaagtgtttttcccttgctagcattccctactttcacagtgtcagggtccctagtgaagactgcagaaggaactgtctcagaagcaattgtagaagtgtaatcaataaggacctggctagctctgtctgttaaaatgctctctgattaatatagtagcataagtatgtcttcgtggtgtttgaaaggatataggctaccacctttattaaagtacatttgacatcctttgatgaaaaagtagatgaagaagctagaccagtgtaggctcacgggtcccctttacacatcatctggctaagtttagggtctgggttgtgttgctggagcacagtttggtgagaccagaatgactccccatccctgtctattcacacatacagcagctcgacacttgctgctgcttctgctgctggccaggagtgaccacataataggaagcaaaaaatgatgccatttgattcagtttgtcatgcagacatctgtgacaccagaacagtcacagtcgtccatatcatgacagaaggctttagattttagtatgcaagtgtatttacattcttcatttttccaacaaagccaagatcactattcacattaaagaaatgacttcctgtgctgcttctgctatgcagcagttttatcccaggagcatttgctgaccacctgctttgtgttggggagggctaaggaggctgagagagggcagactctgccctgcagaaactcatgactgagtggaagaaatggcactcagccggtgagccccagcacaacagcctagtggcaatttagtgttatgatcatggcagtacaggaggaaaaactggtgagaaagtgactgacagctaggtgtggccaaaaaaggcttgaagagtcaggtgagattgggctaaacatagaaatgatgcaatgggaaagcatcatggagggcagcagaggccagcactcgctacccagcgttgaaaggactctagaggagtttgagatgcaccatcaatagagattagatttttaaataaaattaaagtaagtgttattattcataaaatctctgtcttccaggggcctgaaagttccacttcagatatgttgttgattctcacatgcatcgtagcccaatgagctcatgtgtagttaagtcgtgaagccaggacttgagccacatcctgactctggtttcagaccatccccaccctatcacacagagaggaaattcaaagttatgggataggagactgctaacagatctgtgcttaaaacaatacacaaccaccacctgctgacggggcaacactttcctctctgttggttccttaaatttgcttccagagataaacggagtggcatccatgtggccaacatcatttggcttttaaatgccagtggtcttctccctctcccttctttcttacttcaaattcttccctgctaggacctacggagtgtgtagctacctgggacagcattagccactcagccaagtgcaagtctcttgacctccacctttgatgttcatgtagacaactagaactgtgggtgcctttttgtgttttaaaataagactatattttaaggcatattttagataataatgttgacattgtttttccagtactcctttcttcttttgccaatgactttaagatgagttgatatttttggtttgcttctgtagctattgtttcaggaatatataaagaaaataaaacatccaagaaaataaaactcttttcctagaatactatttcctaaactagtatagcttggaaatccagcagaaggagcatgtggtaggtaaaagtaaattcatctggtcattattgaaaatcattactcttgatttttcttcctagcaggattcagacttgtttatgtgatttcagggtggggagccaaggttaagaatttaaggaattagtgtttttaaagaggtcaccttttcattttttggaaaaaaataatctatgaatgcaaattatattgctcttaaatgtccaaaagcttattagagataaatttaagtcagtaaaatctgcctaaggcttagccagaacctgacaatgtgacactattctgtctttagacaatttcatgcaggcttaataggctctgtccagtttctcaagctttcctctaggcagtggatattgtaccaatatcagtggctgtccccacttcatgccctaacgccaccccattccctaccacctccaggtcgtagactactgaaggaggcacatttacagggagcattctaaagagaggagacacttgctttgccttctctagaaaggaatggagaatcttcatgggaagctatatcatgttgacatagcaaaaatttaagcacatatgaaatgtaaaatgaaaagttaatgcccttagtcctttttcgtttgaaattcatttggggacaagaaattgaatttttaaaaagcagatctatctttgtgttcctggagtatctgtctgtcactgaggaaaaaggatagaagtggggaaaaaaaagccttaaattttgttggaggcctgagttgataaggatgatggcagctagattgtgagaggccaagcggcatggggaggtggggttgcgggggttagagctgtgggtgatcagaagggaagggcttcatttctacgctctgcctccgctacctcttccccaccacccctaatcccaggcacactaatgctcccttcttcatttcttcccctttgctagttgttccttttgctccaattctgccagattcaagcatccatttttaacaaaaaacattttaaaatatggccccaaacaaatgtggcaaaatgttggagaggcttaggatgtaagaataaatgaggttattttgttagtcttctctgttttgttttatgatgaaggagtcctccagggaaatgaatttcatatagagtgaggttcagaccttgaaatcaattcagttttgcactcattgttgtttccttgcacatcgtgtgatcaaatccatctcttaacctgtggccgctataatcatcaccttcaaccaaaaacatgtgttgagggaccatggtctgaacgctaaccagggaacattgagctggctccgctctctctggacaagctcatgttggctgaagtcactgcggtgtgttgaataaatcttcccccaaaattcttgtctacccagaacttcagaatgtgatcttatttggaaataaggtctttgcagatacaattagttcatgaagatcaggtcatactaggtaagagtgggccctaaatccaatgaatggcatcttataaaaagaggacatatgcacagagagacacacagggaagaaggccttgtgaagacaaaggcagagattggagtgttgcagccacaattcagggataactaagaattgctgcaacaccagcagctaggaagaggcagggaaggaattttcccaagagccttcagagagagcacggccctgctggcaccttgattttagatttctggcgtccagaacgtgagataataagtttcggttgttttaagccacccagtttgtggtactcggttctgacagccctgggaatctattatggtcactccagtaagaaaataagagaggggctgctaagctaggaagccaaggagccgcctgaggatgcagcactgagaagaggaggagatagacaactcagagatgctgcctgtccccaaacagtgcccacacactcaacaaacaacccagatcaaaggtgtttttctgtttttctctgtgcacaaggccattcccctctgtagcttagctacaaaaccaaacactacctgtagcaggattgagttctacaagtcaagatgtggctgtctcggccaaagaaggttcatatccaacctcttgactggatggccatgaaatgagggtctccccacacacggatctgatttctgtgtgttctgctcttatttatgagccaacctttccttttcctcccgacattgaactagcttctgaacattgcatggatttttctgacactatggacagccagaagtcatttgaggttcttacgcaggggatgtgacaccatatcagtgtcatttaaggatgtcgactctagcagctgtgtacagacctgatgctttgtggattttctgtgaaacatgactgcatttcccatttaaaatatcaccgatgcatatcctaaagatcccgctgtggctgttatcatcatttcagggtgaactatgggtagaagcttgcagagcatacttttttaccttttaatctagcagctagctcaataaaacaactgtgatctgcactcctgtatagtcgcattatatttagtcatggatacttaggactttatctccagctgaagtatgtgcataaggctggctggctaacttccacagctcatttcccggtgccgctgagtcgtttatttatttttattattctattcccacttcagtatcttgtcctaaaggacaacaatatacaaccctaattttttccatctatctttgtgtacataagaatgttattaagcccgtcaaagtatctgcactgtgcctttgcttacgattgtaattaaactcagaccctcaattagtcattttaacccataaaatggatgagtgcttggtcccacggtgcctctaattctagagtgaccttgagaaacgccccttcacaaagtaatgttaatgataatcacactctggctacaaagctccaaggacgtttattttctgtggcttactcttgcattagccacaggtaagaagaggaattattattatttttatgttaagttcagttgtctgccaatattattcatctgttaaaaagaatctttttgagaaagtgtttttaaagtgttgtatcatgagccccaaactagctcatcccagtcttggccagagatgaggggcatgtgtcagctgaattcagcaccctttttttttattcttttgagatggagtcttgctctgttgcccaggctagagtgcagtggcatgatctcggctcactgcaacctctgcctcctgggttcaagcgattctcctgcctcagcctcccgagtgcctgggactacatacataccaccacacccagctaatttttgtatttttagtagagatggggtttcaccgtgttggccaggctagtcctgaactcctgacctcaagtgatcctcccgcctcaacctcccaaagtgctgggattacaggaatgagccaatgcacccagcctgaattcagcactcttaatccaggttcttgaaaatgagaaggactctgtgtggacatgggaacagatgagacacaccactcaccccactccaccccattttcccacacctggtcctagagcagaggaagctcctggccgggcagcttagtcctgatcagtgtgtctagtaaagatgtgaagtgattttattgagtcagttctcagcagtgacagtcctcttcgatgggaggggacagagttcagtggagtgaggaggagtaaggtgatcttaggagctcctcagaaaagacagttggctgcccatctcagcagctccaccagtgacgagggctcgggtctcctgtggtgcaaccccaacatttccagatcacttcctcccacccagtcagaaggaggtgtgctttatacagtcatgcatggcataacaacaggaacgtgttctgagaaatgcatcttgagtccatttcattcttatggaaacgccgtaaacaccatagggcgcacttacacaaacctagacgttatagcttatgacacagcctaggctgtatgatatgtctattgctcctaggttacaggcctgtatagcacaacactgtcctgaatactgcagacagttgtaacacaaatggtaagtatgtgtctatctaaacgtatccatacatagaaaaggtaatactttgcacttagtggcaaatagaagaatccttggagtttgcagttgaaattactgcataatatcattaagataagacagcctgatgcatttaggtcatcattatatgccccagactggacaagctgggatatgttttccctaattaatgcctcagaagacaatattccttttttcagtatctccgtggctgatccacctctctcttactaacacattctttctttacgtataaaagctttttacttgaagctggcttaaagtttctatcttgtagcccttgagctttgtatctgttaggaattttgtatgtgccctgtcttttccattaggaaaagttcgaaaaagcttcatttttcatttctttcagatggcctttcttccccaaaaggagtatcattgtccaaagttcttcctggcatttttgttccctgaaatagtattggggataatttcttcccaaacactattttgttttcctaagctagaaaaagtgagagtataatgatttctccttgaatataaatgattaatataaaatcccccatcatgctattcccttttaaagttttcatcacttatttctgcaaactttgatctacttaattatgaaaatttgcacactccaactgagatttgttttaaattatgtatcctgtaatttggttgcaaatatgggcttcttttaaaaggacaagcaaatatttaatttatcttttcagcgtgaatgaatagtcattattcctatgaagacatgaatatttggatttttccattaatatgaacaaattactcactttaaaagaaattcaatgaaaaagtttagtgaattatcaattggtttaaaatgatgtttaatagatatttctataaaacattagtacagggtattagctccctgataaataaaaagctggttcattctttaaatccttcataacttcttgacattaaaaatgtaatttttcttcctgctgcctcccaaattacattacattgcataagaagtaacttccctggaggagaagcaaacaaatctattaaccataaattgaagaagaaagagcacaccaaacgctttcatgtactgcttacgtacccagcctctccagcactgtaacacatcgattttcatgctgtttattctttcccatttcaaagtggcattatttgaaaataaataaaactgacatttaccaaagttgggccaaacaacccgtgagttagtacagctcacagaacaagcagagtccacgtggggccatgcccctgttgatgaaccttaagtgaagatctccagcttgtagatgtgatcctgttggaggaaggaaaacatcagcaatgagaggcatgaaaggcactcagaaggcagcagttcaggctggacgcggtggctcacgcctgtcatctcagcactttgagaggccaaggcgggtggatcacctgaggtcaggagttccagaccagcctgaccaacatggtgaaaccccatctctactaaaaataaaaaattagccgggtgagctggcgggcacctgtaatcccagctactcaggagtctgaggcaggagaattgcttgaacccagaggcagaggttgcagtgagccgagatcatgctactgcactccagcctgggcgacaagagcaaaactccccgtcaaaaaaaaaaaaaaaaaaaaaaaaaaagaaggcagcagttcagaggcctcaccacctgccaccacctgatgtcagcatgcagagctggatgctatctgtgctgcactgcgcttctccacattctgctggccccacatcctctttttcttgagtctggttggtccttaattaaccaagaatatttgaaatcaaatttagtttccctctaattgaccaagactatttcaagtaagtgagtagaaaagtctccatgtgccattctatgctctctggccccctttcctaggataacgactttgtcccgtcactgtgcgggccagtagagaagtccaccggatttactcagggatgtttgacaatcactgcaggagtaggcgggggcggtggaggctcagcgggaggtctggttccctgggttcttttccattgccctgtgcagctgtgctatggaagagtgagaggtggggtctctgaacactgactcaacagtagtgtgggggtctcataggaagcagaggtgcctttggggtgagcagagagaattagcacttgccttcctgcacagccccgtggggcccctgtctgcctctctgggatgggatcttcattgtgtcacagaaagccaattgcttattctggaaacagaattgagaagcaattgaaagtaaaagtcattactccttaagtcttgtaagttcttgttctaaactgacagaagcttctagaagtacccactacaaaattttctaaagcagggaaaagctaaagggaagacagccctgtccaggtttcatgcttggtcagcatgttcttgcctccaacaggtttaaccgaagaagcaatatttagtaataatatgtgtgaatgggctgatagccttccacactggctttttaggaccctgggctcttcctctgtgtcatacactcattttcagtttttcagtctgctacataaaaggacagaccgccaggacttcagattagtcctgcgtccttcactgtctttccgtagaggtacaaatacatcatcgctccccattaacaagcagtaaactggcaaggaagatgttgtaccagtgatgcactgactggagctaatgaatcccaacagctaattacacttctcttatggtaacttattaccagaaagtagctgcgttagcacaaagattgtatgtgaggatggccgtgcccagggagaggccagctgatgaatcatcccccataattttccataatagtcctgtctggacttccgtgtccagaccattgttcttcccggggttacatgttgcctgcccttattttggaacaacaatgtaattgccaattgtggactaatttatataaacacatgagggttctgccaaaggaaagcgtcaccgtgatgggtgctgactgctcacggagctattttgcacaagttagagtcaggtggttggaggaaatgaagcttactgcaaaaaataatggtttcaggtaagcaaaagcatcgtgtccttttgaggcctgccaggaggcgtggtgtgtggcctgtcgcattgctcagaacctgatggggcttgaagggcagcgtttctccttaatgtgcacggaagcagcgctgagtttcttcctagaacacaaaggaactttactgatttctcctctgcaggcagcactggctaccacacatgattaaatgtcatttgtccttgacccctgtcactcctaagcagctgaaatagattaagagtcagatgaagcagagcatcctctgccagctcctgcggtaacaggctcacaaagaaaccaatgccagggcttcttaggatttcccagggagcattcctgtttgaggggaaatcattgaggcagaatagcctcctgtttcctcccaagcacccagccgggatccccagagctaacacagaggccttgggaaggtagagctgcctgtctgagcagcttcccactcccacggggacagaaggggacagcagcccagaaagacagcaccaaagcaccatgaggcagggacgctgctggagaaagggctcccctcacttctcacctcactggacctggaagctccctccactgtctttaaaacttactgagctatgaagactttaattcaggtgaagacaaaggccaaggagtgccatagaccaccaagcccagatgcacctgcctgcaggcagatcgaactagcagcagaaacgagcccttccacccggcaacaccttctgttatgaccagattatgaccctccacctcccaggcatttcctcccctatcctttctatccctttcattcaaactaattcagaataaatttacataacatcaaattagccatttaaaagtgaacaactcggcagcatttggtacgttcaaagtgtgttgaaaatgacatctacctagttccaaaatattttcatcaccctaaaagaaaaccccatattcattaagcagttactcccattctgccttgcccaggccctggcaattaccagtctgtgctctttctctatgaatctatctcttctgcatatttcatataaataggatcctacaatagatgacttttatgactggcttccttcacttagcatgatgtgttcaaggttcatcattgttgtagcatgttttagaacttcagtcctttatgtggctgaataatattcccctgcatggatatagcacattttgtgtatccacttatccattgatggacatgtgagctgtgttcactcttcggctattgtatttgtttacatacccatttcaattattttgggtatatacctagaagcagaattgatggattgtatggtaactctgtatcactttttgaaaaccgccaactgcttttcacagctcttccttttttttctgtatgttcacctccattacattatctgggcctattcttctctttttctcacattaccttcgtttcatgttgtcgcctcattctgaaaaagtttttttttttttttcaactgctgaattattatggccatctgtctttgtatcactcttcttgagtccttaggagaaaggctctacacagatttcaccattttattttaagcatctcagaactggtatcagcccgtctcagctgtgtggacatagctggcctgggcctgcaagtctccagcctcatgtggggcccctctgctcttcattcaccatgtttgcaatactagcctcttttccgttgttctatacgttgaggtcttttctacctcaggacctttacatgtgactaccaacacctggaggactttccacctttgtatcccaacttaaatgtctcttgttgtaagagacactccttgacacgttcattccgtatatattcggccttctctatggccttgtcaaagcattctgggcttttgatccagaacttctcacaatttggagggatattcttgcctgtgtgcttgggtatttaaggcccatcacttcacaagtgacattctcacgtacatgacgatcatgtctttgatcagtatcagttttgtctttccccaaaacaacatctggcaccttgtagatcctgaataaatagctcctacctgaatgactgagtgaatgactgaattgatgaatggcccttctttttctgctgtgccagctgcctaataactgtcctgtactaatcagcaccaagcaaggaaacttttcactctcctggttgttcataaaatcttcccagttggagagataactaacttcacatttatccttcccagtttccacatgttgagattaatttcttgggtagagccatgtaactgcttgttttccagtgtgtgtgttgctgataattctgctaaatgaaaccaccgcatcaatttgttttatcaaacagaatatattttcctttgggtggcctcactgacttgcttagtacattttgtcctcacgatgtgctcatgttgcccttggtttttatgattctgaattcctcaaccacctcatctgaaggaagccattagactgtgcttatcagcaccgttaagaaatcaataaataatatcactctagtgctttgtggacaagataactctttaatacctctaatcatcacgtaattctcaggatagcatcataaatgatatattatgtctttttttccaattttaaataagaaaaaactgaagcttagagaggtttagcagtttaccctggagcccttggtagaaagccacaaaccaaaattcgaagctgggctttctgaatctggacggaatgcttttcccatgatgctgctgccttgtggtcagcctgtcagcactgaactctgcagccagtctgccccctcccctagataattggagcagccgtagccatctcatcctctccttgttggcccagtgttaaatcaacagcttagataaaatggatcacatctcttattgcacacaaacatatcttgaatttctagtatgtgcccaggactttgctaggcaccataggaacaaagatgaggaagtgacagttgtgttttaacagaagaggaggaaatctgaactgtggtgcatcatggggatacttaatgtcattaaaacagtccatggcaaactgccagagagctcctggggatggaaccatggactccacctgaagaactctaggaacccaccccagagtctgtccgggggaagaaggagagtttgccggtgaaggcgcagagagatgctccaggccagaagatccacctgtaggaggaagatgatgcatgtctggggacagacaggtggctcagtgtggccagccagggcgcggttggtagggagggacagagaggggaaaggcctattgggagctgattgttaagactgtctgtgaaggagcgtcatttggaggaggtgtcttgattttcgtagactgagtggaaccatggaagtgtgattggaagagacacggggctcctcttgctatacaaatgcagccattcccacagggtggagagaggattagagaggtggggcagggacaaggaggagaagagggtggagctggcagaaggatgagaggacccatgatagcactggccccatttgcagatcctagactctgtcctaggtgttgctctaggaacctcagttagttgccactgtctttgagatgagtgtgatatggacaggtgtaaaatccaagctcagaggagcaggcatcctcatctgcatctgaatagaaactacaggttgtgtaatcttgggccactgaggtagcctctctgagcctcagtttctccctctgtaaagagggattggccagtcatgtagggctgggacagggggaggcaagggaggctgagctgtgcagggccagatcccacctttagtttaaatttttggtaatattttcatcctgtatttttttgctttgatttagatgaaaaaatattgcattaaaatattcttcggcacaacaatgtgaatgtacttagtcctactgaacgtttaaaaatggttaagatggtaattttatataatatatattttattataaaaatgtgtacgttgtttatcataattagtaagttatttcagcacccccttaaatgttgcaccgaggtgacagcctcacatccctcacccattcctggccctgcagtcatgcacataaattgcttggcatagggtctgaccaatcagaaacggatggctgctggctcaagaccactgtctctgctgaggcagccatcgtgcaattgtaatgaaagtctgtcttgggagctgttgggaacgataaggggagactcaggggctgagcactgggtcgtcttatgcatcttgggcatagcatcctacacacatctatttccttaggaaaatgtgtccaccaacaggagctaggaacctcactccgtaaaacaacatttgtctcctagatcatctcagcttgggtggaggcccttcctccagaaaaggggtgagacggcggtcccttgagagaaatacagcttcttcccaccaactcaaaggatacctgttgtcccctaagacctcattctctgcttccatttctgtggaccaaaaggtagacccccaaggccttgacatctcctctgctggtggtcacagtaacccttaccctgactcactcagccctttgtgccccaggagacaaggagagcatgtgacagatcctcagaggaagcacaggtgagtccaagtggggagaccaggctctggtcgggtagcctgcaggtggaccggaggcagtgggagctcaagccacttcccaaaccttcccgagctccccgaccctccgttgcctccctgatgcctccttgatgcctccttaaaatccgtattttaggactgaggggcccaataaatgcacccttttcttctcccaagtttaggactaattgaaaaataagacaatgaaaacagacaaatggaacttaaatagtctgtttactggtgacaacactgggctgacagcatgactttctaacccgccaagtggcagactaaggatctgctcatagaaacccctagctggtgcagacctggggactgcccctatggtagaaacccctagctggtgcagacctggggactgcccctatggtagaaacccctagctggtgcagacctggggacaagcccctatggtagaaacccctagctggtgtagacctggggactgcccctatggtaggaacccctagctggtgcagacctggggacaagcccctatggtagaaacccctagctggtgtagacctggcgactgcccctatggaaaacctgggatttgaaaagctgacaaacccacccaacatcactgactcccacagtccctggtcctgtattatagcttagctccaacaagtgcaaaaatctcagccaatgccagagcttcatcacccaccagtcaaatgattcactctccttattaggggctgttttgagtaaaattatacctccctccaagattcacattttgcagtcctaaccccaactactgaagaatgtgaccttatttggaaataagttcattgctgataaagttagtttagatgaagtcattaggatgggctccaatccaatgtgactgatcattacaaaaatgggaaatttggacacaaagacacacactcccagggagaacatccacgtgaagatgaaggcagagatcagggtcctgctcctacaagccaatagagcatcaaagactgccagcaaaccaccagaagctaagagagaggcccagaacgagttttttttcacaacccttggaaagaaccaaccctgcagacaccttgatcttgaactgtgaaacaatacatttctgttgcttaagccacccagcttgtggtaatgttttacagcagctctagcaaactagtacaggggtgcaagtgtataggaagggtaggggaagtcatggagagtttctaggaaaataaagctaggaaaagaggttcacctttcccagagctaatggggtattagctgaataataggatagccctctgtgcatgacattaggtgctttacacatattgttcttattttctctttgttaaatgggttcctctgccctttgctcgggcacatatgcctgagtgagcagaagtcaagggggaaggaggaaataggtctggctcctgcatgcatcacacactgcctcatctaatccttctaaaacatcagcccactttatagatgaataaactgagggtatgatgttaagtgtgttgcccaagaccagttggctaataaaagagtttaaattttgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggtgacagagcgaaactccgcctcaaacaaaaaaaaaaaaaaaaaaagagtttaaatttgacaccaaaccttttccagtaccacagcctgtcttatggaaaacaaaatacttctatttcttataagtgaactataaaaatgaggacctgccaaggtaggggtatggaagtattcctggtgtgttcctctcactgttcacacccttctccctggctcttcaagaatcccccttgcattcaacttcacactctcttgcttgaaattcctttaacatgtttgagataagaatattatctgatccgtttctaatttctctgtggaatagggctaaagaagaagcaggcactaggaagcagctctcttgctggcttttaattttatttgctttctgtggctagagtacattagtattggcatcatttagtccttctgtctccttttcatttgagcaagttatcatctatttgacaggtgtcttagtccattttatgctgctataacagaataccacagtctgggtaatttataaagaacagagatttatttcttacgtatctggaggctgggaagtacaaggtcagggggctggcatatggtgagggccttcttgctgcatcatggttgagggcagaaggtggaagggcaagagagagccagagggtgagtggaggccaggctcagttttataacaaactcactcttgcaataaggaacccactcccataaaaatattaatccattgagagccctcaggatctaatcgcctcctcaagttcccacttctcaacactgttacattgggattaagtttccaacacatgaatttggagaacaccttcaaactatagcaacaggcaaagaaatcaatcacaagcagccattcatattcatctgcagaccaaaattggccatagatgaagatgcagaaccttcaagggctgtctgctgccaacctgggctcctgagtgcagacacagctggcctaaggcatccatctgttttctcctatccctaaacagttttttctccctttgccagcttgcacggctgcctgttcttctcacagctggccttcttgcatatccaaacttaaccgttcaaaggcaatatttattagatctataactattcttagaataactaagcatccccaaaggatatttttactgaagacgccttccaaagactggagcctctaacttttagctttggctcctttattcaccaagagccatcaggagggtactctggccacatagaaaacaggtaaagccaatcactttaagcatgcaattgtcactaattactctgaccttttctattattgtgttcaccaacaatttacaaaattaaaaaaaaaaatgacggtcttatatgcatttgttttaaaaagtaatcaaacagctgggcatgatgtcccatgcctgtaatcccagcactttgggaggccaagacaaaaggattgcttgagtccaagagctcaagaccagcccaggcaacatagggagaccctgtctctacaaaaaataaaaaattagttgggttcagtgacatgcacctgtagttccagctacttggaagtctgaggtcagaggatcgcttgagcctgggaggtagaggctgcattgagccctgattatgccactgcattccagcctgggcaacagaatgagaccctgtctcaaaaaaataaaaataaaaataaaaataatttttaaagcaatcagacaatacaaaaggaataaaaatagtattagtaattgtctcttaccttccaacccagagccaaaccagttaattattctccatatatatttatataaattgtttttttaataaatctagaatataacaacttaaatacgtgtacattttctctccaatactatacacagatggcttctcctatacattggatgaacttttggtaaagactgtgttttcccagatccttctttccattgcacatcctgaatggcctcagtaactgttttgtagctgggggtgaatgggctctccttcttccctctcttcccatgtgtttgacatcacagtaggaactggtagcattggtaaatatagatacagatgtcttctcaataggtagttatagagaatcattattattagattattacaggtaagcttgaactttattagcatacatagtgtttgaaaacaactttagcccttggcttgcaaaaacaatcgtttgaatgtaatcagatagcattgcattccaattaatcaatagaagaccaataaattgaccagataatgtttttacctgtttttccttttgagataaaattattaaaagaagagcctaggagtactttgaggacagtcttgtgaatacacttcctgaacctgttcctttgccctggacaggttgaaggaggcaggagattgtcatgttttctttgggtaccaatgtatgcccaactgtaatgaaaaaatagtctgaccttcagtggtaggccagacccccaatgatgtccctgtgctaatcaccaaaaacctgtgaagaccttaaattacatggcaagggaaaattaaggttgcagatggaattaaggttgctaacacctgaccttaaaatagggcgattatgctggattatttgcgtggatccctataatctcaaggattcttacatgtgaaagagggaggcagaagagtatcagagtgataccacataagaaagtctcccctggctctgaagacagaggaagcagccatgagccaagatgtgcatgtagaagctgggaaaggcagggaaacattctcccctggagcccccagaaggaacacagccaacaccttgatttcagcctgtgggcccattgctgacttctgttctccagatgtataagaataaatcggcagtttatgcccctaagtttgtgttaatttgttacagcagcaggaggaacctagcagatgccttcaggcagctgttgcattcctgtggagcaccaggaagccacacagccaggcaggtcgcaagcactcagcactcagggagcagagctgcacgagcagctggccagcaggacacgaggtctagcagcaaacagagagaaaatgggatttgtttttctttctccctttcaacccaggctcttctatcatccaagattccataaacatcacacccatgatgatgcagtggttaccccagggaggtgagcaaagattcaagtaagacagggattcatcagctggtcccgttctaggtgtgagaaaacaaatgtgaaatgaaatccagccactgtcagcgtgctttcacacagtcctgaactctaacacgcagtatgctgggatgcagacaggcttcttgggtaacaagatgctttctccctcttttggtttccagatcaaaaatggtttctggccgggtgtggtcgctcatgcctgtaatcccagcactttgggaggccgaggtgagtggatcacttgaggccaggagtttgagaccagcctgggcaacatagcaaaacactgtctctagtaaaaatacaaaaattagcctggcatggtggtgtgcagctgtaatcccagctactcaggaggctgaagcatgggaatcacttgaatcccggaggcagaggttgcattgagccaagatcgtgccattttactccagcctcagaaaagaaaaaaaaaaaagtttccttttactctgtgactcctctgaagacagggaaagaaaactcagtgccagcttcttggggagatgattccaatgctttagttctgcatggacatgcaggaaggaacctcctcatgactaatcaatgcagcagtaccacttcattcactccccactggagatatgtatggagcagagctctcatgacctaaattataagccaagacaccaaccttggtcctgttgtgtagctcctagcaaagctaacttttctagaaaaaataattaatcagtaactacaaatagaacagaatctggaccacccattaaatctgtgtgatgtaacaaggtttagaatattgagccgaactcacaccaatcacagacccgacaaggtatcaagcttttctaataatatcagagacacaggtaaccacagggcacaggttgggcagggagaggatggcaccaccagtgccactaccaggtccttcctgctgtgtcaggacacgcactgacccagtttaacacgtgtcctcgcagaatggtgtgcatttacaacacttacaaatagggagcctgggattgacagaatagtggcccccaaagatgtctacatcctaatcccagcaacctgagactgttacctggcaaaagacactttgcagacgtgaatagggttaagaaccatgagaaggggagattgttgtgattttcccagtgggcccagtctaatcacatgagcccttaaaagcagagaatgttctctggctggagtcagggagatgcagcagaatgagagatcacggctggctttgaggatggagaaaggaggccacacgccaagaaatacacacagttgctagaagctgggaaagatcctcagctgacaaccagtcaggaaacaggacttcagtcctacaaccataacaaactaaattctgcaagtaagctgaataagcaaggaaacagattttcccctagcacctccaaaaagtaatgcagccctgctgataccttgatgttagctctggagacccatactggactttcaacctgtaataagagagaactgtaaggtaataaatttatgttactttagtctggtaaattagaggtaacttgtggcagtagcaaaaagctaatacagggtcattttggtcattaaatacctctaatttcatatccaaatggatacctaacttaaatatttcccatgagcactcctagacatcaggaatattctgaagaaaacattccataaataaggatttgcctgctagtaaacattattgttttgtttgctaggaggtctgtgttttgcatgtttgcaagaagacctggcagtcatcagtcacctgctttcttttccaaaagcattcttcctccctacacccaagttagacctgctgctagttgtcttcttcccaagttattttgtaagagcttatctacaactacatggaaatagtaaaccaaggcttagagtattaccctattaagtttatgaggattaaccttgttcttgaatataacaagcaaggaaaaaacaaggaaattcctggacacgttggggtgtatgtactatttatagtattttccaaatcataatttgctctagacgactagatacagcttcttgactaaactggcatgaaaaaaatcaaatttccggactctgaataggaaaattaataaaattcctgcctttagatcaacatgctcccaataaaattgggatgtcttatattaataaataagaaatgaactaatgaatggattaattcctcatatggcttttctgtcattcagctcctccagaccaatctggaataagtatgttatttatggaattggattagagatacaatagtatgtcttttcaattcaacaactatttattgagtgcctacttgatgccagacactgtactagctgctggtgatatatgagtgacaagaaaggcacaggccctattttcatgggctttgcaggaaggaggcagtaagcaggtaacatcagtggggtgggaattgtgaaagagagccttgaatgaacatagaaccaatgaatttagcctggtcaggggatcagggaaagccctcctaaggaaaagacttgaatgatgagtaggagttagaagaggagagagtattcaggcatgtgcctttgagttttactcagtgaaatgaccctggactggaggacttgtgcttcgatatatatttttgaagaatccctgcagctgctacatgagacttccctagaaggtagagaagatgaggacagaagcagagagaacatataagagatacatggtggccttagagaacaattctggaaatgctttgaagttagagctgacttgatatgctgcctgattgaatgtaggtgtgtgggaaagaggagagtcagagatgagtgacacacatatctattccacaagcgtagcactgctggtgcataacaacataagcattaagaaaaccctcaaaataggccccagttagcaccattgttctttttccccatttcatttttatctccttttttcattcttgcctttttcattttatcttctttcgtgtctcttgatcactgtggcaacaaatatactttataaagtcctttttcactcttattatttctattttattcatcactaatttaattcatgacctctaagatgaagaaaattcagaactaaaaaacaaacaaaaaacaagctaaaaaggctggcagtctctgttcagtctactgtaacaaaacagcttagaccaggtaattcacaaacaacagaaatgtatttctgacagttctagaggctgggaagtccaagatcaaggcatcagcggcttcaagatctgctgagggctgctttctgcttcacagataataccttcctgcatcctcagatggtggaagaggctaacagactccctcaggcatcttttataaggccactcatcctattcatgagtgtctcacttaataccatcaccttgggggttaggtttcaacatataaattttaggagggacacagatattcagatgatagcagtagccaatgctaatttagaagtggatatctccacctaccaccatgatatgaaccagatggagagcaagggcaaagttgtggctagcttgtttgcaacttcatgtaacccacagcccactgcatctcgctgcatggtaaggggccagtgcatgtaggagagtgtcagtcatgggcacactatctttgaggtgtgtccatgtggaaaataaagatgggaaaccactactcagagacttcagcgatcctaattttctttggagttggaatcacctaacactatgtatttgattttcagcatagtctgtaaaaatattccatgatgagtatttgtgattcaaattaaaataatacagtgtatgtcttagagaattttagcaaattattggattaaatgaagtcattcaatcactgaatctaccgatgtacatttgtgtgatatagaaggatcctctctctgcatgtgttttgtcaaaagttgaatccactgtttcttctgtaacttttttctttactaattgacagatctctaaaaccttttcatttcagcacatataaaatgatggataataagagtaattatattaagatgaactttagaaaaaccttgagtttctagattctgttttctagattatttctatggagtactgttgccttgacattttcccccatgaagtcattatatatagtttgtgccagagttctaagaaccattattatttacgaaaagcagtaaaacctgaatgacaaatgtgccctgggctgatggtggagggcacgagccttctcttttgttttctagttattcccagggtggccaccaagctggttaagtgcacaatttttaaatcagaccttaacacttgctcaaaagactgacacatgtactgtaaaagattaaaagtcctttgattgcagcacttagcgcagtgaagatagacaatggaactaaactcttcatggccaacttgtgacctgtttttaatgatgctctgtggctcctcaaagtgtcattgctatttgacctttctgtgcagctttataattcttggatttttgaagcattactcctttcacaactgaagcagtaaaaggaaattgtgcacccagtggtgccattatcctacactcatattgtgtgcaagccatctggtagtagtaaagcaagaaaagtcattcttaggtgctacctagagttggtgagaaactcatttagcttactgttcttcctgcaacaagagacatctaaaaatcttaatgactacatctcgtcttatcattcagagcctgtgaaatgcccccatctgaagaaacgatgtttatctaaaacttttgaaatacgttagcagaaatgttaaaatgaacatttgtgaaaattactatggtgggtttccttttgttttatcttatgtgaatatagtagttttccattgctaccataacaaattaccacaaacgtaatggctgagaacattactaattgattactgcagagtcctgcactctagaaatgcaggggtcttggctggtttctctgtttggagcctctcgagtctgaaatcaaggcattggccattgggctctttttgcacagaagagcctgtatccaggatcgttcaggttgctggctaaattcagacccatgaagtagactaagggctgcatttccttgtggggtgtcagccaggagttgttctcagattctagagggcatgatattccttggctcattgctcccttccttcatccttaaagccacctgagtagccccactacctctatctttccccctttctcctgctccctcctcagccacatctctcagtctgacccttgtgccttcctcttctgatttgaagagttcctgtgattacactgagcccagcaggataatccaggatcatttccctatcctaaggtcagctgattagcaaccttgattccacctgcaaagccccttccccagttagtatttggttgagcgaccaaagggtaggaatcttggagagatgtctttagaattctccctaccacagtgaaggggaaaagtgcaatcatgacaataatggaagcagacagactatatcggtactatggcagccttgcttttaaaatgcagaatcttcgagctgccctgttaacccattttccaacattattcctaactagtgattaagacctgtgcataaacttgcaagacctcattggtacttctctttacagaaataactcctgctttcttttaataagccttccagaaatttctttcagaaatttaagaataggccaggcgtggtggctcatgcctgtaatcccaacactttgggaggccaaggcaggtgaatcacctgaggccaggaattcggaaccagcctgaccaacatggagaaaccttatcactactaagaatacaaaattagccaggcgtggtggtgcatgcctgtaatcccagctgcttgggaggctgaggttggagaattgcttgaacccgcgaggcagaggttgcagtgagccaagatcgcatcattgcactccagcctgggcaacaagagtgaaactgcgtctcaaaaaaaagaaaaagaaaaaagaaatttaagaatatattttagtaattaagattaaattactagttactgggagaagacagtaaggtgcataataatttaaacagcaagactgtgctaatatttccctttcaggaaaaaaaaaggctaaataatcttaagttttactgttttctgtatattttttcttatatgaaatatatatgtgttcttataatctttcttatccccatctcccattacctccatatgcgatattttcattctgaaacaaggcgagtggtccttagacttcttggcagtcttaagtaaccattagccaaaaacatggtttgtctgtttttaatacagtattcacctagctagagctatacagtaatctctggccgagttaactggagtccggattttctaacatttgtcttgttctttgcctcaagtaaaaaactactaaataagttgtcaaaacttctcagtttatgagatagcagttagcagagatgggtaaatttctaagaggttataggaagggtgggttttattttcaatcacttccttccaatttaaacttatggggattaagctattttgatccaaggaatgttttgatccaagagctcttggagtctccttttctattagcatttttgccacaaattaaggagttggtttccagggaaaatatgtaagaagactgtcttagtcagtctggcctgccatagtgaaatacgagagacaagatagcttacaaacagcagaaatgtatttctcacattctgggagctggaagtctaagatcagggtgccttcacggttgggttctagtgaggactctctcctgggttgcagacagccaactcctgtgtcttcacacagcggaaagagggcaaagagtctcggagtccccttttataagggcattgatttcattcaagaaggttctcatccttatgacctaatcatctcccaaagtcctcagtaacactgtgacatgggggttagaatctcaaaatatgatttgttggaggacacaaacattcagtctataacaaagaccataaaaagcagagagggccggatacccgcaggtggtaggcctggaccccacagaataacagcggcttctgccctttcttccctactgagtgactccctcttctaagtacttagccccccagtgagcagtcagcttacagaaatactggggtgactccccacaataaaacaatattttagaggggctggagaattgcacaaaacaaagggttaagacccaagagtatgtgagagtatatgcagttctttgcctctttcagttttttgatgatggttattggtattcagtaagctatcagtcagtgatcaaagcaatcacaaaaacaagaaatagacctcaaggaaaactttaccatctagataagtgagcttttaaaaatcacatttattctcagctttaataagtctttgaagtacgatttgttaaaatatcctgcaagtaaataaattaaaagattacatgactgcatatgtggaattaggggatgaattgaaatgaaagttggaagttttttgtttttttttttgagacgcagtctcgctctatcgcccaggctggagtgcaatggtgccatctcagctcactgcaagctccgcctcccgggttcatgccattctcctgcctcagcctcccgagtagctgggactacaggcgcccgccaccacgcctggctaattttttttatttttttagtagagacgggatttcaccatgttagccaggatggtctcgatctcctgacctcgttatccgccagccttggcctcccaaagtgctgggattgcaggcgtgagccactgtgcccagccggaaaggctgttttaataatagctgttaataatccagaacataatgccagatcttgaaaatcttaacgcccacagtctgacatttaaaagccaggtagccaataatctataaacccttattagtcaagttctgttcccctacttcttagaagataggggactcaaaatgcaaggaattggatcacattggtattgctcattatttatttagtcacatggtatttattttcctggaagccaactgcttggtgaagtgaatattgcatctctcttctgcaatgtttcctagcatattcatttattatatacattttaaggcttaggttctgtgacttgtcatataaatcacacctggttgagcagaaataattttgtttaacaaagaaagaagaaaacaactagctagtattcattttttaatctaatttgtgttttgacccatgacattttcttttcgctgtgtttgtaactttgtaactggccatggctggcaaatcatttagcaagcatggtaatgcttgctgcagtggcgtgtggtgggtggacttaacagaggtcctcttgatgggaagtcaaggtgccagaattaaggttagatatgggcggctttcaatatatagtacaccctgattttctgagcctaccatgaatgtgccagagtaaaacattgtgggagttggtagaatacagggagggcgggcactgacccgggggatggaccatatggcgttactccaagcttgagacgtcgtccggtcatgaaaaaatcaatgcctagtgagtacagctcattccccaagtactgcaagttaggaaagaacaactgtgagcggcacgtgagtgtttgtggagcacaaagggccacccgcacaattaggctcacagttaatggttttagccacacagcatccacacctttcttccctctgatttccttgtaatttagcccaatgggaaactttcagcagacatttcatagagcagttaactctgtggcgaccatcagttttaattggaatcatgtagctaaaaccctaggtagtacttgacagcaagagggtgtcttttaattcaggtatttctggttccgctctgggcttctctggaacaatgttccctgatgcatggctaactccagaaggcacggatccaggcagtcttaaaacggtgcagtgtttaatcgtcatcaaaagaggggccctccgtccctttctgatggcttacgtttatgggtggatggggggggtgtggtatgaacctagcaaccaccgctttgggcacagaacaacagtggtgttcgcggccagccccaataggtagttggtctttagccactgaagcattctgtctctgcagctcagcaaagcaattaccaagccatcattgtcctgatttataaagaaattgccttccttgggagaagacagtaaggtgcatagtaattcgaacagcaagactgtgctaatctttaaaaaaaaattagggaaacttgtttttttgggaattattctgacttggctgtgataagagaccagctttcaaaacacatatggagagagagaagtcaagagcttttcaagtaaatttaaccttacattatttgcaaccaataaaagtttatggaggtgtggctaatcctaatgcgggtaatactgcctggtacttatggttggtgcttcacataatgttatgggaattcatttaaaataacgaggctgcactgcagacttcacttaagcagggctaggaagctgcctcatttctctctcttataatccagtgtactcatgtcctagacagatacagaatgccaactgtagcactattggttctctgcaagctctgaaaactccagttttcaggggacttttctggcagaagtggaagataccaaccaggcaaaagagcagtctggaccaagctgatggctgcaaatttggtggcattcttgtagctgatgagatcagagatagggcagaatatattgaagcacgtagttcagcctcagaaagtgcgtcatcccaacatcacatcagtgttgctcatgcagagggccttggcatgccctgagtcccatcgaacagtggcctggcctcacggcattgagagcaggtattttctatgccaccacctcacgcccttccacatgctccgaggaagaattttgatgcatatatatatattatatatatttatatatataatatatattatatatttttatataatatatatttatatatttatatttttatataatatataatatataatatatatttatatataatatataaatatataatatatattatatattatatataaaatatataatatataatatatgtatattttatatataatatatataaatatatattatatataatatatatattttatttatatataatatatatattttatttatatataaaatatatattttatttatatataatatatatttatattttttatttatatataatatatatttatatattatatattatatatatttatatattatatattatatatatttatatattatatataatatatatatttatgtattatatattatatatatttatatatgtaatatatatttatgtattatatatttatatattatatatattatatatattatatacttaatataatatataatatatattatatatattgtatatatataatatatatttatatattttatatataatatatatatttatatataatatatataaatatatatattatatatatggcattttggtcttgagcaaagcaatccagttgtttgattatctagaaaactcttcttgaaacttgcatgtgcccactgcaggctgagcagttttcctgggagggaatgggacatgaggcatcggagacggtgctgagaagaatccgtttaccctggagcaaaacgagctgcagcctccctgtgagtttcctcttgctgctgtaacaaattgccacaaattccatgacttaaaaaaacaaaatacattagcccacagcttctctgggccagaacttcagacactggactcactggtttaaaatcaaggtgctggtgggatcgttctccttactagcagctctggggaagaatccaagctactgcaggttgttagcagaaccttgttccttatggccatgagactgaggtctccacttgcttggtggtggccagttgagagctgccctcagctcctgcactcctaatggcctctccctcccctttgcctgtggctaccccatatgttgaagctagcagctgggagctgaacctttactcttgggatctctgccatcccttctgctgcacctctctgactccagccagggaaagcagagaataaaatagggagattttccagggacaaaatagggaaagtctccctattttaaacattgtaaccttaattccatctgcaacgtcttttttttttcttttttccatataaagtaacctgttcacagactccaagaattaagttatagacctcttggaggggctgttctctggcctaccacagtccaccctctggcctccaaagagtcacattcatgccacatactttcattccatccacagtccccaaaggtttcatcccattacagcatcatctcaaagtcttaaatctcttcagctcaaaagtccaaaatctgaatcatccaaatccgagctggatgagtaatctgttaagtacagctcctggggaagaacttctctccgtctgtgaacctgtgaaaataaggaagcaacatatctgctcccaacatgcagtgatgggacgacatagtaacaattatagacactccagttctaaaagggggaattgaaaataaaatggagttgctgctccaaagcagcctggaaacccagcccagccaatgccattgggtttccaggccagagcttatcgaacgtcagcctcagctttgccctccgggtcagatgtcagaaaaagatgacagtggaaatgcctcttgtaagggacttgaatgcatcaggctggtgggggaagaagccctgcttcagtccacttttgagtatcgtgcaaacgtcacacatttccacctgcacagaacgacaaggacagaactgcatttccacctgccgtggaactacaagaggcaggagtggtacctctggtgagggatggcccaggatttgcagcaatccacctgggctgtcctgtggccagatctcaggaagcacttagcacagagaatgtggttgagtaaaaggccattaacaagatttgcccttggtccaccatgagccagccacagttttagtagacatattgcactggctgaggatgccaggcttagtaaaaatggagaattatatgccaaaattaacatttgccacagaatgccatggctccctgccaggtcctgtccttggttggagcctgcagaccccacccctgcacggatgtgcgtggatggtatttgcacaggctgttcacctggaacttagcccaaacctgtgcctgtactttaagccttgccctttgcatctaaaagtacgcatttttaatactttccatttacattgcatgagctgcttttttgctggaaacatgtttattatgttccgtgtccttattttttaagttaccacccatgacttgctgctgtaagtgtgaaggaaaataactgatatctacatttacagaattacaacttaaggaaatattttactaaaacagatgaagagtaaaattttcatccatttcagcctatatttgttttctgttgtatatctagatgtcacttccaaagaagatgggttcccaaattcttcacactgctagttacatactgatgatatcgtggttactcacatcaaatataatgtctgtttaccttgctggacggtgaccttctaaaggtcacaagccaggtactctcatcagtttatcccaggacttagcattgcgtatggaagaaagcaggcacccagtcaaggttggctgctttgttgatttgaaattatttatctctgctattttatcttcctagaatgattcctctaaagcccatatctcctccaaaattgaaccaaacattacataatacagtaaaaaattagaaataatctggatattcattaacagggtattaatttaaaaaattatgaattgtgatctattttctttttttttgagacagagtttcactcttgttgcccaggctggagtgcaatggcgtgatctcagctcaccgcaacctccgcatcccgggttcaagcaattctcctgcctcagcctcccaagtagctgggattgcaggcatgtgccaccacgcccagctaattttgtatttttagtagagacagggattctccatgttggtcaggctggtctcgaactcccgacctcaggtgatccgcctgcctcggcctcccaaagtgctgggattataggtgtgagccactgtgcccagccgatctatttataccatgagataccaaaagtcattcaataactgtagctaccatcatgaacagagacagagataaacttttgaggggtaaaagccagttgcctgaggaattgttatggtaaaaaacagaatcttacctacatggttcattaatacgagtggaaaataatcttgaatgataaacaccaaatggtcacagtgatttccttaagggaaagcgaagagtgtggacatcacttttagttctacatttcccccactgtcttaatatttttacattagtttttgatttttaaaaaataaatgactaaaattgccaatgctactgtgaaaccttctgttctttcctctcacacatttgcgggagacacttttcctgtggggtgctggtaacccgcctggcatgtttctcccctctgggctgggaggtctctggtggagcagctgctcagctaacgtttactgagaagaaaccagcccggcgctgagcagctgccctgtgtcactgcagatcccctgtgatgtccacaccattcccagcagcacctcccggatgaggaggccaaagcaaagaaagcgccttcacagctaagtagcgcagctatgtgcaccgcagcaggtacaggagaagccacttttgtgaacattttgaataataaggaagccagccactcccttttttcaaagaagctacaaatcaaagggatgagccctcgtggaagaatgaaggggatggacagacttggagggtctcatgctgcccccctagccctgcaacctctgcacctagagagagaggctgtggctggattactgtcactccagtaaaggccaggtggagtcagcagacccagtggctgggcgaagacaccccttccttccccacccctgggcactcaacaaagaggacaatcttcctgcacggaagaaaaggatgggctttttggacaatgattttggaaaccacagacaaagtttcccaaggccttgtgggaggacacaaggcagagctgccgtttccccgaggaggcaaatacatttgattcctgaaacccagactctagatttaggagagcagcgtgctgctccaagcaggggctgctcaaaccacttattttggtgagatgtttttagacagtttaggatcccagcctcagaatatgctgaaagttctgtacctctagcacagaaaataaaaacaaaaaaccatgcataacgtgcatataaaaatatacaaaacttggaacaaaatatcaggagttcacagacaccctcctgaatcctatatctgagcttcagatgagaatctcggtcaggggttgatcgtgccagtgacccgtttctgtatggcttcaagtaagaacaggttttacattttttaaaaggttgttgaaagaaggaaaaagaggaggagagaagaaaaagtggcagaaaccctgtgtggcccgcaaagcctgaaatatttattctctgatcctttacagagagtttttaactcctgatctaggtgttcacggatagaagatctctttaaaatttaatgtttttgaagcaaaagcaagtgtgcttcgtggaatcgagaaaagtatgattggcataatttcccattctcacacttactcagatcaggtaatttatgataaattcaagccatcgaggatgtaaggatgttctccacagaaaggagctaattataggcatcaaactccaaagagccaattttttgcatttttacgtgtaattaatacttgataatcgatttggctgctaataatatggctctttgaaggggtagctattaggtctgttcagtctctgcttagcctaagcaagagagagcaggcaggagaggctgggagttctggagatcttgttactgggggtgcctgtgttgttgaattaaaagattgtcatgagttaaaaaatttccatcaatttctgagcaggtaattacatggtcaaaaaattaagatgctccatatttatgttctacttgtgagatcccccctcacaagtttagtgttatttcccatcatttgctggttgactgttagaagctgatggccattggtctaaaggccataactggtgtgtgtgggggccatggtcccatcctgttaggaagagcctggggagtgttgttcagagtctatacatcacatagcacacggcagacagccacatggcttcatggccattcaagaagtactctacctttccacattgaatttcctaccgtgggctaaggccgtggttctcacctttggaatgcgttctcatcagctggagaccagtgaaacacactgagaatggggctaatcgaagtataggggaagggcctgcgcctttgtattttaatcaagctccaaagctgattctgatgcagcagaggagcataggtttgagaagccacagggctgaacacaggttaggtgctggggaagcacacatgtagattagatcctcatggagcccagctatccagagcagacctctcagcctcgaaacagttggtgtgccttgtggtgggggcagtcctgagcattgtgggatggttagcagcagccctggctgcctctacccatgagatgcctgtaatgtccccaacactcacccagcggtgacaaccaaaaatattccctggtggcacagtcatcctagttaggaaccactggtctagaaagagtcctgaaaagaaccatatgctctttcatccagtcgatatccagtgagttcctactgtgtcctgcacagtggggagcacaaacaaccaaataagatgatgctcccccctacctcctaacgccttgtgggaccagactcaaacatcgtgtgttacaggtgctctaagagaagcttgtgcctggagctatgaaggaaggagtagcggggctgaggcaaggcttagaaggtagaaaaggcagtgcttggattgagccctggcaactgcgactgtcagagttgatggcttcaaggtggaaggaagaacattccagggggagggatcagtgggcctgggaaccccagacagcctctccttatccttggtcaagcgtccagaggccctcagctctgccctgaggggtcgcaggtatccccagggtcgggtctggtctctggtccatgccatcatctctggtgtcttctgcctccccggcctgccttgctgggttgcatcaaggctgtactaagtatgtgacttcatttttcgacgggacggtgccttgggactctctgtatcacttaaacctagttctgttctctaacaccctccagacagcccaccccactcctcaaactagtatatggtctcaggaacccaggccagatcctgcagagacccagcatctgggctctgatggttataaattggaagatgagatgtaggagctcagggagcgcctgcccagggatgtgaagggctgggccacctgatggacggtgattatagcagggctggacccagggctcaaggacatgtaagtaggctgggtatgagacaactccagtggagtccagaccctgaaggccaaggagaaggtgagggagagaggagaggaggaaacagacataggaagacaacctagccttgagccaggctgtgaaagctcttcctccaagcctgaggttgtagacgggtgagaaactgggaaatatctgactggctccaggccacaaacttgtgaacaatcataagaaagtttatatcttgaactaattttacttgcgatgctgtatgctatcttcaattgcatcttctattttttttttttttgcaagttgaaactgcctcgaataactcaagatgaggcttgtaacacaaggtacagtttaagaagccagtattcaaatgctggaacaaacatctgatatttattctgtaagcatagagcacagtcagtcacagagtaaatgtgcccctgctttcctgaattccaatccgatggaagggctgaattctcaataagagccaactatgtgtcacacactcagctgaatgctaggtataaacatgagaatgacacgctttctactctccagaaagtcccagtgcagtaataaggtcacagcctaaataataccaatacaaaataaatgatgatcagtaaaggaggttcaaagagctaagagtgtgtgaagggagaggctaattacaaatacattgattacccaatatctcattccttggttttccctgtggtttgatcttcagtatcctggccatctgaagcagagacacatctttcatggaaaatgccgtagtcatacaggtgaacatatggtctgagttccacgttgggtcctaggagagcactgagtgatggagattcaaagaaatgagatttcaagcagcacagaagacaggggaaaggaagcagtttagttgcattaaaataaaaaatagattggtcttttaatttggaagacataaaaatgaattgtttcattttttatctattagataaaaagattatagaatccacttttagcaggaacttcccaatgacatagcaactgacaattcagtcacgattgtaaaggttactaataaggatgagatattatgcacatttttgtgcttctaacaaataatctacaggtatttaatactatgtttatgcatagaatttttccatacccatttctaaccagacatagaagtcaccttcctcatgatgggcagaagatggtttaagtacaatgggagggaggaactttctagattgaacattgattaattgtcaaacactaaggaccatgattacaactaaccatttagtgagcatcgcggaaggttatcagggtgtttatttttaaacagtgaaacatcttgttaagtttcatagtaaaggtgttgagacaaaaatttgagctgtgttcaagtcgtgatgcttatagctgtatcatgtactaacaagcttatgctatttcaatcataagctgacatgacttcaccttaacatgttgatcaaaagtcttaaccaacaacaataaaaagctgaaatttgtggttgaaagagtagaacttgtgtctgtggggaagacggaggaacaggaaaccctccttaccaccaatgtgaaaatcaaatattctcttaagatatgtttcatgcactgaggcatagttgattaaaagtggaaacccaagcccagaggcctataggaaatcattgcccattgaaaagagacagtttatataaaaatgtatactgagcctcatcatgcctgcggacagtatgataacgccctcttcaagtctgtatgtatactgagcctcatcatgcctgcagacagtatgataaccacctcttgaagtctgtatgtatactgagcctcatgttgcctgcagacagtataataaccccctcttgaagtctatatgtaaactgagcctcatcacccctgcagacagcatgataaccccctcttgaagtctatgtgtatactgagcctcatcacccctgcggacagtatgataaccccctcttgaagtctatatgtatactgagcctcattacccctgcggacagcatgataaccccctcttgaagtctatatgtatactgagcctcatcacccctgcagacagtatgataaccccctcttgaagtccgtatgtatactgagcctcaccatgcctgcagacagtataataaccccctcttgaagtctatatgtatactgagcctcatcaccccttcagacagtatgataaccccctcttgaagtctatatgtatactgagcctcatcacccctgcagacagcatgataaccccctcttgaagtctatatcataggtgctgtgtgggtgtaggcgtatctcagtcactccccttctctgctgagaccttaagttattaatctttctcatttttcaatatcttacacattgtaatatagtagccaattaataactttttaaattttggaggagactggactagaatggaatagaaactagaataaagaaaaacgctaagattagtattgacaacttctgatgttaagttgttcattttgattatttcctattggttggtcctgcgcatttaatgattaccagtgaaattagggctgattattaggaagtttattggtgaattgggaggcagcctgcctccaaaaaaaggatactcgaaggaaagactgagcacattagtcaaagaagagctgcagagggtttttttcagatcagggtgtacacacgctaccctaagttgctttccagcctgaatttcattaattctatttggaaatgctaacttgccacgctaaagagcgaaacataatcacacattgccatgcaaagttcttctggccaaagaggtctgattcagaatctttgacaaacttattattttaacagcttcacagctcaacctggtgaaaatcatttcaagaaggaatgatctaaaatgctcctttaaaagggccattcttttagtttaaaataatatccaaatgcctgtcaccaccttttccctagcagaaagttagttcctctctggccaccaccacggattgtgtcagaaacaaaggttggccatcacaggatggaatttataaaattttacataaaaatgctgtcagtatttgcctagttatattatctaggaagctgagaaattttgtttatattcgaagatcagcaaatgccaaaaatactaatttgaattgtataacctttcccagtgttacacaaaaatgctgctgatagagcctatcttaacacgtctgtggaactttttaggtatcaaaaaactcttcatgttcagtagcattttaacatgaaacctgttttattttattttaattcttaaaaaatcatattctgcattcatatttgacaacaggcctgaagccctttctttcccatcttcacaggttttgttccagctcctcctcagctgaatgctaggtagagacgtaagactgacatgccttctaccctccagaaagtctcggtgcagtaatgaggtcacagccaaataattccaatacaaaatcaatggtgatcagtaaaggaggttcaaagagccaagagagtgtgaagggggaggctaattgcaaatagattgattcctcaaaatctcattccttggtcctctctgggtttgatctccagtatcttggccatctgaagcagagacacacttactgtgtggccttggacaacctctgaggctcggttttatcatctgtaaaacagaatttattacaacagcaaaagatgttgtgaatatgaaatgagactacctgggtcaattatagcgggctggagattcatttcattcaacttctccagactccgtccaggcttactgatccttgggatctgcctcatggctgccccagcactcagcaaagaacaccaccctcctcccagccagaccctccctagagagctggggtctgagttctcaacatcagcatcaccaaggatatgcaagttatctgactctaccccagacattctgagtcagagactccagcatggagccagcagtctgtactgcacacacctccagaggattccgatgctcccaaagtttgagaatcgtccttctttttctaccactgttcccaaggtccttaaattctttcaatccctttgtaccacccactaagtcatctcctgcagcctcccttttacaggttgtgttgtctgtagtaagtcattgcagaaattctctactggaaccatatgctaactgtgggtaggagaagaacaacatatgctcaggtggtagagtaactaaaagcaccccaagattttccttcggattatctctgtctcttgtaggactagaagatctctctgcttcgtagccacacatttcattacagtagaccccatctgttgccattagctcagcatgtgctagtacagaaaagagcttggagcagccccttctcataagaggtatcatgcacatcccaatgactaaattgtcacagaaacctctaactatgtccttagaatgaagtcctagaagtctacttctggctgggccaaggtaggtatcttttgtggcagacaaatttagatgtctaaaatatttcagaagttacaagttctgtctttgaaagtgtttcggacctctcaaagaggaatcctttgaatcaaaaagcttctgattgtacatggagtaaacctagaagactttctgaaggtcccccaccctccacggtcatgggactcacagatcccgtattaggagttcttcattgtctattccaggagttgcattacagacatctgtgacttacccaactctgggatgtgttttgtggaagccatcccttttcattaaagatatattcttgataagcattctgaaaaagtggggaaaaatgcatttactttcaaactatgagagcagctgggcatggaaagacattcttttggtgacaaccgtgaagatcgctgacgtgtccttttgctttgcaggaatgttagttcggccggagaggaggcccgcagaaggatgagagagtgtgatgggcttacggatgccttgctgtacgtgatccagtctgcgctggggagcagtgagatcgatagcaaggttggttgtgctggcatagattaaacatgtttgagaataaagactcccacgggactcaacaatagctaacaaccctggagagccaatgcagtatttcagactttccttctgaactctctcctggtttccttataagaatccaacacttttagactgggcttctaattctagcatggatctagatatataacctaacttctgattagctgtgagtaaatatgcagattgttctaagttactcaaaccacaggtgttccagttgagtgtataaacttgaataccacgttgctcacaagcttctagttttttttttttaatgtaatccactttcaacagaaaagacaagatgttaaaactacctgctttttttttttattttttgagacagagtctcgctctgtcacccaggctctgtcacccaggagtgcagtggtgcaatgaaggctcactgcaacctccacctcctgggatcaagtgattctcctgcttcagcctcctgagtagctaagattacaggcgtgcaccaccacacccggctatttttttgtatttttagtagagatcgggttttaccacattggccaggctggtctcaaacacctgacctcaagtgatccgcccacctcagactcccaaagtgctgggattacaggcatgagccaccacacccagatttgcgatttgaataatcccatattcttataaacttgctttttaacaactgttgattacactaagtgccattttaaaaggcctgcaagatctaaataaatgtcacaatgctaaataaatggggcttcccaacaaaataaatcagcaaagtctattcagtgtcttagttcacaagccagaatagaattgggtgggcttttccagtgtttgagctattttatttagtcttaaataagtttgattcattcatatgtttgtaatttcataatatcctgttataaacacaaactttaccaatagtcataaagtaatgcaggtaataaatgtgatttcttaataaggatttctcaagagccacccttattgacattttggggtgaattattctttgtcatgtgactgtcttgtgcattgcaggatgcttagcaacctccctggcttccgcccactggataccagtagcagcccccatccccaccccagtaacaaacaacagtgtctccagacattgccacatgtcctgcagggagcaaaattggccctggttatgaaccgtgaccttaatcctatggttttcattctgactctttattagaattgcctttggagtgttcatgtaaatacatctgcacagaccctattgcagtcctcctaacccaactgtctaactctggtcacaagtttgtgtacctttaaaagttcatcaggtaatttgatgtacatcttagattaagaacctgccatagtagatagagctttaatatgactctctaattgggaatctggtaaaatgtaatttagttacaaagttagataaagaacaaataaaagtgtttctatccatgtagtcattaattggctgtgtgtataagttagcatagcacttctcaaccctgactacatattagggttaccaagaaatttagaaaatcactgatgcctgagccttactccccagagatctgaatgcaaggtacctctgggacgtcagccctttgagtactagttcaccccaattatgagcaccacttgtcatcttttaacttctgctcagttaggttcacatccattcactgactgtgtgtttttagtttcaaagatgaacataatgtaacaaagagtaagcattcccctttcacagaaggccttaagtgaccattttagaccatttagtatcatcgacaggaaaattaaattcctaaacaagtgaccagtcaagatgtcttgaatatttacaagtgcttgttagcgtaatagacacgtgtgttttcaaagggctcctgaaggtaaatcactgaagcggcaatgctcagcatcgtcatattcagagtggtgagtgaggcactgggagactataccttttactgtgatggctacgaaaagagctttgatactagctggaccttacagctgaaaataaaataagagtcaacagcctcatgctttggctaagtgcagccaccagcaccaaagattaaggcatctttcaggagccatggttcaagaaccaacatggcacaaacatcttctttctgtcagatgaccagattcctaaaacctgggagacttggtagatcatcttttctaatgtccacattttccccaaaagaggaagttgaaataattgggagtattcagggctggagtcagaaaacccagatatccctggtggagtaagaagagccctgagctggcatcaagacagtgccagtggactgtgccatctccacctcccactggctggagcaccatatccaactgacctcaactctgtgacaaggagcataatcatagctgaatgccaaggctgttgaaaggatcagatgtgatgttactcagcaggtgcttcactggctggattgtgctattgggttttaacgtattattattgtaccatcattttccactcagccctctgcttggccgcttttgagctttcacaatgacaaattgagggtgaggggtttgaatgagtacaccttctttttaaggcctgagaagttaatacataaaagagcgtggattccatacaagcttgtgactctggtcctataattgggccagtgtgttgactggataacatatggtggagcactctacaacttccagattaaccctttctaatagaaaataaggaatcaaaatgaccctggtaaccaaaagcaactgctgaaagcactgctgacagcaatggatgtcccaagcaaagctaccggctgccaccctcctgctaggatcccaagtcttttgtcttctctttctccttatccccttagagaaaagctcttgaattaagtaactctcccaaaccaacccagactgcagaactcctggaggcttaaatgacagataaatgtggtccctgtgatcttctttcccccattcctccctccccatccgcccccatccctactttctcttcttcttctagcttcttcccaaatcatctccccagctgcagctcgattataaagcatttttcccaactgcagatttattccccaggagtcatttgttaaacagaggaacagtgatgcctccagggaagacgaacagtgggatgagaaagaagtttattctcccaagtctttgatgtaagaaaaataagtttgagctgatttaaagatcattctgacttatgccataacattttcctttcaatgagagtcgtttctctctttcatgcatcgccctgagtttacctgctttcgtgccagtccactttttgatgcagaggatgcttggaatagaaaatcaggttgactcagagcctgtgggattagcagcccatgacaccttgaaaagctgacaagaaaggtctggaatgacaaaggctccagagatatttcctgaaaactggttttcctcgtaagttttcatgccctcggtaataagtacagggcacctgctacctttcaccagattccagccagtggagggaagcagtgcaggattgtgatcccagcagcccctgcccattccagtcccaccccaggactgcagagaagcagctcagtctggtgggaggtactcacagctttagctgtcctcctttcacccatacaatggaattgtattatgtgccatcacagtggctgttacgtagcaggtgcctgaaaaaatgatagccagcttggtaagattcttcaaataaaacttggctcagtttatttttttttccatcattgtttcaccccttctaaaattggatatttttctccgctttccatggttcctgtagtcaaaaggtcagctttgtcttaaccagcaaacgttttctgcaaaaggtcagagaataaatattcccggtgttgcgggccatactgtctcagtcacagccatgtaattctgcattgtaccatgaaagcagctacagaccattcataaacaaatgggcctgggtgtcctccaggaaaacaccaattatgcacaaccggctgtgggctggatcggacccctgggcggcagtttgctcacccctcttctcaacaatcagaagttattacaactagtattttagcaaatagttttgagcagacactattcaaagagctgtatctgtgagcttattaaccctcactgtggctctgtacatgatactggtgttttttttgcttgtttttttgtttttctttttgagatggagtctcactgtgttgcccaggctggagtgcagtggcgcaatcttggctcactgcaagctccgctttccgggttcacaccattctcctgccttagcctcctgagtagctgggactacaggtgcccgccaccatgcttggctaatttttgaatttttagtagagacggggtttcaccttgttagccaggatgatctcaatctcctgacctcatgatccacccacctcggcctcccaaagtgctgggattacaggcatgagccaccgcgcccagcctgtacatgatactgttaatatgaccctccctttacaaatgaggaaatagaagtacagaaagattaagcactttgcccaaggccccacagcttgtgaaatggtaggcccaggattggaagccaagccggctagccctagatcccatcctctggagctccgcactgtgccatctcctgccactgttaatgatatgaacatttgaagagcatttactgtgccccagctttcttcccagtacttgcacgctgtgttactttcctgttgctgtcataaccaatgaccacaaacttggtggctgaacccaacacacatttatgatcttatagctctagagaccagcagtctgaagtgggtctcactgggataaaattaaaatgtggtaaggtctgaggcttaccttcttgaggctcttggggagaatttgttcccttccctattccagcatctagaccctgcccacatacctcggcttgtggccccttccaccatcttcagatccggccatggtcagccatgtccttctcacatcacatcactgtgactctcctgacttcctctttgacgtacaggccccttgtgaggacacaggcccacccgaacaatccagataacctccccatctgacaagcagctgattagcttaacaattcccacctcctgccagccacgtgacctaacatacgcgcaggttccagagattaagatgtagacctgctgggtgcggtggctcacgactgtaatcccagcactttgggaggcctaagcaagtggatcacaaagtcaggagatcgagaccatcctggctaacacagtgaaaccccatctctactaaaaatacaaaaaaaaattagctgggcgtagtggcgggtgcctgtagtcccagctacttgggaggctgaggcaggagaatggtctgaacctgggaggcggagcttgcagtgagccgagatcgcgccactgcactccagcctgggcgacaaagcgagactccgtctcaaaaaaaaaaaaaaaatgtagaccttctgggagggccattattctgcgtaccacacacatgttttagctcaactaatgcacaagaacctaagatgtgggacctgttatgaccattttacagaggggtacaccatgtcccagagatgtcaagtgcattgtccaaagtcccacagctaaatcggacacctagggttctacaggtgtccggctccacaacatgtgtccttaaccactgtttaaccttttggctaagaaaacatgagtgtcaggcatctcaaaaaaatgtagactaaaaatatttatgcaccccaggtgatcacagcccctcactttcctgggacaaccctggtttgcacctgtagcctccttgacactcggaaaatgctccggtgggcagtaaatatgccccccaccagagctgaccgaaattctaagtctttgattcctcattacccgatccccaatccccagccagggagtcagaggtggggcgctgtctgttagtggatgatatttgggatctctcgtggttgtacattcttcccttctcacaagtgaatttcaatcaacaataacagatgtttatagaagtaactattgctgataagtcatttatttgtgggggataaaaggtcctaagacctttctaagtttctccaattgttttccactgtggccatcaggggagctttcagaagctggcagctaaacacttccaaagagaaatgtgtccatggagaaagaggcctttccaggtggaagaatggagtgctgagtgctagttttactcattctttcctctgtttcccccttttctgcagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcaggtgatgcaggctgcttgcagctgcatgcaattatccccttcctaattgcaactgtaatatatcctcaatatatagagaatgagccctgcattttcatcaggaggtaaaatcactaatgcatctgcacaattttcctgtgggaatttcacagctgagacggtgggacatgaaatgatttccctcacgtctcgcagttgagccaggataggaaattacttaaaaaagaaaaaaagacacctgaggccctagcaagctctgacattccacctctgagcaggcgctgtgttaattcacacatttacttagggcattgtcggagctggatttgatgccatccaggtgacagggatgggtggaacaggagatgtggtataagaagggaaacagagagagacagagggaggccaaagatccatcatgtatttaatcgctggtttcgaagcatttagattttcagtctcacactttccattggaaatggggtaacagagaattcacagcccttccacaggatggcattagaagcttggccgtggggaacaattcaggtgaattcagaacaatgttgagctggagctggaggcctcttgagaacagaatggccctcacctgctgcagcgggaagtaggttcccctgcagcaaaacgaaggccgctaggcagcaactcacaaccctgatgcatcagaacagtctctgctcctgtcttggggagcccatgagagaccaaacccctcaccacaggccccaccaggacagggagcgatgggaggacaaagcatccccacctttgctaacactggaacagcggttaacttcagggcctggaaactgatttatctcatcaaggagcttacagagagtttcacaagtaaagtgaaaaaaagcaatataaaaacaggtgcgtacatagatataggtatagatgatacagatacaatctggccagttttgtataatatgtcatatgcaaatacaaaatgctatttgcctgtacaaaatatatgtgtttcttgaaaaagcagagtaagatccaagagaagataatgattgattccttttgtacttctgtatttataaatcttctacaatgaaaattacatttgtaatctttgcaaatggcctttaaaaaataatgttcataaaggcactaagttaatgtatgcttataaaagtgtatggtttttttcagagaaatttatacctcactgaaaggtgtaagacattatgtaaaatgaaaggttatctagtctacaacacagaccttccaggacagaggagccaaatattataacaggagtaaaagtgatacaaataataattggtttaatgatggcctctagaactttttctagtccagaaatttatgttgacccttacctttggcattggtgttcttgaccttaaaaagacactataatattctgcatgtcaaatttagctataagaaaaatctcagaaactttaaaaaaaaatccctgtagggataattctagaaaatatatgatacaaaaatatgatgcatgcatgctgttagttcaagaaatggttgctattgaaccatactagaagtatcagacttctaggccattctagtctagaagcaccagactacgagctcctgtgtgcagaagtgtttgacactctatgcatcactttctggtctaagaggtccttgcaaactcatccatttttgcatctgctgtgtgcctgttgctgagttctaaggaattgctagtttctctagtccgttttggacaaaacctcccatgaaacagtcagcatgtcatctgccaagaaggcgcgtctcccccagaaggaccctctctgccctcagcagggctttatgacagcagactgtcactgcatggttggtggagggaatccgaagattggggtccagggaaataggaggagacaaaatggattcatttactttttgcaccttttgtagcaatcagcattttttggtttgttttcaccttggtctatggccaacgatcctgtgatggtgtcctgaggtgggtactgtttcagcgtggtttggaggtgacgggacattgtcctccaccagctgctggtcaggtcagaccttcttcaaggcgctgttggtgtgagattgaccatgggcagagggccactgagaaaaacaaaaactaaataagcaggacctgatggaatccaaaacctccctttttagcttataaatcaatttaaagttatttaatttaaatgggtaaaaaatatatgtctgtctgcatgggtgaggagacaaacctatcaattcaaacaggattctgatccactatttttatctggtaggtcttctttcatgatcatctttgtttcacaactgagtgcactgtagtcaatttaacagtaaatatttttgctctttttcacctctttgttaagttgtagatgccaaatgcataaatgactggaagattcacctgtgatatacacggtgctgttttatgcataaaagcagtaggaatgggcctctgtgtaaaacttcaatgcccccttatttttcccacaatgaaagagatgtcttggaagaactttcaaggcttcttgcccgcactctttcctggcctgtcttaggatcccgcagaccagcctctacgcttctgttcatgctgttccactgcctggccctccctttccccactcactacttggagaataatcattcaagagcaaataaaacatcccctctatctttccaagacttctttcaagtaaacaattactccctaatctacttctccataattttatttaaacttctctgctagttattatcatattatgggttaagtatagcaattgatccccaaagagagcgaattttctggggcaaaggactctgtgggtcttatttcggtctgtgacttctagcccaatgcctggccccaattacactgtggcctatggtggcccctagctcttgctgtgggtttaattgtgggtggatgctcatagctgtgacttttcccagactcatctgtttctttcctggtgagactttgccccaagggctgctgtgagccaagcgtcttccgcagtcttccctccctgtgttttgagctgttccccagcctctcatgacagtgctgcatttatctcactgttagtcagtattctgaatctgcaatcaccaccaaaacaaatgcaccatctaaattactgttatcatctaagaacttaagtttatatgcaacaaaggtatatgtgtatgtgtcaaaaagtatccctggagaagcaggacttttgatcctgccagactaaacaaattctttgcactgaaggtgttatgagaaatcatgaaatcccaccacctacaaggttttcttggattttcaggatatcggtattggccaccacttcttcaagagcctcacacgttgcctgctatgtcattcggatgctcttgacccaaaagtgagactctagggctaaataaacagcatgcatatcccaaagcacaaacatgaattttattagtagttaaaatgaccacaatggagatttgaactttaacagtttcttctcatttcagacaaagtagatattaatgataaatatctaggtatacatttacatagttaacatgtaaataatatgtgagtaaaatagcactaacctccaagaagaaaataatacccacaccttcagcgtgcctccttctagagagattcatagttacaacttacatctgggcatatatcctttcagatgtttttctgttagaggccatatcagacagcaaaattcataaggtcttatagttagtaagtgtatttccactgatgtagaactccggtctcttgagtcttcagaggtgggctccttgtattttatggggctctcatcttcagggtgctgccttcctccccatggtcacgattctggctcttcacatccacagttcaggagcagaaatgggggaaagaagacaggagtatcctttcctttaggaccccacccagaagttgcacacatcactgttacatccctgtggcctagactggctcgtagtggcaccagagctgcgagggaggctggggattgtagtcttttgtgacaactatgaccctaggtgaaccttgggcattctcttaataaagaaaaaaaggcatgtagtggcccattcagggtgtgcagtgagtagggggctctccttgtgaggaggagtctcttaccagtgaaatcgtgtagcattgtctgcacatggtagtgaacaaaaacccaacttgtattcatttcattacctgtacattccctgcaaagagtgcagcctcttattacctgcccccaggtgacagcccccactgcccactttggcacaccactgatgggcgggaaggtgtaggcacaagtctgctctatgtcactttgctgaccactttatgacagcttatcatttgacacagactgacttttttccttgccagtaagcagttcttcacactggaatgaggaggagctactgtgaattccatggtagaggaataccatgacgtggcgaaccaatcccctattcctagaaaatcaggttgcttccaagtttgtactaatgtaaactgtaatgaacatctgtgtagttaaatctcacctacccccttaatcacttcttgagagtgcattcttagaagtgaaatagctagaccaaatgcatgcttttaagactctcaatacgcaaaccagaatttatcttaatcactctaaatgtcagtgacagtttctgttcgtggacttgattttttattatcacttcatgcatctgctcctcatgacatttggatgctcctaggctttcatttcctaatatcacaggttgtttttctttttcttccagacagttttcattttctcattagtaaccatactctttcttttgccgcttaatatcatttcctttctaaccatctgcttctttcagctgccgcccgttcctcttggctggttcgagtacagtctccctcggccttcacctcaccatatgctgggagcttgttgactcaaggcatgatatttcatgtcctggaagcaacatatctcatgagcctgcaaagatcacggctgtgcatttttgcgcagcaactctcgtctgccattatccatggatgaaccatattcttctacttctttctcacctctagtggaagatatagcccatcacctaaaagtgctgctattttagtttcagtgagtttatagacttaaaactctgtttcaggtgtctcgtttagttttcttaattgtattttatctctcagccttccacaccatcaatactgtcttttacaacttcaccagggcctctcggcttcggcactggtcacatgtggggcagcatacctctctgttccagggagccggcctgtgcattgcagggtatttgccagcctccctggactctacccactggatgccagtagcaccttctgccacagccatgacaaccaaaaatgtccccagacattgccgcttgtccccctgggtgttaaaattgccctggttgagaccattggactagattgtccttcgaaggacatattaccaaacatataaaccaagaccacaggattatctgaaggaggttggcacgtcagggacaaagcccctttagaaggcagtaacagggacggccatgtcccaggtttccctagatgtggatggcaaattaggagcagagagaattctagatgagcatcagtgatgccccagttggttccatcacagtgactttgggaagggacaggcaggcccagtcatatggagcagccttgacagctgtcttctgtggggcacagcacagtggccggcctcgtgatgccagtctgtggagtaggcagcatcaccagcttcactcctgagggatgtgtgctcaccgggccccgtggccccccacaggaggaggtgcatcagcaaggctattcctgaatctcttttgccctaacgctttgttcagacagcacctcatcctgcctctttaatgcgggtttctaatctctcaaatgcaaagcccctcctgtcttttgcaaggagagcctggagacaatgcagtgccacataaatacagctaattagccatcaactctatcccctctttgcacagcctcagcctcagctgcagccgaagtcttctgaacagctcctgggggattcagacacccgcactaccgttttctttgaaattcctaagaatcaacacaaagaatcatttctcgctggctttttacagttaactggagtttttgaatacccatcacctctatccttccacctttaaccccccaaaagctggaagtggccatgaaacactgtaaaggcaaattatgtaataactctgctgttcaaagcaagccaagcaagagtggcagacggtggatggacttgggtttttattgttgctttttaaagtacatagtgctggctgcagcttaattaaaccaaaccctgcttgagagaacattctctgacagtttacctacttagagccatcttctcttcctacattttgcaatgtgtgacttcccctgagaggaaagagtgggatcttaaaatcagaatgtttccctgatgctgcagatctgctacctttatcttgcagcatctctggtctgttgtttatttcactgaaatatcttaaaaaatgaaagtgagcctgcacatatgtaatgactgtgatgctccctaattagtagagaaatctaggtgatagaggtgcattccgctggtgaagccagccttttctgtttatgttctgaagatacgactcagcagtaaaaggtcttttctgcacacaaacttgattggcggagactgtatgaagcctgtgacaggtggaaagaggagctgtgtattttagcacttctcctgaaatggaaatccttctccatactccctgactgctccttgttggtgtctcctcagtacccagcccagtgcattggagatcagagactagggcagttgcaggatggctcacagagaagagtcttgtaaattgtcctgtaattcttctcattcattagggggcttttatgaatgtgataattagagtactcctgtgactctctataacttaaagaaccccatgtttacaaagtctttttttttttttaatatagtatgttgacatctttactttcaggggtttttttgttttgttttttgcttttgagacagtcttgctctgtcacacaggctggagtgcaatggcgccatcttggcccactgcaaactccacctcctggattcaagtgattctcctgcctcagtctcctgagtagctggaattacaggtgtgcgccaccacacccagctgatttttgtatttttgtagaggtggggtttcaccacgttggccaggctggtctcaaactcctgacctcaagcgatctgcctgcctcagcctcccaaagtgctcggattatgggcatgagccactgtgcccagcctactttcaggtttttatccctaagttacgtctttctcttcatataaggagcaaatggcttccactctttcattctcaaacccaactgagatagaactcttttaaatagaccgggtgcggtggctcatgcctgtaatcccagcactctgggaggccgaggtgggtggatcacttgaggtcaggagttcaagaccagccaggccaacatggcgaaaccccgtctctactaaaaatacaaaaattagctgggtgtgatggagcacacctgtaatcccagctactcaggaggctgaggcaggagaattgctccaacccaggaggcagaggttgcagtgagccaagattgtgccactgcactccagcctgggtgacagagtgagactctgtctcaaaaaaaaaaaaaaaaaaaaaaaaaaaaatcttttaaatagaatttaagccctgcatggaagcaaaagtatttaaagcaaatccaaagaaaggcttttttccttttctttctttgtaacatacacattgagcacagccccacgcatatgttatttccttcctaagcagacctttttttacaggggccattatgtatgctctgtgccgatggtgaccatatcaaaaagcatcatgtctaaatttcagcagtcccttaaccttctatcttgggaagcttgatatcctcttttttttccaaaaatttttgagcattaccttcttaatgaaagaatacatattttcaattctatacagttttagaaatggaatgacagaaactgttggctgattttttatggatattagtcatgcagttgtatatttgaagccagtaaagaaaagtgctgatacattattgggtgaagcactatttggagtggcaaaaaatcaatctattggtttgttctatgatctatgtacactcactgctttgctaccagcctgtctccaacagagctctaattctcaattactcagttttcaaacactctggttatagccaccttaatccttagctttatgaactctaaatatgtgtgtaaaattagaaatttctatgaacaagacaattcataagaggaggttcagtattacactagtgatatatcctttggtctgttttcctgttcaacagcatgtgaatgacttgcacaaagtgtaatttgaacattgaagtaatatctgtaagactcaagggatactagaacttttgcaaattttattcgttaaaatataacagatgaaaattaacatgttgcacagaattgtggaacatttatgtaactctcaaacataaggagtaaaattctgaggaggaagggatattttcattgaaaatttcccccaagctggaacaagatgaaacccagcaaaaaagcttttttaaaaccacaaatgcctctgtcttcgtgctatttctctcactttctctattctgcttaatttttaaactgcaacctgaggagtgaagatgtaaacacacacacacacacacacacacacacacacacacatatgtggtcgtcatgcagataacataataaaaagtccttttctggcattgccaccactgctgtcctggaaatactttgtcttcatgtgctctttattatatagaaaattctctctcctgacttgatgacattttacttctttatgtattctttgcatatttcaagctcttaaagagtttttggtagtaggttctcaagatatagtccaaaacgaacacagtttgcacaagatttgtaagtttagtcttgtgttcttcagggctgaatcactgtgtggtcactgcttcaattatgttacagattaagccacttgcttgccttctgataatgtcccatttttgtagatattttaggatagaagcaccttatatttaaatttgtaaatcaagtatttctactttggtgcaagagttgtatatcccatgatttttcttgaatcttcacattcgagcctcaaaagtttgcatgtgcagaattgtctcacctacatcagtctgatcctaacttcaccattgccctactaccttgttgatgttgatgagctagacaaaataatatcaagcatgttaacccaagtcttacagaatacgtccagtcatgttacagctgatggaaatctatttttaatgggcttttccccctattaacttatgatacttttctccctattaacttaataaaagtttgaataaagtacccagataaaggtctggcagatacatttactggctttgaaatagtcctttttcttcaatatcaacgtgctaaaatagccaagaatcccctttgaactccatctccagttgccatcaaagattatctgtgttcacatcagttgtccttttattccttcagattctctctgtagccattaagaaaggattgtaataaaagatatttgagagctacatagatgacatgtcagagcctgaggaaaattttctacggacttaaccatttatcctgctttattgcacagaagttagaaaaggagaacaagatgaaacccagcaaaagataacatggctactttttcctcttttttgtaacgagcatgcaaatattacttctctgtacctcttgctgttaggttagctcttacataaaaggaaaatctatccatgttgagttggaagtttcacatttttatttttctgaattttatccatttttatatgaaaataattgctttaaatttttaaggagacaagatataaaatgaaataaaagaaataatttgccatttcttgttactctagcagatagattcactaccccaagctggtctcctttgagaggccaatattgctactgctttgtcattgaaactggcaaacctacagaatgactactgtctttttctagtgcccactttctattcagtgcagcaagccaggatcaaataatgaactaggagcaatgtgacggggctagttcacttccttctttttttaatttaaaggagatgtattggttttattgataggcagttcacaggtgcaaagtcatctttgaatagttaggaagtggctttggttaaaaggacaggaagcttcccacactgagtgtccttgttataaagttaaaattgagtgacatgttcattgaaaatgacctttaatgggatgtcattcatctctgagctttacccttgacttaaactaagctgtgtcattattgaggaaaagaagacatgcagtttagcttatttcaagaaataaataatgaagtttttgaaattatttgtgacagcagccatctctgtctacttttctatttttatgttgcaaggataaaaagtaagcatgtattttcttgcagtaaaactttcagaattaaggaacttacattcagaaatatggttttgtttttcatatttatacacacacacatttatatacatgcacatatatgtatgtacataaaatatctgtaagtacatttagcatatgtcatttacactgtatttttaagtaatcattaataaacactaataagctaaataccttcatgttctcacactaaaattataaagaaattgtttattttactgtgatttttctcagaactgaatatgtgtatttttttctaaaagcatagcatctttcatttctaactttattatagtcattattttcacaaaagacaaagcctttgtgtaatcaaagatcagaatcattattttaatttttagtgttttttaaattgttaagagtaatagaacaggaagtttgaaatgtagaaaaaaaagacattgtattagtaaatttttatgataattacaggtattttatgatgcattttagttggaataatgtgcaaatcccatactactttgcatcctgctttgctcatttaacttttattgttataatttgtccaagttgctacatagtcttcataagtatcattcctaatggttgactggtattcctttgtgcgtgtaagccataatttctaaattatgggtaattaattttgaattacacattatcctattattcattagattcaattcaaagcaaacttaactatcatgattgctccaagatctagatttgcctgtagctcatgtcattgtgtctaatagactatagcagttttctctcttttatcgattctgtcatttgttagatgcaacaatagaacccaatttgtatacatgtaacaaattatataggagtttatcacattaataatgatgcataagaagtgagggcatttgttgttggtaactattatgcaacactggtagtatgcttactataaaatatgctaccttgatctttatccttcttccaaactgctcaatcaaaattaattcatctcttccccttccttcctacagcaacatgttagagtcgttcttggagagcttatccacttcttctgccagttacattctcttgcgtgcatacaccaacccaccctccaccctcgatcccaagctctcgctgggcaggaatggcttccacttttagtgatccctggactgctgatgcaatagcctccgtgcagtctatgttcagcaaatgtgatagcactctgcttttgttttcgcctgtaatgtttgaggaaggcaaagttgggaagcataaagatgttaaagatgtttgctctcttgtttttcttccgccagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaaggtatggccagttcattacaataaaaagaaatctggagttatgagcaactcctcagaaaacaatataagtccagttttgagaaatgcaactctaataaagatttctaggatgttagagaaaaaaaaattatattgaactgttttacttggaaatgtattccttttaaaaattgatcttaaaggctcaggagtccttgaagatcactacaaacagagaggactagatgtggttatagtcactgaaaatgctgtgaaatgtttttcattctattcttgtagctgagctactttgttttcagtgcagattgtgacaggttgatattttttcaaagcactatcattaactggtaagagagttaatgctcaaatacctgtgtaaaatcccatgtgaacacttaaaatgtaccgggtcccagccccaaaagaaaagaaaagaaaagaaaagaaccccttatgtttttaaagcatgggcttacagagaagaatagtattgttagttgactttggcaaacatgttaaagtaaatttatgattggagaggagattagaacagcctttttctgagtccttataaactaacactgttcctgattgattttcataacactcattttgggcaaaaagagattcaccatagtaattcattcctgagtctggtcaccaatgcgctaatttgctttgttgcataaaaaagtttgacctattagaagaatgagggcaggtggggagaataccaagagagaaagtttgcacttctgccatgcatgttccattaatctcatatcaaatcctggggtgtgggatattcatcaatcactcctttcctttacatttattttcatccaaaccatgttaacatatacacacggacatcagaagctcaaggccatagatgtcacacactcaccacaccctggcctcaacattatgtaactacaccctcccctttgcttattcctttggatgtctgccttcttgtcattctctctgtcatcctttgtttccattactacagtccaagctacagaacttccttctttctcaagtgtgccatcccagctcatgggtgccaggccctgacaattcttcctacagagctagccgctgccccatgccagacccacttcttctcctaagagtcttaggaatgggcataattagcccttttctacaccctgcccatagacagccctagagttgtacacatctcttgcttgcaaccagagattggtagagaaaagcttcaaaagcagagttgcaccaggtagacatcccaagcatagtcttacaggagcaggaaagagatactaatggaaatcacttcctggaatgaggacttacatcttatgtctctctaaatttagcgtgatctaggaagctttgactcaaatcacagttcaaaccgaggctccaccttttctgagcatggtgagcctgggcaaactacagcatatcactgtgtctcagatgtgtcatctgcagagaaaatcagggctgcctcactctacatcatgcacatcagtcacaacgctggatgcaaggatggtagcaagatgtgataggccaagacactgtatgtgcccatgaccactcacgtgctcatgagctaaaagaccctacccagctcccctgccttgcagcactaactagatgggtacaggaaaatgggctctgggcttcaggcatcagcctgactaagacacaaagatctagattgtggcaaatcaggtgtgccatcttaagatgttgtttctctctctctctctctctctgtctctctctctcttcctccctccctctgtctctctcttctttctctcttcctttatttttatcaattatcattttccttgagaaatacttatttcattatcatgtaataataacaacttaaaagtggagaaatatctttggcctctagaagattttgaatgtaagacttcaacctttcaactctatattccatatgttcaaaaagtagaaataggaaaaatatgtaaaagaacaaactcaagcttctagaattaaaatataatgcctcatttacaccatggaatactatgcatccataaaaaaggatgagttcatgtccttagcagggacatggatggagctggaaaccatcattctcagcaaactaaaacaggaacagaaaaccaaataccacatgttctcactcgtaagtgggaattgaacaatgagaacacatggaaacagggaggagaacatcacacaccggggcctggcaggggtggggggctaggagagggatagcattaggagaaatacctaatgtagataacggttgatgggtgcagcaaaccaccatggtatgtgtatacctgtgtaacaaacctgcacattctgcacgtgtatcccagaacttaaagtataataaatataatataatataatgcctgaacaaaaattatgtggaatgggattaacagcagattataagattacagaataaaagattagtgaacttgaagacagcaataggaatgatccaaaatgaaacacaaagaaaaaagaagaaaaaatgaacagtgcatcagtgagcttcaagtgacctcatatatgtgtaaacggagtccccaaatgagagaagaaagagaacagaaaaaaatattttaaaaaataatggttgaaaattttccaaatttaatgaaaactataaactcacagatctaagcagctcaaggagccccaggcacagaaaacaggaagaaaaaataccaaggtatattttaatcagattgctcaaaattagtaacaaagaaaaaaaatcctaaaagcggacagataaaaaagacatgttaaagtacaaagaactgcgccacatctaaacaccaaatttaaggatcagtggcactaatcattcattcatacaatgattccttctgagctgctaagactgtcctctagaagagaatttagtctgtacgccccttatgggcagaccaagccccatttatctttctgtcccactgactacccctgtgattggctgagcgaaaaaattcaaatgtgattatttttctcaattactatccatgtctatatgtcttccttgagggttgcagtgttttctatttattaatgtctactagtcaataagaatttggtagcacatattatgttccaggccatcctcagatggtcacattttatgatattttgattctttggttcagctggcaatatactgtcaatacaatgtaaaattgatagaaagaagttatgagagaaccattttcttttcagtgttcagactgaacaatgttttgcaggttgcagagctcagtagcaaagggccagttctgcggttcctactgtgctgagatttccgtgtaagtttgcaggttccgtatctcaggggcaaccagatcagctgcaagaactgcttagatatgtgtggatctttaggtgtgtagagtaagaaaatgacaagtttaaaaagcatttactatttttatattttaagagtctcttctactttacataatgggaattatggaagaagtatgataattattcttaatattttctggcaatagcctcttactgtttccagcacaataaatctgtgcattagttcagcacagttattccacatatccagagcgcatttctttggtaaatttctctactgctaagcgagtagagaataataggaaaatggcagaaaggtctagaatagccaaagtcagcataacagaagctgttctgttttagacaaagcttaacaatgacgaccatagatttccctgtccttatcggaaatcaacatgttaaaaaatgcaagaactggccaggtgttgtggctcacgcctgtaatcccaacactttgggaggctgaggtggatggatcatgaggtcaagagatcaagatcatcctggccctgtctctattaaaaatacaaaaattagctgggcatggtggcgtgtgcctgtagtcccagctactcaggaggctgaggcaggagaatcccttgaacctgggaggcggagattgcagtgagccaggatcacgccactgcactccagcctggtgacagagtgagactccatctcaaaaaaaaaaaaaaaaaagcaagaactcttgtaagcagacacatagaccatcataaggagggagagtagatactgtggtggcaaagagaaaagacagaggagttaggaaaactgaatataagaatgcaagaaagaaaaactgtcagagaccatttaatgtcatggctgttccatctactctgcgagtcataaagttggccctctgtcatcaagaaaatgttattactagtaattttagaagacagaaagcatttgcaaaagatttccatcccaatggttaaagtaggattttgcctcttaggatgtcagtcttgcttatgagaagcgctgcttccctaataattctagataatgggatagttctcaggcatgacgagaggctgataagtaatatttgggagtaattataaatatgtacatacatatataaacatttcttatcaaaatacaagtacacatatagggatcagtcacattatcatcatcttttgtataatatactattttgccatgtttcatgggaagagcaagtggacaattcttagggaagatttcagaagattatcatgaagccaagcaatgatgaattattataatttcaagaagacaaaggatgagttgtccagaaaccaaacagataaatccttacttttaaaaagatgatttcagaaaaaagtattgaattattaaaagattgagttaggatacacaacagcatatagtgttaccatctgaaatctagaattcaaagaatgcatttttatagcaactgttaaaatttagtggtatttctttagtgttcttaactttttatgacccaacaaaaacagaaatgtagaggtaaaatactataattttgcatggagacagctttttatagacctcatcatctaaaacaataaattctctttataggaagatcatgcacactctttttctgtgacaaattgactagcaaactagatattcataatggccctaaacactttttaaactttaaaacactcattacttggtttatgagcatcagaaaaacataatgttattatggcagaagcaaagtgataaatgtttttcattgccaacatggacttcagttacctttttctcatttatagtacagtgattttgtttgttgcagactattaaaacaattgggtatagtgctttgaagatttccaaaatgtgaacgaatgttcttttaactcccgtttatggattatttctattgtacttgagctttctgaaaacccaggatttgaactgtagaaatatatctgtacttgctatgaagtcaaacattttaaaatctttgtacactcagttttcctcctaaagtgtgactcttttcaaagcatctgttatttgccatttattttaaaaataagacagaacaaagagagacttggatgttaatctattaatatttaatgagctaacgtaatagcaacatggacttagtgaagaaggaaacagaatctctggccgtgtgccccaaatgaataaaaaatgcaagagaactgggaaattagagacttgtccttagagagagagataacagccttgagaaagactgactttagcatagcttagtaggtagtgtatcatgtaaaagtgaaccagggcagattagtggagtctatcaaacgcaagttaagaatcatggtttattgtctaagacaaagtgacttgtctttgttctagttaatggtgtgatgccaagctttagatttaaatgtaaagaaacagagttttgaaagactgtgatgaaaatacaacgcgaagcatcgtgcctcatcaattagaaactaggccagtataaacacagaggtgatcagagcaccctgtctagtcagcagtgtcctggagatggtacactcagacacaggcaatgaccagtctgttgcaggacaagaacagacccactctgtggagcaggagatgggaggagcatggccacaaccaggtcattggtcctaatcacaggactcagtgatttcttccctgcaagacccgggaagcagcacggatagcaaagaccacatctgtgttgcaaatgccacatgcatccaaatcgataaatggagaaaacccatttttaatagttttgcattaattttagtactgtcattggatgatctgatttctaaagttctaaattacagaactttaaagttgtagaaacagctgaaccagagggatttccacttccagccaagatgccaagatggaatgacaaggttcaaatttacctttcttcaaggaaaaacaacagcaacaaagaaaagacatatgtgaaacattggggttttttagtaagacactagacattagtcagcaaaggacaatgatctctgaaagacaggaaacaaaagaaggtgagtcctctgattgtctcagctcaccaccttgagagagagtttccaagccatggtatgaagattgagggaccagggggatctcggtagactcactgtgttcaggagatggatcggggaatcgggagatatcaaagtgatcagagttcataggacaaaatatcaaagaggagagagccacacatagaaccctagagatgtgcagaggactccccttaaatattcaacagagaactctcagcacatgtgtctgaggcaaatacccaaggctgggaaagaaacacctgaaattattagggagaatgaaatcggacactcatgtgggggtgcatatagtgcatgttctcaagagccagagaagaaaatctcataatccatgggccactggggagaatagtcagtagggtcttgcctcagtacagaggaataattagccctggactaaccatgctctagtctttcctatcaaatcttaaattagacccaaaaggatcaacagtttccaagtaaattaactgcatcctagaacaaagctttaagatacccgtaggaatacaaaaatattcagcacccaacaaattaaaattgagaatgtctggcatacaactaaaaactatcctgcaagtaaatagaaaatgcaatccataataaggagaaaaataaataaatgaaaactaagaactgacagatgttaaaattatcaaataagcaattattataacagtattccatgtgttcaaaacattttaaaagttacacatggaaaatgtataaaagactcaaataaaacctctagagtctgaaatgcagtgtctgaaatgaaaaatacatggggtgtgattaacagcagtttagacattgcagaggaaaagatcagtgaacttgaagacaatagaagctatccagcatgaaacacagaaagaaaaaagaaaggtacagatcatctgtgggtgtcaagtggcacccgctatatgtagacagagtaccctaatgagaggacagagaaaggaggaagagaataggaaaaaatttttgaaaaaataatgactgaaaatttcccaaatttaatgaaactcatacactcacagatcaaagcagcttaaacagcctcaagcacaaggaacatgaagaaataaaaccaaggtgcatcaaaatcaaactgctcaaagtcagcaataaaaagaaaatcttcaaagcatccagaggaagaaaagacatgttccacacaagataaggaagaccgcagatttcttatcagcaacaacgccagtgagaagacagggaggcagcatctataaagcactaaaaaaaaaaagaaaaaaaaggctgaacttactgggctcaatcatatattaaattgacttttagtttggtgtctagcagacacagcctatccctaaagcagtggtccccaacatttttggcaccaggaaccagtttcgtggaagacaatttttccgtggatccaatggggcgaggaatagttttggaatgaaactgttccacttcagatcatcaggaattaaagtctcatgaggagcatgcaacctagatccctcacatgcacagttcacaatagggtttgtgctcctatgagaatcaaatgctgctgccgatctgacaggaggcagaactcaggcggtaatgctcactcacctaccactcaactcctgctgtacggcccagttcctaacaggccacaatactggtctgcggcccgggggttggggccttctgccctaatgggaagtcctagtccaccaattgcactgagagcacttgtaaaactacctgtacatgaaacccattttcagcccagtttaagacatgggctaacctgtcacctgagcagtcaacttcacagaggaattctaacacaaaaacttagatgaaattgacacagcatgatcacagcgctatggtggctccggacatgccacctcagtattctgttcttcagtcctggagacaaacaagtattcataagccctgagtcaaaggttccagcaccacaccaggggcctcagaatgaagggatttgtttggctttagaacacactcccaaaggagcatgtaaccattttatttatctatctatctatttattttttttgagacagagtttcgttctgtcacccaggctggtgtgcagtggtgggatcttggctcactgcaacctctgcctccctggttcaagggattctcctgcctcagtctcccgaggagctggtattacaggagcctgggccaagcccagctaatttttgtatttttagtagagatggagtttcactatattggccaggctggtctcgaactcctggcctcaagtgatccgccctccttggcctccgaaagtgctcggattacaggcgtgagccactgtgcccagctgtgtaaccattttaaaccctagcagtcgttttgtggaagtggttagaattttttggccctgttagtaatttcagtggctttgatcctttttgcatagttcccctctgtgcagaatgctgttgttaaatcatcagacttgatgctgtaaatcaacctgacatcttttttcatcaattaaacagtttaaaatctccaactgtgggccaaaaaagacaagacaattgagataaatagatgaatatgactcggtctcttcccttacaatatggtaaacatgtaaacaaagtgtctacaaaatccattacagatgctgctatagcagtatgtgccggcacagggccatccatgaggttgtttttgcaatgaagtggaggaggtgaggaagcacacttccagcattgcttgttaaagccttagggctagggttccatgattgagagtttattttagtacactagcatagtatttaggagagtgctaactgctataacaaagagacccccacataggcaaatacccaagcgagataagttattttctcctgatgtcacagttaagagcaggttaaggcagaagttcccctccacgaattaattcacccaggctgatagctgttctgccatcttcaatgtgtgacttagaggactgctgttgtcatcactatccaccagcaggaagcaaaaacaacagcagcaaaaacacaagttcataacaacatatgttctcttatgaaagtcaagatcacagctctatgtcccttctcataggctgggctcagctcctagcctctagtacacagatgtcttcataaactcatcccctaccagcaatcaataataatttgcagtaaggtcatctaaatccagatccaagaaaaataagattctgtcttctgaagaatttgctaatatattagatttatactagactattagaaaataaaacacactatcttagtaaaatataattgcactgtagttaacttactacctaagacttcagcaaaaactttgccttatagttgcaagactgaaagggcttatcaatagggcccctccaaactgtgccctaaagatacatttcagatttctccctccccatatccaaaagaaagaaattgcttaatattccaaaaatggcatgttttctggttccaaaagaaaaacatgaagtccagatcacttccacccatgaggcactatgtttaaagagaaaaaaaaatatgtagatgaaaagttttctgacttagtgcctattaacttagaacaagaaacaactgaattaattttattttcctaaattggataaaaatatcaccaaatcttccatgtctgtgaatgtagtggctcagagcctgcacctctcaaccaccactcttgtttagagggtagtagtgtgagcagtttcattttggacctccactgtggtcagtttccccttctcaatggtgtattcatgcatcactgttactaaggaacacacaggggtctcagaataagatctgaggcagcctgagtctcataccatgcactgtctatcatttaacagggttgtatttagttccccagaaggcatttctagataccagttgcacacaaggatgacatctctaatatttgattacatccacagtaaaaacaaacaaaaaaccttttcatgttcagaaagtttccttttttaaagaaattttttaattgaaaattactaatccttgagatagcttgagagttggggaatgagtatgcttcttccaatctcttcagtgaatgcttcctctgggtcacttttacttgagcttgaccttctttgtttgttcttactacaaaaacacatctaaatgttttccccccaggaaattatcttgcctgtacattaatattttgagcattgcataaacatatgggctaaaattcagtctttgccctaacttgacttagatttttaaaattcagacaaagaaacaacagcaacaaaaaacactaaacatgcaatagttgccattgccttaaccaaaatttgtgcttattaaattgatttatttctttactaacagaatggaattcttcactagtcatcttgactagagataccagttttcaaaatagatttagaaattttgaaaacaaagttatgtaaatccataacataactctggatgtgaagagccaacacctgacttctatatccattgcagagtaaccccatcatttgaaggaccttgtgctaataccaccccattatttcataaatcctagagcaggaaccaagcacagttcctttccagctgggagaatctggtaattcaaataataatccattctagacagaataatctggggcatacagcaaaagccatgccgtttcctaatattttatgcattgtttttataataaactactggtaaaaataagactaactaaataagcttttcagtgcaggaggtgtttcctaccctcttgtcatgggaatgagacaccctggtattgtaaataaattcagaaacaaatttaggaatcacatgccatttgtaccaaattcattgtatgtatttttcattggaagagtttggttttaaaatttgactttaccttgttaaaagaaaaactgaggatatggctaatttgataaagaaaattaatgcacaaatgattatttaactgaaaatcatttaattgcagactatacttctaacacaagagtacttttagaatatagagaattattcaacaaattcagaattttagcactataatggattcagcctcagaagagaatatttagtacttaaaggaaaacactgtcattgtaatttagcaaattattaggatttcaatgaggaaaagctagttaaattatagtattaatctcctttcaggaacaaataggccttcacagaatcacctcagtttcagcaagggggaactttttggaaaaattatgaccatcagttgtatttatagctgggctgggatttgtaaaagtcaaatccctggaaatccacattagaatgagacagtctggccttaaagggttaaaagatactgacttctccttgttaccaaattctcaatacatacaactaggaatttcatgggacacaaacttgtgtgcaagtatctttgttaatttacttcaggttcatctctgagccctcatttgcctgatgccaacaaatagaaaggaaagaaatgtgaatctcaacatttctaggcaaacccagtcaaattcagctgtttcccagtcccgtcagtctgcaagcgtggccacattttacgttcctcaccttcatcctctcctgcccctgcagttggtgctaaacttgggggtcttacaggtatagtcccgcacagaggatgggggtgtggtgtccatttctcagtgtagaatcaactctgttctatgcagcctcttctccaggacacacatggacgtggtgattggtgattggaccatctccggtccagggtcctgtcttggcccacacctgcctccatcccttttgagctcccctgaaatccaaccacctcctctccttaatccagagaggcaccgtctgctcccaccatgtgctccactgatgtgtctcctcccttctggccaagtaacccctctgcagccctgggtccttcgtttctcctcctcagctaacctacacaccccacccattcaagaacaccctcagcagctaccccttgccacactggggctacacgaatcctcccagccctccccagcccagcaagccatgtcactgttcctgccctgtggctgccattctgggatggtacaggagacttcactgagtcttgctcagccactgcagtcatcctagaagagcagccaaactgtggagtttccattctcccatcttcaagggggatgtcatcctcagtcccccttatccatggaggggggcttgtccaggaggactccagggatcagctggcagcccccacagtgctgccgcatctcttgcttcctctccaaactgcatcctttctttccccagcatggaggctctgtattgactagggagagggcaaattattttctccctgttccaattctctttcaaatatattccatcttttacctggatctgtgccctctagccttagacaatacatgtttgctgcttctctgtcccatgctgacaacacttctttgggtcaaataatggcctgagcctctccccaggaagaggagtgcaaaagctttgtcccatcacctgcaggaagggatcctttcctgacacaagcgagaaattccaattagacatgacttcttgtattggacctactaaatctggacaaattggtctcatttactgtgataacattggaaatcttctatatacacacaaacatacacataactaacctttcaaaatgaaagctattttctatgtctcaataataaaaatatcaaatctattgtctggttatcctttctttcttagggaaaacacatcactgctcaccagtttctcgtatcaaaaatgtgtttctatatcatccacatttttggtcctaagtagccttttttgttattgttgctctcaaatcaattcccagcaaagctgaaggattcccattattctccaaataccaaatcaccttttcatccagcattggggggtgtggctagtacctggacttctaaggacaaagttatgtccatttattcttggctcatttcagatgtggccaggttctcctctgtctgtgtctggaaggatggagggaaaggctaggtcatatctgggagactgagcatggaggattaaaggagaggggatgagatgatggtagagggggtataatgtcagcagcataaaaaaagacagatatgaagtaacaggacccagagtcaagggcacaggtgtctcctgtgggcaggttattgaatatctttgtgcctaaatttccccctgtataaaataaaaatgctgacctccctggagtttcaagaattagaagagatctcaaatatataagccagtcgcatggggcctgcaaagaagtggtatggtggaagagatgaactcatcttccccagttcatctcttccccaccaggctgagggcacttgcatcagcctgcctaagttgccaggagtacccctgccatctcccagaaggtcaagaatatctccccgatgttgcaagttattgttgatgttccttttgcaatatgtcattgttgaccccacaccctgatttgcattctcttcctttttctagcttctctccttagttttagggaagatcccaggattaagtgggctgcataagctcagatttccaggcttttccaagctggggactggagactcagcagggcacaaggagtaggggaggcagatgtgtccacaggaagtcatgtttcagcatgtcggttaaatgcatcgatggaaattggcattgtaccaggagaaagggcttcctccctgggaggggatatcagttccggattcccacatcccaagaagcagtttgcaaacctcaatgttttgtcatgtctgacacttcctaaccttccacttctttgctccctgaaagtggagctgtcaaatagttcactgcagccaagagatgctttagtgagctttacctgctccctaccccctcaaggcttcctagagcttgaggtacaaagtagaggtgagacaaaagcatacagtgtgggttgatggtgataagaaactgtgtgaatgtgatttctaatgtaggacaggatgaagttgtttttttgatttcatatttcatgcagggctgggctgaggatgtggcaggcatggcatatgccctacgttcactgccagagggggctccctgcctgccacaggtgagagccagctctggggtgcctgcccccatgggggaaggggggtggaggtggcctggtggggggactgggtgggaaaggactggtccccaggaggaccctaccacagaatccacagcctcattgcgtgaatgtaattttcttaaatcaaaatgaaattgcaacaggtaaaacccttacatttgtgaatttttatattgtactctcttctccaggacactgtagaagagtatacatcatacatacaaatgtctgaaaacgtgggcctgcattctgttaagtgaatgggaatgctttatcatcctgatattgcaaggacattttaatatgacgcattacctgtgttccattaaggctgacgaccaccaacccaaaacaaatttcatgtcctactttataaagaagacattgaattatggccctgaacattatacagtttaaccttaatgttttttaaaaaacattttaccatgtgcactcttgcttttcaatgtcatatttacatttatccacccctgcctatttctgactagttgactctttattgttcagcaaacgacttattgacagcacgttcagcaactcacctgtgtgccccatctccaaattcaaagctgtcttgagaaatcactcccacacaacccattctcattttctactttttcagggttcttgttttatttctctttaatgtcactggccacatccgcttgtcccaaacctctgtatcttgaagcatcaagtatacgcatcacgcaaatggctttcaacttcaagtactgaaaacagtgtcacaaaagaaacctaatgtggttcactgattaaccctgaaatctttgtccccaagttgaaggcaaaaaatacagttaaaaagtttaaatgcatgtctaacgtattcaacccattctacaactaggtcttggtaattcaacctttttggctcctgtaagcagccgcctgaaaacgcaaatgtactatttgcatgcagggtttcttcctgtttctaacgcccttcgccttccctgtttttgcagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggtatgttctccctgattcacagtgtctcaagtgttaagtgaaaatattttctctaggggtaggtgtggttgaacccgtatgcatagcctatgcttacacagaagccgtgcatttattagcagcctcattttttctgctgtccttctgatttaaatccactgcactgagtcatcttttagaatttagaggaaaatgtgatgctcgttgacatttctaatccttgcaaattaaaaagaacctcaatgctcggcacaggataccgttgtctcaatcctctgaatctctgacaggctgtttgtttgtttcccatgcagtgaactgaggaattctgataggattacttttcttcccctctctattttaaatttattttggatgagaccactagccctttaatcctattcttttaagaaattatctctctttaatttggtattcaagaaatacagaggatcttttattaataaggcacaaaagaggtaatacattcacctgtctattcaacaaaactcatggcctgctttgttccaggcctgttctaggcccagagattaaatcaataagcaaaacagacagaaagccctgcccttgtggagtttacattcaagagaaggagatgttcaagaagcaaactaaacaaatgaatcacaaaatggagctgagtaaagggtaattagtgagattgcaaatttctttttaattgagatatccacataacataaaattgaccactttaaagtctaccattttagtggcatttagtatattcataatgttgtacaatcaccacctgtatcaagttttaaaacattttcatcaccccaaaggcaaacactgttcccattagcaatcactctccatcccccttctccagcccctggcaaccatcaatctgctctctgtctatggattttcctattctgggtatttggtataaatggaatcatagaacatatgacctttgtgtctgacttttttcacttagcataaggattgtgtttctttaatggtaaactagtaagttataatcatagacattcatgggacacaaagtgatgttatgatatacaggttgagggtccctaatccagaagtccaaaatcctgaaatgctgccgaatccgtaattttttgagtgccaacatgatgctccaatgagcatttccaattttgaatttttaaattagagatgcttaactggtatgtattctgccaatattcccaaatccgaaaacatctaaaatccgaaaacacttctggtcctaagcatttttggataaggggttctcaacctgaatgcatacaatgtgaactgattaaatcaagctgattaacatttcatctcttcaaataattatcttatctttggtgggaacatttgaaaatttactcttagcaattttgaaatataaaatacattattattaactgtagtcaccttgttgcataataaatctcaaaaaatctgttcttctcaagtgaaactttgcacccttccaccaacatctccccattcctcttaccttcagtctctcataaccaccattctaccttctgcttctacaaagcatgtttgtgtgtgtgtgtgagtgtgtgtgtgtgtgtgtgtgtgtgtgtgtgtgtgacagggtctcatgtgttgctcaggctggagtgcagtggcataatcttgacttactgcaacctccacctcccaagttcaaacagttctcctgcctcagcctctcgagtagctgggactacagacacgtgccaccatgcccaactaatttgtgtattttttagtggaggtggggcctcaccatgttggccaggatggtctcgaactcctgacctcaggtaatccacccacctcggcctcccaaagtgctggaattacaggcatgagccatcggcacccagcctatgcttctataaattcatttgttttagattctacatttaagtgagatcatgtggtatgtgtacatatgtaagtggctcatttcacttagcataatgtcctccaggttcatccatgttgttgtaaaggacaggattcccttcctttctgtggctgagtagtattcctttgtgtatatataccgtattttatttattcatttatccattgatggacacttagattgcttctatacattaactattgtgaataatgctggaatgaacatgagagttataaatggttctgtgacatactgataccagatcctctggatatatacccagaagtgggattactggatcatatagtaattctatatttagctttttgtagaacctatatacagtttttctaatcagtacagtagtggctgtactaatatacattcccgctaataaagtacaagggtttctctttctctgcatcctcaccaacactggtttttatctttttgataattactgttctgataggtgtgaggtgataacttattgtggtttgaatttgcattgcttagtgatattgaacctttcttcatatatgtgctagccatttgtatttcttcttttaagtaatgtctattcatatcctttgtccattttttaatcaggttatttgttttcttgctgttgaattgtttgaattctttatatatttttgatatcaacccataattatatttttggttactaataatattttctcccaatctgtaggttgtctcttcattccattattttttttctgtgcagaagctttttagtttgatgcaatcccatttgtctatcttttattttgttgcatgagcttttggagtcaaatccaaaaacattattgcccagaccagtgtcgtatagcttttcccctgttttctcctagaatttttatagtttaggtcttacatttaagtcttgagtccatttttagttgatttttctatgtaaaagtctagtttcattcttccatatgtggatatccagtttagggttgtgattttcaatgcgaggtcaagataggggtggttggaaaagtaacactagagactcaaaggagatgagacaggaagccatgcaggtatttggggggaaaagaatccagggaaaaggccctggagagggaactgggagcaggccagtgggctccaggccttcaagggaccttgtgtacctggcagggcgagtgttgggagccaaggtcagagaggccttctgatgcctccctctgtaggtgggaagatgccaaggccaaggctgattgatctcctggagaaagatgaatctactgaaacctctcagaggatgacacagtccccacaggccattggtctggctggtaggcatctggtgttagggatatcatttctgtagggtcactagtccaatgacagcatgaaatctggcagcctgaatgcagggaacagaagtcagtaggtagcatccagaggctcagcagaagggagctggaccaacccccgtggcaagggtgcaggtgatcttgggaactgggagaaattaggtgacaataggcaaagagctcaagattccattcctggggcaactggaagaccaagtgtgactccaaattgcagacaaaatgtttttatagttacatggttctttttcccctatccaaattacagatagtggtatattaagccttttatgacctgggaagcagccactttttctcctgccatttcacaatagccatcatatcctccaagaaaaaccataatatttgcagctcttcagccatttatttattcactgcaaggccaggctgcaaatctgtgtctaacagattcaccatacttgtaattcattatacagcgggaaataagcttgcaacttgctatttacacttagtttgcatttaatttaagggttatctgtgaattgtgtagatttggtatatctaaagtaggtcgttagctccaaaggtcaaggtactcttcccatatactcttttctttttttcgttgcacagttgtttcagacaggacagcactgggattcccaataaaatcctatcccttctctgaaaaatggagaaaaaaatcaatagctaatcagtctactgcctggatactaactacttggtattgtgtgtttgtgtgtgtgttttttttcttttggtggattaaaatataacaaaatagtgaactattgattggtttgacagctcctaggcatctcttctttctcaaaagccagttatctagtcttctctcggagacaggaatatttagaccactatactgcctgtgttcaacgaaacctttactatcaaatgtcaccagatgggaaatgaagccagtcatttgaaagtagaagggaaaatatctaagtcacaggctttatgaaatcaatatttttttcttgactgagaatagcagaatttgacaagaacaacattggattgtatttaagagagaggaaatgcgacttttgctaactattttactttaaatactgtacccaagtggtttttgtaggaaaatgctatacagaactttatacacagaagaaagctgcagtgactttgagtgaagaacaatgaaaggttaatcttggacctcctctcctctccatcacctctcacagaaggctagggtgacatcatatggtttcatggcattgaagatcatctgtattctggtgactccaaacaggtatctccagcatgaacctcagatcctgtgtccaactgtctgctctatcctctccactggatgtcttatgagtgtctcaaatatagcatgtccacaaccaaggtctctcccagacctgacccttccatagtattcccccagaaaatgaccagttattcttgcagagacctgggacagacaccttggcgtcttctttgactcgtatgcaatccacctcatacctaatctatcaacaaatctggttgtccttctgaattttcgcagactttaacacttctcttcatcttcattgctttctctctggtccaaaactctcatcatccctctcctggcttattcctgagcacccccttacctagtctccctgtgcttccttcaccctagatggtctcctattgcagtggcaaccagagttatcctgttgaaaccttagtcagagcacgtcactccttcacaccaaaccctcctcatctcagtgtaaaatcaagtctttgcagggcagatgtggaagctccctatgacctctccaaccccacctagtcctctggaaattaataaattttctgaggccactggttgactgtgattcctatattacatgctctgagatcctgcctcagggaatttgaacttgctgcttcctggagtctcttcctcttggcattcatgcagctcagtcctcacctcactcacgtctttcccagagaagcttttcaggccaccgtacttaaaatcttaccctcagctcctttccctgcttaattttctccacagccccaattaccttctaatatataatgtattacttattcatcttgttttatttccatctttccccactgtaaggtaagcctgttaagagcagagagttctcttatttccttgctggcatatcccatgtacctagaacaatgcccaatctgtagtagggacttaataaatatttgccagaaaaaaaatgactgaaccgaatatttcctgcttgtcgtcatcttaaaatgacctccaagtcagcaaaacattaaggaaattaaataaaacattaacttaaaaaaggggggttttctattaaaaaagccaagaatcaaacagccagtttcttttctctataaatttactagatgcatgcagacactcaggatttcagaaagaatccctttcttttccatcattggttctggattttcagtttaaaatagaattcttcgtagatcattcttttaatgagaggttgggggaagcagactccacaattgcagctaaggaatcattcatctttcttagactccattatcggggaaactctaaataggctattgaacaataatcaccctatcccatgaggtctaatgagaatcatacagtagcactagcagaatgaaacacgctttgcctctcccttggctttccatttgggttgtttccatagttatgtgtatgtctctgggaaacagcaataagtatgctatagatagatctttgtgttcttcctactggcatagaatagtagccgaggttaatgcacatccatacatttctttgcaaccttcaaaaaatgttaattatccttctgagtatggaaggtttaaaaaaggaatggtaataattagcatcagtgaaaagagcaaacaatattgtattgcttcaacagaaagtttagcaaaatgccacccatttcggcacatggacagttcctggtgtagatggcagacacttattttaggcaaatcccatcctctctgccaacaaaacaaactcaaaccaaacatttaaagcataacatgagcttgcatttactacctgccaccaccattcaaagcccaccttgcagtggcctttcctgataaaggctactccctgcacccagagctgaagtgggcagcacctatttgataagaaaccttctcacttgttttagatttccattgtgtaattttatcctcacattgtctcttatgttttttgtgtatgcgtatgtcttccccaaatgaaataataagcaagcatcaggtgatgtatttacttttatgtctgacagtgtctagcactttgctatgctcataacaagaactcggtatgtagttgctgaatgaattaactggtggataaataacacagcgtatttattcaaagagcagatctggaggaggtttggggaatccaaatagagagaggaaggggtagagggatgtctgtgtctgtctctttctacggtgtccagagaacagaggaaagaaataaagcttagatgctctctcaaatccagactctaatcaaactcattctgctgccactgtggaagaggcttgagattggaaaggaaatagtaatgctttctgtgtgtgattcaatcactgccaaaggttcctgttggcggggccaccgcatccctgcgggtactggcggagctcacagagcccctccactggctgccccgggtggtggcaacttgccacagtttccagcaggcgaaccagggctgggatgctgcaagcatcctcctagctccctgcaccctcctgaggctgaagagaaggacctatcctccgtgtcatgagcctggccctttcccagtttgccatcatcctttggcctcatccttctgtgctttgcaggactgtttccctacattctgctcccatttggatggctgcttcaccacattggggaggctgtgtaagaatcttcctttgactgacgcccccatatgttcctattctataatccacttttcacgctgggctttcttttcactttaccaactagctgagcttctgtccagccaatgccttctctccccattccaacctcaaaaggagcacaagatgggatctgactttctctggggtcagaatagggccatttcctagggggaatctgctgcttctcaaacacaggcatccaccaaccaagatggaagggaagggcgctacacagcgcccccctgtgtagtgagcattacacaactcatgttttcccacgtgaacaaaatcaggaacaaaataagggtggtttcttgcctgggagtttattattttttaagtagtaaaaatcattgctattcctttccccacatggatctttagatcatccttttcattcattctgggggttaaggaggtggggggtgggcagggggaattagggccatcctttcaagcttcctttacttaccacaatgttttaaatattcaaataatagatttgatctgcacattgtaaagactgtttccggacaaagattcctggtgatatttaaaggacgacataaaaatgttctgtctttgagtgaaaataaagactgaataaagaaaacggtgatgcccatagaattacaatactccttcctccatgccaggtctttacttagtgagaaatgttttttcctttggagaactggagtgaggggtggtgagaacagggaaaatcttcgttatatcaatactgtcctgaatgttacatataaagctttataatggaatctaggaattctaaacctggaaatactgctcttcatggaagctttgagatacctttttaaccaaaccctcaatgatgagagcatgaactggggaatgaacagatccctgcagctgtgtctccacttcaatgacaaatggttacaaatgatactcaggacatcattcctcaaagtccgtctaaattccacagtctaggattgaaacgcacctgagtcagtatcctctccatgctcagagtatcatattgcacccccactgtctgctggcgaaactgagaaacagagggctctaagaaacatttagagtcctatcagttaaaatagatacccatgtgttttcttatttttgcgtctcatgctaatggctggcacgtgacagaacgttctgggatatgggtgctccattctgggaaacagacctcttgagggtcactgatcacgtggcactgtaggcaccttctttacttgtgctcttggccctgacgaatcccacctccgtccagggaaagatacaaggctgtggaaagtccagtgcaacccaggaaggcaacgtgctgtttttagtactggaaatatgtaagttcactttattacgttgatctgaggaaattttagagacatatcttctctgcttttcaaaatatgtttcttcagacccagacagatgtcgtttttattagaacacttggaatttcaattagtattttaaaaagaaaccttatttcttagacaaagtgatttgttggagcactctctgctggtttgttttaataacttgatttcacaagccacattttagacagaaggcaagctctgtaccttggctggaactttgtatcttcagattaggtgcctatgttacagctcccatctcctaaaccccagaacctaatttcatgaatgctgcctcccttttcggtgaagccatgggttctttgttaattaacttgggacaccttttggggaattttggcagctgggtcgggaagataagaattccttaaaagggaagttataaataaattgaagagccaatcattattctattaaataagaattaatgatttgtcccttggaaatactccatgtggggaaaaagacaaaactgaaacatttccagttgattcaaattcaggacttctgcccaaaggcttagagacctcaaagagagagcaagagacggagagccgacctaactttatttggactgtttaggtgttcattttatgtctggccaaacagtttccgaagaaaagctttagaaaagaggatgcatgagaaatgaaatggctctcctcaaataccacagccaaatcttgagaatataaaaacagaaaatagacgtttgcaggataatgtttttacattgtattcccttctatgtgtggactgctatcttctctccttgttaaaaacaaaagtctcaatcaggtggaaagaaattattatttttactcttgaatactaaaaattaatggattagaaatgagtttaaacgtttaaagatgaattctttttaaaccatcctggctgatgtttgattatatttattatactggatctcaaaaaattacggagcaggcaaggacagctgtaattgggtttcagctaaaaggaaggctccaggctggtgccatcaatcagatgggccagtggtgctgcccttgggggcataaggcagttagaagagaaggaggcagacagcagggaggggacagccagcctagcaggaagggcaccgcaagcccccgggcatacaccaggggaccaggaaggagacagaagcctggagatgcagccccgccagtgtcccagtgtctgggcagcctgaggccggatatgggatgctggtctgtgacctggcatgagcagcaaccacagattctgctcctaaaccaattgcctgaagaagaaaaaagctcgtgttgttcatcctgccagactccagtcaaagggacattgagtgagagaatcaagcaattcccaacagctcctcatgaaaatgtcctgaaagttcattcaagaaaattagttgaaattcggacattgtttctctcataaccagaaagttcgtaacaatatactgtccatttgggaaacttggttttttaaagttaaaacaaaattttcctattcaatttcgtgtattataatgtacttaagcaatgtcaggtaaaatgaatggatttgaagcatagagtggcttatttcctaagcatataatagccttcaatcccaaagtgagtgtatgtttcttatcatttgatgtaggcaactgaacttcaggcagtatagcctgggctgatgcacatatatgttaatgtgcagtgtgttactttcaattaaggctcactaagactgcaacattaacattagaggttattcagtgctcaagagagatcaaaagatacaaatccctgtggtcctcaccttgagacttgaacagtttaatttattggtcagaaaggaaagttatagtgatgaaatggaaactggtggtattacattttaattgactattacctccacagactaatacccccagtgtctatgggagtgaccttattcctcttaaaatgttagaaactcactaggtttaattttccagtcaccatctcctttcttcctcagattcgaacataaaccccagtttttacttggccttcttttcccagtgatagaaatgaacagaaactttccttgttttcttttcttccttttctttatcccaagtgagtaaaccaagtgtgatatcttattgatactttgccaaggagtttcttgagttctctttactacccctcagcattttacttttcagtttcagcccatagcatgacaagcccaggacacacgcgcactctgtgggggttcctgccctctgccccttcttacccagtctgcactcccccctcccacatcactgctgccacgcttacctttgcaaggtactccagttacagactagtcagtgtttcctgatgtgaatgacacaaagtgaactctgctgcctcatttttttttttcgttttttgaaaaaaaaatttttgaagacagggtctcactttgtcactcaggctctgtcactcaggagtacagtggtacaatctcagctcactacaacctcagcctccgaggttcaaacgattctcatgcctcgggcacctgggtatctgggattacaggtgcagacgccaccatgcctgactaatttttgtattcatagtagagacaaggtgttgccaagctggccagactggtcttgaactcccggccttaagccatctgcccgcctcaacctcccagagtgctgggattacaggcatgagccactgtgcccagccctgatttttttcttagtaaaaatttttattgaggcccccaagagcctttgtgcttcttagtgcagtagatatgtctctcttccaaacttgctggaaccttccggcagcatttggcatattcacgtacctttgttcctaagataaaactttcctagtgttcttcctactcttttccttctccatttttctcccctctttggccttttcttctccactttacgtcactgctgtgtcctgggcctttttgtcctctccccctctcctctcctcccttcctcctccctcccctcccctacgcactcctcctcttccctctccatatacacactatatctaagacctctcctccattttatttcaggtcctcttcatttcttcctgcaataaacttgtataaatctgatataatttcccttctgcctgaagaaactcctttagcactttttatagtgcaagtctgatgaagataaattctctcagctttgtgtcattttgaaaatgtctttagttgcctccatccacaaaggatacctctccttagaattctgagaataatttttttcagcacttcaaagatattattctgttgtcttatggcttccattgcttttgatgagaagtcagttgttactgttgttccctgagtatgtatttttatactacctgctttcaagatgcttggtcattattgattattatatttcctctaccccatctcactttcctgtccttctgggaattcaattacatgtatattacactacatgatattgtcctgtaggtaggtcttagatcttcagtttaagatttttttattgttctttttcactttgtgctttagttttgataatttctagtaatctatctttaaactcactggtccttccatgtgctattttcaatcctttataaaggcattatataaatccttcctgtctgatattgtattttccaattctagaatttcaatttggttatgtcttatagtttccatttctctgctgaatttaaccaatttttttcatgcatgttgtccattatctcactagataatttaacaaatatatcacagataaagtccttatctacatattctaacatctatattattgtggatttgcctatgataactttattttctcttaattttcggtcatattgtcttacttctttgcaagtcttgtgatttgttattgtatgccggacgttttatgttgaaagatttgaatagactgaagttggtaattctttcctcctaaaaagcacctcatttcatctacggggttgctaaggtagagggctgagataatctaatgcatgctttaactatatctgggctttagttaaattcagcccagttgcagcccagttaaattcagtttaccactgagtgcaaatgtttcaagagcatgatcagtatttaatctaccattaggctcagaagttgagcacctgtagattccaaagatttctctatactccgtatactattgcccagttatcagttttctgagccatataagatctctttctctgtctctctgtctcttctctctctctctgtctctctgtctgtctgtctgtctctctctctcttttcctttgtttccctgtctgctgtgaagctcagctgccagctttttggatcattgtactacctatatttttcaggccttgtataattttacatccactgtctctatccatcctcaatatgtaccatttctgagttcacagcctcctttccagttggacactctctcctctgtccctacggataacattttcattataactcacttagatggctcatggcagccattttcctaccctgatggctctttcacctccttttctatctactcctaacccatcttccaagacaaattcaggccctaccctttttacaagcttctgtgagtgctctagatttatttttgccctatttacacttctttgtgttaatctgtataccccccgagtttggcacttaaggaatttaaggaatgctgtgtacaacaccataagttcatgatgactcaagtagagtagtgtcatctcctcctctaacctgatcactctttaggaacaagaacaatacctttctctatttttactttttgtgcttcttttgaaagccccaatatgcctagcattgtattaatgttgtgatgaagatacacgttgcgtagttactgttctgctagaatatgagctctgtgggaacacggacacggacagtgtcttccttctttgctactataacccccagaacggatctgttctgtcgtctagcagattcttatttttttgttgttgtttttatttttgagacggagtctcgctctgtcgcccaggctggagtgcagtggtgcgatctcggctcactgcaagcttcgcctcccaggttcacgccattctcctgccccagccccccacatagctgggactacaggcgcccgccaccacgcccggataatttgtttacattttttagtagagacggggtttcaccgtgttagccaggatggtctcgatctcctgacctcgtgatccgcccgcctcggcttcccaaagtgctgggattacaggcgtgagccaccgcgcctggcctagtagattcttattaagttgtgttgtaatgcataataggttgaagtcataatattgtggttttataaaccaaatttttattgtcatacatagatttcctaagtaatttaaatcagtttgccattataacctataccagagcatcttttataactgagacctacttaccctctactctctttccttaacttgaacacatcaccaccacaaacttataaaaatagaactacatgctttatttttactctgcaaaccaaagcagacaaaaagtcctttctaaagaacaccattcttaaagttggatgcacggtggaatcacctgagcctgacccagagccacctagatatgagtacttgtttcaaggctccctgagggatgctgaagtttgccaaggttgagaactactgagttgagtctgtaagatccatcataaataaaaattgcctgctaatcttttggaaaactgtgttcttccaatttggaaatattttataattattaaagtttaaacttaagagtatttttcctctgagatatcccatttctctgattagaaaagacaaaaaaatttgttccagaaattgctgatccaaactttatattatttatgtaatggatagttgcttctaatggaatagccaacttcagccaacattgccactaatgtcattgatccctagagtcaaaaccagcttaaattgttgcaaatactatatatagagagagtaggaatattatattttaatataatctttcacaacacacactttgatgaagacatcatgagcctcttcagttcagcaaaagtctctacctttccacttaataaagccccttatgtttgaagaccaatttaatcaagaggatgggtttaaagagctcattgtaaacattaaaatgcaaatataacactgacaattgtagaggggtctgggaaggctccagggagtctctcaattcttcaatgagggcagggtttcctgccccactcaaggtgtctaagtttctcaccattcaggatgcctacacgtgaccaaggtggttagaccacagggttggaggtgctgcttttcctggcagcaccttttcccagctccagtcttggctaacctctgggacctaagaacctgatccttcaggcagcatctggttattccctcttgcgctttggcccatggtttctttgaagctgtgtctctgtttaggtgtgggttgagtaaggaaagtatttcttcagcatttcagtgagcaagcaaaggagaagaaaaataaacagaaaatatgtaatttaatacttagagctataaccctgccttgaccattctccaaaaatgctagagtattaccactgcattttggtgaactacttttcttgaattaaagctacgtatcacttcttaaacactattctctgcttatactctcctctaccttataccaatacctggacgatttttaaaatgtgttctctttgatatatagaggggatgtgaggcagtgtttgctttgaattgcttttgaatcatggcaacaggatttttcataagctcttccctcttgtcccttccccaggccctgtcccttccccaggccctgactgacagcatgtgttgtgtgcagaataactctggggttggtatatggctgcatcaggcactgggaggagctaatcagtccccttgaagatcaaacctttggtcttgctttttggtcagattgctaatctgctgaactaaggaaacatagacagtgggagacccaaggagtaattctctggtctgccttgaatattcctaaattgacctgagaccacattctggcattagcattgccttcttctgtgacagcttgcttagcccatcagaacacgattgcaattgtatttcactctcactgagtctcgctgttggtcttggaggtgtcaacgaaaagagtcaaactctgcagaatatttgaagagatttattctgagccaaatatgagtgaccatggcccatgacacagccctcaggaggtcttcagaatatgtgcccaaagtggtcagggtgcacttggttttatacagtttagagaggcatgagacatcaattaaatacattggtttggtccagaaaggtggaacaactcaaagtgcagggggtggttggggatggcaggggtcagggtgggggaggagggagtgaggggggctgtaggtaaatttaaacattttctggttgacaattgattgagcttgtctaaaggcctgggatcaataggaaggaaatgctcaggttaagttaaaagattgtggaaggctgggcgcggtggcgcatgcctgtaatcccagcactttgggaggctgaagtgggtggataacgaggtcaagagattgagaccatcctggccaacatggtggaaccccatctctactaaaaatacaaaaattatctgggtatggtggcgtgcacctgtagtcccagctacttgggaggctgaggcaggagaatctcttaaacccaggagacggaggttgcagtgagctgagatcacaccactgcactccagcctggtgacagagtgagaccccatctgaaaaaaaaaaaaaaagataaaagattgtggagaccaaggttcttttgaagtcttataatggctgcccttagagacaatagatgacaaatgtttcctattcagacctttaaagggtgctagactctcagttaatctcttcaggatggggagggcctgcgataaaaagatctagttatgttagcagagattctttacagatgcaaattttccctcacaaaggacagctctgcaggaccatttcaaaatatggcaaagaaacatgttttggggtaaaatattttgactttcttctttgtcacataatgttatgccagagtcaaattggaaagtaaatcacgatatataggattaaataaacccatctgatgagaatttatggtttgtagggcatgactccccaaatcctttagataggaatttgggcatgttaaaaaaatcagagtttagtcctcagagggaagaggtaacagataaaaagagatagagtgggtgatgaatattggcaaggatgtttgttgaagaaaagggagtattttttttctaaagcatctccataggggaaaatagaggaattattcagtgagcttctttctgataggcaaaggactagcactcgctaaaagaatttgaatgacaaagtatcagggctcctggggataaatatttaaagtatacacatatgtgtgactgtgctactggatcaagcagtaaagttctgtgagcaacaaacaatactgagcattgcataactaagtacagtttccaaaagaactatcttaagtaggtgagtgacctcatacttataatcatggctgcatccacagttattaggcacccgtgggaaaggcccaggtgactgaatcaggttataaaatccttccagcttggcttaaagcaggacttctagcaaacctgcattttagcttcccagttgtctccaaaggccacctccacccctcgttaactcaaagcagagatggagtggaagatgtagaaatgtttagaataaaaatgaaatgcaggaaaactgcagcttagacaataactagcagtaacaagaacaaccacaaccacccctccaactggttaatctgtaacccaccagctcctaggtggcttgaaggaagctgagcgaccagcttgaactgggtgcagaaaaaacaaatcaccactgcctaaaatcccagttagtctaattagataaggaatcagtctagatagtaacagtgtgattgacaggtacacagactttcctataaatttgtttactttataactttcctttaagcattctgatgaacttttaggaaaaataactatatctccgttttgctttggcaagagacaaagggatgagtttagatggtagagctgacagggctgtagacccaggcatgaggtagggggtttaaacagctgtaggccaactctggtcttgtcttctgcagaatagataagcaatcccaagtgacccttactgcatgtgaagagtggggacagttaccggagaaggaggggagggagcgcatggaatgttctctatctcgaaggcacatcttctgcagactcctctcttctcatccttccactctgagccctgttcttcctcccggatggtgggaatcagcctctgattggttatgaagtctccaggttcaggacttttcacagtctatatgattgttatctagtctctgctcagttatgcggtgactagatgctagtctctgcctagttttctttctaaattccaaggcgtgtgagattccttattttaaacacagaaaagagggagctcaaatatgtgcataaaaatagcccgacaacttggctgaaacaagctggtatctttacttggagaaaagaaatggaaagaaatggaagggaacacaccttgccttcaccttgaccttcctataaatgcctaagaggactccatttcttccagccctccccacccccaagttccctgaagttctaaagtcatcttatcctgttgctggcatctcctgggtctggctgacccatgctggtaatctccttgagagaagatgccctgttctttcggaggatctctgtgcttccccagcatggcctgaccacacacaggctggaggatgcctgtgtcagcgtattgatagaattaatgattgcaaatcattaacagaatgtttaagagtaggggtatgcaatttatttttccttgttaactctctaaaagacttttggaaagctatgccccccaaccccacccccctcacatttttagatttaaattgttgccaggaatatagtttagtttcccgggtggcattttaaaaataaaactgacacatccctcttttaaatatgtctttaaaaatctggataccacagtggtttagtacccaacatcatcttcttcaacaatatgtgagcagattatttatcaatattagaaattctacgtcattccttttgctcctcaaacatataagctttctacctcccccgaaaattttaccctgattaatgtattttatgctttaaagtgtcttattgctcattctctttgcaaacaaaatttatacaaattaagatatattgtaaatatttcttatggtattaggctttaaattaaaactttcttacagattattactgtagttattagcagaataaaattgatcaaaataatatatcatttatcttgattaaagttattcaatataaaatgtaaaattgtattggaaatgcattcaccagatggatgagccttttttccctatccattcatatattcaaaaataatataacttattgcttgattgaacaaggttgtctcattttattctcttttttgttgtttttatagatttaaataccgagaaacattactcatatatataaggtaaagagaatagatggtctttccttatagtaatgctacttgattctttgaacttcttatgcattgatgtttaaatatctcattgggatccgtcatcaagttatttttaatgatctgttaactgtcaactttgttcagtcttccttcaatcttgttgaaggtaaagaactggaaactgccccgttgaagaaaacgatgaattgtccatcatcatggttgttcctccttaacccagacactggcattaagcaatacccttggcttcatctcagagaatgtttgccattgcagcagggagaaaattgacctggttttgtaaaacaagagaagggaacgtgtgaaagaacatgcaagcacgtttttcaggcagatcagttttgttcagagtgcataaggaggtcgagaatctgaaaatggattcccttaaaaccccaaaccctgtatccccctggcaagcctttacgcggtccccgacagcacacagggctccttttggagtctgccccaggggagcctgcccccagtggaactatagctatgagcttggcgttgttcccatgtagtcaagggttaacattagaagaatgtgcttgtctgatgaattagctcgggctttcccaagtcatttccacaaatgccatttttgagctgcagttccccagagggagctcacgtaaagagaaaagcagccaactgtgtggtatgaaacaccaggcaagatttaggggttgcatttgaagctaattaagactacagtgagaattttatgctagatcataatttcttatcttcatatagagtatcattattgggacaatgagtacagtatttaaaaattcccagggactaattaaatataaacaagtccagctttcaaaatagaagtgccacaattcattgttcataccatgaaagtctaatgtgattatttaatacagttggcaaaatatggtaatacatagttggatatttcaagggtttagtgtaattttatccttgtgtactaacttccaagatgtggaattaatttatctcctcattcattcatttgaccaatattttttgagtgcctactatgtaccagtcatagcacatcaaagtttctgctttgtggagcttacagcctagtggtgaaaatagtctcaaaaataagcaaacaggccctgtgcagtggctcacgcctgtaatctcagctctttgggaggccgaggcagacagatcacctgaggtcaggagttcgagagcagcctgcccaacatggtgaaaccccatctctactaaaaatataaaaattagccgggtgtggtagtgggtgcccatagtcccagctactccagaggctgaggcaggaaaatcacttgaatccaggaggaggaggctgcagtgagccgagattgcaccactgtactccagcctaggtgacaagaacaaaactttgtctaaaaaaaaaagagaaagaaaacaatatctactttccacttcagacatgagtaaaatagggtaagggtttagagagtgacaaggggaagggaatgttgaatggggtggtcaggaaagaagtctatgaagaggtaaatcctaagagatggacaggagccagaccttacaccatctgggcaagggagcagcaagagcaaaacccctggtgcaggagagaggttcgcaggtggcaaaaacaggaacaaggtcaatgttgttgtagctggaaaacgaggcagggaaaggtcagagatgctgatggtgagtgcgggatacctttcagcctggataaggaagttggatttttctctgagagttttggctcatgaaagcatgatcagatgtttattactaaaagtcctctccggctgctggttgaacactagacagtagataagatggaagagcagtgaggacttggattcaggagtctgggaaagagctcatgctgtccaggaccagagttgtagcacaggggtagaaaaagtattttgaaggtggaaccagcaaggtttgctgatggatgaaatacaaaatgccgtaagtggcaaaaaaagacagaggaggggaggggatggtagatcacaactttgattttggactgaaagtttgaaatatctgtgagacatgaaaggggacatgccacgtagaaagccgacaatattcatttagagctcaggactgagatattaatctgtgtgtcatcagtgtgaaaaagaaaaaaaaagatagttaaagtcatggtccaattatgttaatctctaagtacagaaacatctacaggaagtctcatcttaaaataaaatgcccatccacaggtagataagcatttcttggctcattaacccaagacaggtttcttacataattgtcttcatttttactttggaataaagaagacaagaggtaatgtttccttgtgtggatgatactgaaaattataagaccacacatgttcagattattttaggttgactgtaggtcatcacgtgaagccattttaagttcctcttacttgtttaagaacaaaacttaaacagatttattcatgccactactgttgaggcatcttggctgtttatccaccccaggaaaaaatatgggacatgaggaaaaggccaatcagttgagactgatcagaagtctgaatttccatccacgagtctagactctcgtgttgggtattatctgtcttacttttatttctttaggcttattattccgaatggtcacatcttactcctgaaatttttatctgtcaggtaatttgtgtgtgtgtgtgtagtcatcctttactatatggcttctgggacttgatgaatccctgtgcacaggaccacgtacctagtcattctgtcttgatcagttttccatgtggaggaaattgttttaggggcccataggtgcagtgccaagttatttatccatggaatatattataatgaaaatgaatggaaatgcttctttgctagtacctttataaatgcagtgggggtagctcccaccccttgagccgtccctgcaaatgctgtggttgtgaacttatcttccatttttcagctgtgtgcatggcttggcaggagactctgtcaaacatttagaagtgagaatagcctgcagggaggcaaatgctcccagaagttataaatctaattgatagaggaccattagacaccttgtagtcaagctctccttattttgcaggaaaaaatattttacttcttcctttttcttcaaatcctagataagcctcaacaaaattaccattttttatataaatatggtatgaatgtatatattcatgtgtatgggtatatctatatatatacacatatatttcaaaaagagtttctgtgatactttttcttataaattgaatactttttttcattcaattgaatcttggtggtaggtgaatgattttttaatcttatatgtagctctgtatgccacaggagtttttataaacaacatgatttttgtcccaagctattttcagaaatgtctgtgactgacatgaaatgggaaatcatggtgattctgccttcaaatttccaacagattcatgatgcttctgtgctcatagctaaaacccagctctgtagtacggatgatgtacaagactgtattagttcgttttcacgctgctgataaagacatacctgagactgggcaatttagaaaagaaagaggtttattggacttacagttccacatgactggggaggcctaacaatcatggtggaaggcaaggaggagcaagtcatatcttatgtggatggcagcaggcaaagagagagagtttgtgcaggggagctcctccttttaaaaccatcagatctcatgagacttattcactgttgtgagaacagaacaagaaagacctgcccccatgattcagttacctcccactaggttcttcccatgacatgtgggaattgtgggagttacaattctagatgagatttgggtgtggacacagccaaaccatatcattctgtgactggcccctcctaaatctcatatcctcacatttcaaaaccaatcatgccttcccaagagtcccccaaagtcttaactcatttcagcattaactcaaaagtccacagtccaaagtctcatctgagacaaggcaagtcccttctgcctatgagcctgtaaaatcaaaagcaagctagttacttcctagatacaatggggtagagatattgggtaaatacagccattccaaatgtgagaaattggccaaaacaaaggggctacaggacccatgcaagtctgaaatccagtgtggaagtcaaatcttgaagctccaaaatgacctgctttgattccatgtctaacatccaggtcatcctgatgtgagaggtaggtttccatagtcttgggcagcttcacccctgtggctttgcaggggatagcctccctcccagctgccttcatgggctagtattgagtgtctgtgacttttccagcttcacgatgcaagaggtcattggatctaccattctggtgtctggaggatggtagccctcttctcacagctccgctaggtggtgccccagtagggactctgtgtgtgggctcccatcccacatttcccttcgcactgcccgagcagaggttctccatgaggaccctgtcccttctgcctggacatccaggcgtttccatgcatcttctgaaatctaggcagaggttcccaaacctcagttcttgacttctgtgcacctgcagtctcaacaccacatgagagctgccaaggcttggggcttgcaccctctgaagccatggcctgaggtctccattggcccctttaagccatggctggagcagctgggatgcaggacaccaagtccctaggctgcacaaagcatgaggaccctggacccagcccaggaaatcactttttcctcctaggcctccaggcctgtggtgggaggtgctgctgtgaagacctctgacatgccctggagacattttccccattgtcttggggattaacattcagctcctcattacgtatgcaaatttctgcagctggcttgaatttctccccagaaaatagaattttattttctatcacgttgtcagactgcaagttttccaaacttttatgctctgcttcccttataaaaccaaatgcttttaacagtacccaagtcaccttttgaatgctttgctgcttagaaatttcttccaccagataccttaaatcatctctcttatgttcaaagttccacaaatctctagggcaggggcaaattcctgccagtctcttttttaaaatataacaagagttacctttgctctagttcccaagaagttcctcatttccatctgagaccacctcagcctggactttattgtccatatcactgtcattattgtgggcaaaaacattcaacaagtctctaggaagttccaaactttcccatatttttctatcttattctgagcccttcaaattgttccaacctctacttgttaccaagttccaaagccacttccacattttcaggtaacttttcagtagcaccccactctactggtaccaatgtattgtattaatccattttctcactgctgataaagacatacccaagactgggcaatttacaaaagaaagaggtttattggatttacagctccacatggctggggaggcctgacaatcatggtggaaggcaaggaggagcaagtcacatcttacgtggatggcagcaggcaaaaagagagagtttgtgcaggggaactcccatttttaaaatgatgagatctcataagacttattcactgtcgtgagaacagcacgagaaagacctgtccccatgattcaattacttcccactgggtccctccaacaacacgtgggaattgtgggagttacaattcaagatgagatttgggtggggacacagccaaaccatatcaacaacccaccccattagatgaatatactcctcattaaacttcctgttttctcttgtttcctgcttactttatcaatgaaaccattttctggttttgacaatccagaatgttggtcttgagatagctgtcctatacttggagacctgagctggaggagagattttggcaaaagcatgtgattttctatagtgcagatcaagggacaatgatagtggtagatagatggatgtcacaccaatgcagcacaagactggattccacacacaaatgattaaatgaaaggtactcagtgtgaaatcaccttcagacatgaagagtgacactggccctgaccagacctgaaggctcctgaatctgagtctctggcatgcggcctgagcttctctctatctatagaagccctccaggggattctgatacacagcccaggctgagcatcacatatctgcattgcagtgttagccctagctagttcagccatttcctcttatgaatggcactgccctttccattcatatgaagctgcttctcactgagctctaaattattacttacaaaagttcttaggaccttcaaaactcaagtcaagtgctattaagattgtgcaatgagcccatgaatttaaaatacttaagcaagctgggcacaataacacatgcctgtagtcccagctgctcgggaggctaaggcagaaggatcgcttgagcccaagagttggagaccagcctgggaaagacagtgagacccctgtttctagaaattataataacaaaataataatttttaaaataccttagcaaattggaggggcaaatatgtcattattttgaaatgagctatatgtatcacatcaggttttaatatatactaaacactaaaactttttcccagattcatttccatttgttttctacatctcatttttcaatatttccttagcagaaatccaagataatcagtcaatgaacattaacaaagtgattctatgttcaaggcatcactacgtattgtgactcaaggctaggcatttatttagattctccatttcagaaagattcactaatagtattgaaatgtgaaacatttattctcagaaacaaaagtcattgtttaaacttctaatttttattcaagcatgtacttagcaaaagcctgatggtgggagacactccgccccatctccgtgatccaggtcactgcatgttgcaactactcatgttggaattcagtactcatgggtcagtgtatctgagaacctgcactaccatgtgtgccgtgaccatgggattttgttctgcagccaggaaatcagctcaagcccaactttattgcaggttggctttctgtgtcctcagcacacagagacatcccaccgtgagccaaccctgcctgtggcttgtggcagtacctgccatccacaaggacctagggtgtaggccagtagcagctcattctctctgtctcttgctcctccctacatgagccaaagatcacctagcccagtacccccaatcacagccaacctccacagcactggctactttagatagcacatgccccagcacacccagctccagactccaggccatccctctactaacttaggtcctaactggggagatggaggtgggagactgcaaataatttgacaatagacacattaacaggagaaaagacaaggtttattcacctgtgtgtggaagtactcagtaatgagtaactcactgaacgggtatgggtagtagtttatattccagcttaataggggaagggtggatagatagggcttctgttgaaacaaatgggcttcgaggggaaataaatgggggtatggcagttctgataaagtttggtttatgccatgtctcaccccagggctaagagtcagtctctccttcttggctggagcctcctcagaggggacttatggcagctgcattctcagaaagctcagcctttagtcaatgaaggaagctcagaaaaggcttcttttaagtttaaagtaacctttatgccattctgatgggttctttaagacttccacacaacttgtttaggtagcctggttcattcagtacctacgtccttaaccctggttcattcagtacctacgtccttaactctaccttctccaaccgttattcattcctcaatcaagcctgtggtgtcaagaaaagaaatcagtcctgccacacttcaagccagcattcccatgccaggtggaaaatgggacccttggcattgctcagcttcagccagggacagagctgccagagagcccatgcattgctctcagaaaacacattaaggctctcagtcaaacattgaacagtagagaatatttaaaaagtaatgagaaataaataggcaataggagaggatggaaatgtaaaggctctttatataaacacaagcgtggaactatctaggaccacttagtgtagggcagaagctctttgtgagaatattattataatatagaaaaataaatgatgctccccaaagagtcctggagtcattcagaaaatgttaaatcaccctgactctatagcaagccttcaactttcgcagagaaaatgctcaaaaacttcagtttcagcagtgcccagcaaagggcaagtgcggtcttcaaggaggagctgggagatgatgagcgatgggaggcaagcgtggggactggcgggaaggcgggagcagctgaggggatcccagtggacccaaactacaagttggggcttgcagggagcctctgctgaaggtagtaggaaatgtgcttcttactgctcccttgtcttctctaatactcctcttagttcttttcctcttgcataccttttatttctggctaagtgttgggcattgttgtacattttctagcttgactcccttgggcaagttactttctgtctctgtgcctttgtgtcttcatgtttaagatggaaagaactgcagtgttgacctcctagggctgttgttagaagccattgaagacacagagaatacttagaataatagttggaacttggcaggccctgagttaattcactgccatcattgtcctcgtgcttcatagcagtagccgtgttgctgctcttagcctcagttctttcatgggcttctttcggttccttggaggctcccaagcaaaggtttttcagcacctctgttctgtgaaaaagagattaagcattttcagtatatttaaagttatctccagcctattgtgatgatgccttttctccaaaacccttttttattttcgttttattgtaggcacaaatctttctaatgcagatgcttaatttttcccaaaaagcaacttactcctttcaacaaggttttctatttggtcatcacatctgcattcttccaagaagcccactggtaaataatggaacaatgaagcagtgtcgccactaaagagtaatctgcaaccacacagaagctggaatcccaagtacctgtcattatattctcctacacatgtgcagagtttgataaaaagagagagccagttttattattcctttaagaggaaaaaactgccaagaactcctaagctttaattaccaaaataagcttgccttaaacaaattcaaacacatgaacacaaagtagaagatcaaatgcattttgtggccccatgcacatatatcttccatgagcttgtatcttcaaggtaacagtgctgcgtctttaatacccattagcgctgcactgtctaaatggtgcacgccagaaaagagccgtctctaggtgtctcaatgaaccatgaaaaatctcagggaaaatgtattaatatatttttcagcaaatcctttgagatgaggattctcaggaaggattttagtgcattatgcaatgtagttgaattccctcttcagtattgaatatgctttgctttattccaaagagctcaacctcttcctatagacattgaaattcatctgtttcattcatagcaccacgtaaactttttatttttgtctcaaacttctctgataagcttgcctctgcatacaaaaacatcaaagcctgtggtgaaaaattattagaaaagaaaagagaaaagcacctttagtttaagcttcaaatgagaccaaattgattagtcatctgagattaactcagcctagcagtgagcttacagcaaatcacatctgtcatccttttcttattgtaatatatctctttgaaactttcagtaaattgcctacattaagtcatatctttaagagactgattaaatctaaagctgaactagccactgccctatataagtcttatttgttctaatacaaagaaataaattgactcatggggaaaaaaaagcattatgaacacagaccaaaaataagcctcactaatgaaaatatacaaacccgaagtgttattcggtaatttttctagtgttacttaagtgttgccaactagcagctgcctcagatgcccttatctgcttgagtttctagtgaaaaagtggtcctccatggtgcccagggccgccgccctaaagatcatcaacacaacctgttgctgaaacaaagctgaatttatttcttactgtggtaagggggacagcactcaagggagctttggcagtgcctgggaggagggagatgagattttgtggagaatttgaattctggtttaaggtgaatctcccaatgctaagacttgccaccattcaggattggtagaaacaggaattcagtatgtcttagggcacaaactgtcttttgatactttccatggaagagtcagtaggtttttctacaagtttctggattgaacaatcaagttatttgcattggcaagaatctcctggaatagtaagtgacgttaatgaggacaggggtaattaagtgatggtaataaaaccatttctatctgcatgtagatttgttgtctagctgtatgtgtgtcaggggagtattgggcagaagttttaggagggtacatagttttagttctccatgaactgaaagtatatacacatctcaaaaattgctctgtttcatcatggaaaaaaaagccagatgatattgagaagaaatagaagcacaggtagtacaaaaccatcaatgatctaaaatgtatttccatctaacagccctttggctcctgagtccacacctgtacaccctcttcaattcctccaccccagcttgatatggaaagcatgatggactctctgctctcaaggaccaagccccggcccgcttgaaaccacatttacatagtcacaaacactgggattaccgtgcatgctttaagtgctgtgggaactcatagaagataaacatggcaggcagacagtgcttattaaacgcacaacgttacgtagtgaagaagcaataaacaaaaatttagtatttttaaaatcaaattttattttgaagtttattctcagttgctttgggacacaagatctgatcatgccactcttacttgccttttgattaagtccaaggccaacaaaatatcagactatcaatacatatttgtttaatgaatagttggtggatattcatgctctaatttcatagagaacaggtattacaagatctatagctttaaaaaaagaaacctaattctaaaaattagaggaaatgactcaactctcatgaaaaatcttttgcaattctgatttctcagttattagatgaattttcatatcttacatacttctttattagtctcaaacatttgtatttttctattcctcacttctttcctaagagatgtagatacaatcaagagaagttccaaatgcatgagcttgaaccagtggcttacaatgcagctaaagctcttgtcaatgaaggccagggttcttgtcagtttatctcaaatttctacaaggctactaaaattaaccagggagctgtgtctccatttttatattcttattgccccagccaaattctgatatagctaattgcttgtcccccacccaaaattctcttctattttggttaactcatatctctctgcatgatctaagcttcataggtacccatacccactagagctctggccattgggcaaatgtactgcatcctagagatggcagtatatgttaataaagagcctttttgagacccttgagaaggaaattcactagcaatttactaagaatgaatgcgcttttgttctggtagggcaggctttgtggaaataaacaaccaaaggagaaaagcaaaggctgtctattctgagcttcctatagcaagggggctggccattatcacttgtgttttggcagagacttaaaggcagaagagtggtaaatattatagtggagaaaagggaagcttcagttgtgccctaattggaagctgatagcacggagatgttatgagccaaccagaagtggagcacccctggtgattggttggggtgtatgcctggccttctctggttggtcctcagttggaagcagagacaaaaactagggaagctttcatttatgaatcacgtcctggccatctggggccaaatgttgcacaagttctgaatagagatggcaatctgtctttctgtgaaactaatagcaggcttgcttcctgagttgcttattacaggtaaggagttggtttcctgggcaggatgctcaggttgtgggtcaaagttctgtttttatgcattgtctgaccattgtccatttgcatattcagtctctccatggggacatatgtgagagttataacgtaatagagctctggttccaaattatactttattttaaattagtttttagttaattgtcatgaaactaaatatagccaggtaattttgagaaaattatctattattagtttttctccttctggtactacatctataagccatttgtagcagtagatacaaattgtaaaggaaatcattgtggaaatgtaagaagcaggcagttaaccaaagggaaacattgaacgtagcttagtatctccttggacctcttttcactgggacctgaggtggtggacacttctgggtgtgtttcttgtagggaaggtgttattgactctgggtctcaaggcctagggaccaatagacctgggtggaaaaagaacatggcttgaaagtagaaagaaatctaccagaaattggtagaaagggaagaagaaagagcatccagttaaaattccataggctaaaatatacatgcacaattgtatcctctaaaccacattaaaaacaagttttcaggaatagattattgaagtagcactttgttcaacttgctagactccttcactgaaattggttgggcactactatgagcctggcactggaaatatctccattcttatttgttaacagtagtctgtatgtagcaacatggacagaagagtatttccctccactaagacagcgaattgcttgtggcttacaaagttagtatttaaatgaaactactaactcccaggaggtataaatggtgagatatttccccttaaggaaaaagcactttttatgttgcttttgcacaagtggtatgaaacccagttatttattggacacattccatgcacaaaggggtgggtttgggtgcctggataatggatagcatttccagaaagaaagttcagaaggaatttcaagaagccttgtaatgagggatagatacactcacctacaatgcaggggagatggttggtgcacctgctgactggggtaaactcacaggcttgccagggtatccgtggggagggtgatatttccttggcactggagagttatcataacacatttggcaagccttacattttcattcattaggtttctttcattaggttgaaagttagtgtactgtctgtgccaatgcatgtttagacatttatttttctctgtgcaaatgttcctactattgcactccacagacaagtgagaggaaatttgacaagcaatttgtattatgtcagttttaccaaatcacacccttgtcctcccctctaatcacacaaaagcctccaaaagcccatgaggcatgacgttccaggagcttaggaggttattgaggcaggtgagaagtatggaatagatatcaggaggctttagcaaaaaggatcctccctttagctccttgaaatgcccatcccttgactttcagaaggtgacttaccttcccccatttccagcagtgacctcgtcttacctcggaatctctagagcaatagctttcaacatggggcaattttgtcccccaggagatatttagcaatatcagaaaacattttttgttgtcacaactggtgtggatgggagggtgctactggcacctagtgggtggaggccagagctgctgctgtctgtcctgcaggctatgggacagcctcacaacacagcatggtccagcccaaaatatcaacagtgccaagctggaggaacccggctccagatcttgtacagacgtctctcaaggagacctggaaacctggcaaattctgtctttctccaaaagaactattccttccaatctttttcagtaggcatagattatgtctacacatatgtgaaaatcacaagtctagtatgcaatccagccaaatgacactagctggatatagcactgctgtgaccctctacaaatctgtgcttgagttgccatagatgactctacctgtcagctcaacacaggggcagtgtggggcagggatgttacatggctcaactgtttaagttatgcatccatggggtggatggttgcaccattagagaatattccagaaactcttctgtggctaacgctctctgaaacatttccttctctctgcacagaccctgctgtttcccaggcaactaaatgcagtacctaaaaatatatgcatgcaagatttttatggggaaataaaacaatatcacattaaatttaggactaatatttgagatcatgtaaatctctgaaggcagctaccctcactcagggaatagcttatgcttcagtcttagaaactaccttgggatacctgactgtttgccatggtttggtttgggtggggtcctgttttatttgttcatggctaagtagatgcagagattggatgacacttcattcagggcagtgtttgtagaacatggaccttgatccaggccagttccaggttctgggagctcaggtgataaagagcctgtatttccttgcctcaaggagggtactgaagtgaatggacccttgtgctgtgctagaggaatgccaggatttggggatggtgaagcggccagcagaagcagctttgggaggagcgatttaggaaagcctccctaaatggtggaacccctgaattgagcccggagaagttgaagttaaccagacaaaggagcaaacaatgcaggaagcgaaaacaacaggacttaaacctgagagtcccatctcctggagcatatttacaaaattacaagcagggtcacctgctaggaacacagcagctccccagccctgcaggggtcctgttggccagtcccaagagctggtattttacctggtaagcaagagggagctagcgacatgacatggtcaacagaaaaaatggcactcacagtcttgtgcccccagcctacttctgctaggattgaagtatgtgatttgtatttattagggtgacgctggacctataccagagcagcaagcaatggaatacactgatctttctatgtttttattgacctgctgataaacgaaagtcacggcacatatgtatgcatgtatctgtgcatctgtgtgtatgtagacatggagccatactctttatacccctaaatatacacatatcctgtccctctctccgtcccttccctagccagcacaccccttggtggataattgtgtctctttggtttaaactcagaccccaaaacaatgccttttacgtgggaaaacaatacaaaaggcatttttgccatcgctgttggtggggaactgtatgtgatgtgattgggtccctgcgttcctgtagaaccagttgcccagtcacgcttcctgtgacatcatcctcctggacaggcagaggtgtgtactggcagctttccctgctttctgaagcagccggagtgccatgtgcaagtaatctttcatttccaagatgaagagcctgtgtgcacactcatctctctgagagaagcatggctttcacagaggcactcacggtcatgaaactcagctcattaaccctccggaaattcatgaggaggctctgctgagaagagtcactgatgacagaattttaaactttattttctgtccccaataatgttggtgattatgcccatgaaaacgcatgggctttctgtggctgtcaaggactttctagagaaattggtcttgagcttgccatttcgtcagtgctggctctgtgctttgttaactccagggagcttgaagcctgtttttttgttgttgtttgttttgttttgttttgttttgttttaacagatttggacaaaacagaatccagtggtagtgacagtgatgatggcagccaatgtgattaactgaagcatcatttttatttattttatttatttgcttttgcttatttggtcttaaataccaagttgagatatcattcaatgagatttcagacagcgttaaaagtgaaatggcaaattccgtgggattccatatgactgatgagacatgattatttgtcaaataaagcaaaatagaactgttctttgtggtctcttcttcaaagtagcagctctgaaacgtacctaaacccaaaagtcaagcagtgtgttggtttaatagggttcctataacaaagtgcccctaactgcatgggttaaatgtgctggaggcaggaagtttcagattagcgtgtcacagggtcgattgccttggaaggctgtgagggacaatctgtcctaggctgccgccctcgcttctgctgatttgctgtcaatagatggcgttccttggcttgtagaagcatcgcctcaatctctgcttcatcttcacatggtgctttccttgtgtgcatctatctctggatccaaatttcccctttctgtaaggatctctgtcatattggattaggagcccaccccactccagtatgacctcttaactaattacatcagcaatgaccctgttgctacataaggccgcattctgagggactgggggttaggatatcaacataagaattttggtgagggggtaacaattcaacccagaaccggcagcatacccgtttccaccccatcccacaccaagtagccccaacagctgctgagccagcagccaccctgccctgcagcacagacaggggaccagccacttaatatttctggttaaaaccaccaaggaggaaggtcctgagtctccaacttatcagtggaagacaggaagagaggacagagaagggaagggaacattctttaagataaaggagggatgggagaggagataaggaaagtgtagtgggtgagatggtggccccccaaaaatctgtccaagtctaagtccccagaatctgtgagtgtgaccttatttggaaaaagagtatttgcagatacaattaagttaagggtcttgagatgagatcatcctagattatccaagtgggctataaatccaaagctaagtgtccttgtaagagacacaagaggagatgacacagacgcagaggagaaggccatgtgagggtggaggcagagatgggagcgatgcagcctgatttggtttggatgtttgtcccctcaaaatctcatgctagaatgcagtccccagtgttggagatggggccttgtgggaggtatgtgggtcacagggacagatccctcagtaatggcttggtgccttaatgagtgagtatcactctgttcgatattgcaagatctgattgttataaacagagcctggcaccttccccccctccctcttgcatccttctctccccgtacgatctctgcacacactggcttcccttcaccttctgctgtgggtggaagctttctgaagcccttaccaaaagcagatgctggcaccatgctttatgtacagcctgcagaaccatgatccaaataaacttattttctttacgaattacccagtctcaggtattcttttatagcagtacaaatggactaagacacagccccaatccagtaaatgtcaggagccaccagaataaatgccaggcctcccctagagccttaggcgggagcatggccctgtctgctgataccttgatttcagacttgtgacttccagaactgtgagggatacatttctgattttttatgtcaccctgtttgtaataatccactgaagcagtcacaggaaactaatggaaaggaaaagaaagaagtaccattttcaggggccctcagggtccccagtggtggcccaagggggcactaccctgaaacccctgaagtcctacatttttctccagctctgctctggcctgactcacatgaggaatagcagaaccaccagctgatcctgtgctgtagtctccagtgacagtttcctttgagcaccaccatctttccctgtccctgtccaccactctgctcctggatctgtattcaggcacatgctcacctgaacttgaccttagcaatgtgacactggaaggaaaacagatgctgcataagctctgtttaactaatggaattttgtaaaaccaaacaaacatcactgaatcttcagacttaaaaagaagccaacaacccatttatatatatatatatatatatgtattttttttttttgcaagcatgtgttgtttctactcactttgaaaatagggtaggagggactgcttatatcggattatgaaatgtacatagaaaatatcgttctataatatgaagacctctatttttgctggatggatgtatggatttgcatggtttggtttggtttgatgaggctgaccatagtcactgtgtaataatagttaagctacttgtctaccaatgtgtaggctcctgcaatcctagcagatgatcactcacctccctgtcgtctgtcagatcatgccaaacgggcttgacagagtggcagggcagtgtgcagggcatgtttggtgtctgcatttcagaaggtgacactgctaggaagtcattcttaccaagggaaaggacctcctgtcacggtacctcattgcagaatgagagcagacaggcaggaccatcagagtcctgccgggcagaggctgctaccccgctgtacaacctgctggaagatgcagggcctgtgcctgtgggccagttactctcagccaagtgtgaatgacagcctctatcccctgcctgggctccctagtgagggagacaaatagatacttaaacttttccaaaaattgcaatttcagaagagaaaactcaaacactgaacactttcctgaggtttgagccaagtgatttacagaagctctgtgtctagtattttcctgcttttttaatcttccatgcaatctcttttactcatcaaatctttctcctttgctacaagtgaaatcccatctcaataaagaaattgccacagcactgcagcttcttttcttttcctgaaattttaccatattaatattgcttgtaaaaagtgggtcatcacttggctcagatataacaataagtcattttaattgagtgaaattagttaaaataaactttggtccatttttggtcttctaagctcattttttgcttctgtttttatatctacttggtctctttttattcatttcatcataccttatgttttttctacctatctacttgtgaacagttcatacaattacaacatacagttactgattttttttagtatagcgcaaatacaactaccaaagttttaaactcatcacatgtaaatcctgtatgttttatgcatacgacataagcctacaatatgaatgctggaatcctgggtagagtaataataatgctaacagtttcattaaaaatgtctactgtggttaactaacaaacatacagtcaatattatatagcctgagacattcttacagttcataggaatagtgttttcactagctaggacacttggagaaatatctaaagcacaaaccaattttactaaaatacatttaagtatctttgggttctcatgttatttctcttgaaatagaaattctgtgtactataaaaatacaaaagaggcccaattcctttatcctaaaaaaaaaaaaataagctctgacctagatataaaaaattttataagctaacactattaaagaccaatctcgaagtgaagacaagtgattggaagtattttttgagaaaggatactatctcttttgttggtaagaaccatctaaactatcttgcatctaagaaagaagattacctcctaaacataagggggacaaggcttttgtaagatctggaaaagttcaggcacctggcatgaaattagggccccattatatgtgttaggaaaagagatgaagtgatggtccaaccaccccaagccacaccaggcttgctgccttcttgggtctatttcagctctggaggaaatcctagatgtacaggttttttataagccaaatcagaccctggtgaaccagtgacctaaagccaccaaagacttcccggtatccaaagctcaattctataatttacattagaagtagaattgccatgtggaaaccagcacttggcttggctggtaagtcccaggacaaaaattgacttgggcaacaaaattacatgagtttcgtacagtgaacttcctctgtttgagaaccatcttggaattcatccataaacatctcattggttaataaggaagatgaaattttaagcaaataattacatatccttctttaatgccacatatctctctagtttacgaagtcctctgtgaacaaggtgtgcgtgtataacataagaacaagacagatgcatttaggaataaagtgtattggggtgagctgctcctatcagccaacactaaaaacagactaacatacgtcttctctgaccatccctttttcatagtaagagtttttcttttagttctagttttcatcaacattaatttaagttgtgaaattacagcttctgtggtgtaaagatctgtgtgcacttggtgacatgaaaacttaatcaaaggaacaagaacagtagcagcagggccccagactgagtcctcagacccccacttctctggaaatggaatggatgccatgcccaagactgctttctctattctgataagtttctctattctcataagtttctctattctgataagtttggcaaaacctgtgcttaaacaaagttgaacagttggcttcattgtgtctgttggtctgctcagagcctttactttgctaattcaaagtaaatttgctaatacattataaatctctgagatgagtatcaagtacagtatttcctgcatttatgttgcagtgaaaccctatttataacatagcaccttttaaaactagtattccccagacctgcatagaagtaaataacaactgcaacaggataaatatgaatgcaattttcagtgatcaaagtgctgttgtaccttcttaccttgtgtggtcaaaagcctcatgcaatttgtttattatcagtagacataggtttgttagctatcatcctatcctcagtttatatgatagaaggataaattatatacatcagcaaactagatgcaacttcaatgaatgtttttggaatgactggctgaataaatgcatgacagggaaggtgtcacacaggtggtaaaggcagtctatccctgtgaaaagagctcagaggaaggagtcaggagggttaggctggagaaaagagcttctgcctaagagacttatggtcaccaaagctcaggagacagctctgtgacctttcccataccatttaacttctatttgtcttctagataaattggaaattatacctgccatttttatatccctagggtaatgtaagacacaaatggaaataatgaatatgaatgttcttaaaaaagttagaacactacataatgtcatctatgagtaacagcatatgaagaaaaccaacagatgattccctctctccatatccttaattgggtctgatttttattttggcagaggtgtaaatcaatttggaaaagcaagaatgagggaatgtgattgtataattaatcattaagccattgcagtaatcaatgaattactgctattccaatgtcgctcaggttggaggactaatttcagactctattcctgaaaacaaacttttcttcagagaaacactgatctcatctgtctcagacagacaattgtcttctgaaattttcatcttaggagagttcttgggtctttgctagatagcaatcttgacctaaaaataaaacacccttcataggtttctctcctgaagctagaatcagtaagtttaaattttcatcattcctttctgctaaaattagtcaatgaattgagataattatttttatggttatcatgcttaatagttaatcaaattatttaaatcctgttaaaatgtatcatattagttgcttgcctcattttcagtatttctcaaaaatcaatttatttctagttcaaaaaggaacttcagcaaatctcttgttaattaactgccatttttatttttagaaccattcttatactagttaaatatgcatatctcagccaccttcttgcccacagttctactcattttcttagttcttcacacttcaacagtgtgagaatttctcagaatctaattcagtgaattcccctggatgagacaaggtgctgaaacatacaattccttttgtcttccaaacagatggaataggttatttatttgagtataacaactcttgaaagaaatgcataccgtatgccataaacctgtaagattctgcctcattcaatgttatttcttttcagaggattgagttactctttgaatcattttctcagactaactgcttaccaattcgggcatgtgaaataggatcttatatgtgctacaggtctgtgctttttgtttttgtttttgtttttttgagactgagtcttaccctgtcacccaggctagagtgcaatggcgtgatctcagctcactgcaacctccacctcccgggttcaaacaattctcctgcctcagcctcctgagtagctgggattacaggcacccgccaccatgcccagctaattttttcggagttttttttgtttgtttgcttttttgagacagagttcactctgttaacccaggctggagtgcagtggtgtgatctcagctcattgcaacctctgcctcccaggtccaactgattcttctgcctcagcctcccaagtagctgggactacaggcacgtgtcaccatgcctggctaatttttgcatttttagtagagatggggtttcgtcatgttggccaagctggtctcgaactcctgacctcatgcaatctaccagcctcggcctcccaaagtgctgggattacaggtgtgagctactgtgcctggcctgtacttgttttttaaaataatggttattagaaaaaaacataaggaactttagtgtaccttctagaatttgtcttatcctctgcccattgcaactatttgatcccctggctccagctggtctcttcttaatattccttctctctctctttttctatttgaataaatctctaatcaattaaaacaacaggcagattataaaagaagattcattttttaaaaaaatcaaggcatctcttgaaatatttatttgaatctagcaagagcaaaggggcagatgtggagatgaacaggtccctttctgggaaaaggggactggtatgatcaatccagagggttggtgttgccacagccatcgtccactgtgtgaaaggaagacagaaagaaaaagcatcaagatgagaaaggggttttcttatggattgttgcaggggagccagaattaagaccagccgtctacatttaaaactaagtacaaaattaccttggtttgtaaggttacatttagtcaggtcatgctgggcaaacagcagttttctcacaaggtaatcacattgtcacagattggtattgccaatgtcagagatgatgttgattggggagtctgcaactgttaggaaatgggtcaaagattcattatttgggactacagtagaaaggcgattgtgtgttttgtttgtttgtttgcttgcttgcttgcttgcttgctttgggattgtttccctgagcttggctttgtcctgtttccctgaatgaggactgtgacaagcacatgatgtgcacgctgccatgacaggtgcagagctgggtactggtttgcctttacagttataatgctgacgttctgcccctaaaatagatttaaccacaggtgtttggttagcagttttcctatttgtgatcattaatttgatatgttgtcttattgaaccagctgtatagacataggtatagcaagcagtgttgattcattcacaaagaccccttagcatggttataaaaatgagagctatatgatgttaaatcttgagggttaacttttgttttgtggtcacttttatatctgtggcagaaatatttgattctggattgctgaaatcagtaatccagaactttcagattcaaagttcacctcttccaggtttcacatccactacctaggtctcaaagattattccatctctctgagctccaagttttcagtgctcctggccatactgcctgtagggttgggattccctaagccaacgttccccaacctttgtggcagcagggaccagtttcatggaagaccatttttccatggactgaggtcggtggggaagatggtttcaggatgaaagtgtccacctcagatcatctggcattaattagattctcataaggcgtgtgcaacctagctccttcacatgcattgttcacaatagggctcacactcctgtaagaatctaatgacaccactgatctgacagaaggcgaagctcaggctgtaattctcgctcacctgctgctcacctcctgctgtgtggcctggttcctaacaggccatggaccagtattgttccatggcccagggcttggggacccctgccctaagctacacaacatgaaccaagccagtgtcctgggaggatggtgtaggcattaaccccacatatgaaatgcactcattttaaatgagcttgtcatgtctaattacattatatttccctttaaatgtaacatctctggcatggtcattatcacagatttgatttactcaattacattctggtaggaaggaggacagattctaggtaaatatgaaggcctatggctaaagaaaaacacccagattagtaataataatagttaaataataatgtaactattgctttcagttgttgtatagtttcagaccaatcaatatatgtcatgatatttgcaggactattataattattagcttttcctgataatttattatcatcatctgttttaaaatttttaaaggattttaaaaatgagttttgaaggattaattagaagataccatttaaggaatgttttattctagtctttataagcataacctgttagatcaagcactggagacagaggaaatagacagaaggcttctataacatgcccgattcaaatcagaacagtaatcacagcgaaatttgtatcattttgttgaggtaattaatccttgttttgttgatcttggattagtaggcactccactttctcaaagttttctgcctccagtgcaaacaagttctggaactcctgactcagtcccttggtagtcttcatatgtggtggtgatatcagctgatatagggatgcgtgtaactaagatccaattttctattctatgaagtgtcgaaagaacttgttagagtcctttaatcgagctgttgtgatgtttcttccagcagccatcaatactgacgcatggttttggcaggggtatttaggatcgtgtgacaaaaaatcagaaaccacctgttggtgctaaggctgaataggtctggttgtttactcattataaccactaatatccaaattgaggccagtttagtttcataaagaattagtcagtgacggccatgagagtggtgagggcacagaacaatctccatggccttttaatttattccatccaatgtgtgtttggattaccaccaactgaaaaggctattttaaatgtggaaatgggatcttcttttaaaaaattgttgaccattattgtgccattctttaacatgaaggagagtgtgcctctctccacaatgaaaaggtcatcactgctgaagcataatcataatgctcatattttactcatcataattaagtggtggttgagcttttcattttttcatgtcttggcaggtctttttgtattggattcttgatgaacaggacagctctcaacatagtattaaaccaaataaaaatctacgaaatgctgaacatagccaattatttctaggatcccttttctcataaagtgaagaagaaaaatctttagtgtcaccggaagttttctgagaaaccgcaaagatggtttagatgtagaagatacttctaaaagttgtattagtttgaggccaggcgcagtggctcatgcctgtagtcccagcactttgggaggccgaggtgtgtggccaacgtggtgaaatcccatttctaccaaaaaatacaaaaaattagccaggcttggtggtgggcacctgtaatcccagctacttgggaggatgaggcaggagaattgtttgaacgcaggaggcagaggttgcagcgagccaagatcgtgccattgcactccagcctgggtaacaagagtgaaactctgtccaaaaaaaaaaagttgtattagtttgactgtgggggtgcagatttgtggaaggcaatttcaaaaagagttatctgggatgcaagatatgagtgtaaatctggagtggctgaagacaagacgtaacttcagcttggctcagaatgataatatttataataaaacggttaaagaagttattaggaactctagcattttcataagcaaggatcttttgctaaatattaatttaaaagattgaactctagcatttccacaagtgaggaaattttgctaaaagtgactcgagagtaacaaaagcgcaaaaaaaaaattaacacgatatcaagtaggaggattttagtgacaaaagaagctcttgttctttgggcacagactattcttcacaatttcttactgaaaacagagtatatactcaaatataatcagagagaaaacccaacactaacttcattatttttgtaccctactcatgtaacatttgcagtagaaagttcacaggccttttctctatcttgtaagtaaactcatcaaaattacacaaactttataaaagactgtgacacctttcattgttttttttttttcaagttcattatttccaggcattataaaccaagacaaataaggttcacttcttctcaacctttccataacttattgcacatcctcaaatatgtcttaattttacatattaacacacagccagattttttaaccttagacacactttcttcctcgataaacaaaaatgcattccattatcttacagacacattcatattattttacaactattgtacctagtacagtgtagtaggcagaataatgtcctcccaaagatgtccagagcctattcccccagacctgtggctgtgccaccttacgtggccaaggggaattaaggtttataatcagctaaccttgagataggaagaagaccctggattatcccagtgggcccaatgtaatcacaaaggtccttaaaagtggaaaagggagcagctggaggcaaatgaaagggtcagagcgatgtgacacaagaaaggcccattgttgctagttttaaaggtagaaacagagggttacatgccaaggaaatcaggtggcctctaggaactggaaaaggcaagaaaatgattctctcctagagctcccagaatgcagtccttcccacaccgtaatctacccacaccctaattgaagcctagtaagaccagtgttgtacttctaacctgcagaactgtgaaataataaatgtatctagttttaaagcactgaacctgtggtgatttgttacagcagcattagaaaaccaaacaccgcatattctcactcataggtgggaattgaacaatgagaacacatggacacaggaaggggaacatcacactctggggactgctgtggggtggggggaggggggagggatagcattgggagatatacctaatgctagatgacgagttagtgggtgcagcgcaccagcatggcacatgtatacatatgtaactaacctgcacactgtgcacatgtaccctaaaacttaaagtataataataataaatttaaaaaagaggcaaaaaaaagatcaacagaccactagtagttagcttaacaaaaaaaacaagatcccaataaacacaataaaaaatgacagagatcacattaaaaaaaaaagaagaaaactaacacatgcagcatctacttttcatgagttataactttgaaaccatgtaactgagttgtttcctcacagacatagagaaggctaggagacagttgcctgtgtgcacttgagatcagctgagattccagaaagctgcctgtgactcctcacaatgtccttcctccaacagtctgatatattgtttttgtatttcatgaattagcaacatgaacaagtccaggacatttgtacatttgcagatatttgaagcgcatatatgtgtgtgcctatgtgtttagtggacagtgttttttcaaaaagaggacactaagaattttactcagaggaatttggtggagtaactcagtaacagattgttgtggaattccctaaggtgaagaagagcgactccttcatgaaacagcagttattacaattcaatctagctgaacactcgttaacctttttaaatgtttaaataataatattagcttatctgtttaataaacctagaattggaaatcttaaaaattcgtattattaaaaattgaggaaacaaacctaatcttttataaaacagatcatgctaacaaaagatttatgaaatgataaaaccaggggaaagacatctctgtttttcccctaatattatcaaatcagtctgattttgcaaggatttcctttacctgaaaatactgcatcaactctttttaccttagatactaaatattgaaacctcttcaaatatccttaaaggtcctgaagtgtcttagtactattttttaccttgtctttgctaacctggtatcaacttttatttctttgctttaaattttttaacctagctaccaaggctgttaatttaattcattgtgaaatttctttgtgtttttccttgaaataagcttttgtgaaagatgttgttgttgttgctgttgttgttgagacagtcgtactctgttgcctgggctggagtacagtggcatgatctcagctcactgcaacctctgcctcccaggttcaagcgattctcctgcctcaacctcccgagtaactgggattacaggctcccgccactgcacccagctaattttttttatttttagtagagacagggtttcaccatgttggccaagctggtctcgaactcctgacctcatgattcgcccaccttggcctcccaaagtgctgggattataggcatgagccaccaagcctggccagatttttattttttttcttaaaggaccagcaacttaaagcattctgagagtattttcattggcaattttttagttttcttgttgtaattacatatacaaggacttacttgtttacataagccaatcaaattgggagctccatttatcagtctcatccagagaatagaaaagttataccaatttctagacacagaaaatgtttatacacatacaacagaagaatccccagcaaactcttgggtaagctggaggattcaggaacttctgactggatgtcttcttatctcatatgtgctatttttttgtaatccttgtcaagtccattgtggattgaaccaggggatacattttaagatttattaacacctttttgtcagcacatgtttattggcatatttctatatttctgtgtgacttttctaatttttaactttaaaaaaattatggattcacaggaaattgcaaagatagtaaggaggggtcctatgcatccctcagccagtttccagcaatggctatatcttatgtaactataacacaataaatcaggaaattaacattgcagtatatgtgtacagtgtcatcacatgtgtggatttgtgtaaccatcaaggctatcaaaatacagaattattccctcaacccaatgatatttgttgtaccatcttgtcatagtcacagtcttcctaagtatcctaaactcctagcaatcattaatttgttctccatctctataattttgttatttcaagaatgttatataagtggtatcttacaatatagaaccttttgagactggcttttttcacttagcataataccattcaaatcttttcacgttgtagcacatagtgttccttttgattgctaagtagtattccatgtattttgttttaggggaaaaaaaaataagcactcagaaccttccagatgtttccagaggtcagagatctccggacaatccagaagagacttttcccacattaacaagcattcagacattttcagtaactaagcaataccattttgaatgcttcaccaatttggtctgtaagccacactaaccagttttaaaatatatattttttgcatatatttttcccctttgatgatagactgtgtttaaattagatatatttatagtgtgcaaatgacagatttctataaattaagctccaaatacttcccaaaagagaaatgagagacaaaacattccagcattgtaaacatcaaacaaccttttatatacaaaaggaaaaaaaccctttaatccttttcacactaacttacagacatccaatcacatggaaatcagctcctcacttttatatcatcaattattgatgaaaagtaaattcagagacgggagaggattctaggctgatggagaagtaggaagcaccaggaatttgtctcaccacctggacacaatcacattggcagaatctgtctattagtcaggattctccagagggacagaactaataggatatatgtatatatgaaaggaagtttattaaggagaattggcttacatgatcacaaggtgaagccccatgataggccatctgcaagatgatgaagaaagaagccatcagtggctcagtctgacaccaaaagtctcaaaagtagggaaggacaacagtgcagccttcagtctgtggccgaaggcccaaaagcccctgtcaaaccagtggtgtaagtccaagagtccagatgccaaagaactggagtctgacgttcaagggcaagaagcatccagcatgggagaaaggtgaaagccagaaggttcagcaagccatcttatcacacctttttccacctgcttttgttctagccatgctggcagccgactggatggtgcccacccaccttgagggtgggtctgtctctcccaatccactgactcaaatgttaatctcccctggcaacaccctcacagacacaccagaaacactactttaccagcccaccgaggcatccttcaatccaattaagctgacacctaatattaaccatcacactgatataactattttgaaactctggagtctattgaagacttaaaaatttcagaaggcttggacagtaaagtacagtatatttggtcaatctcagcttagctcacagtagctacccatcccccacccctcagccctgtagcaggcagctgtgcacatgttcctagagcagcttacttgcagctggcagaaaccagggttgacacaaaagaccccgtcctctaaatatcgtggatctgttctttctgctgattgctgcttctcactacagtgacacaaacacagaggcaagcagccattgttgcacatacccataccatgattgcaagcccctctatctttggctgaagttattttcagaggatttaaagagctgacaccgtcaccctcctcatccactttatgtttttcttttccctttttgggagccagtcattaaagactagcatattcaaaagcaactgcatatacaagagaaataagagagccagtatgcatgcccagggaaactctcatgctcagaaaacatctgtgaagatcttaaggctaattctcaacacagagacagcctaaaacagtcaaaaacaaaacaaaaacaaaaaattacaaaccctggaaaagaggaagaatctgatttccagataacccattattacattcaaattttcagtttcaacaacaataaaaaaccacaaggcatacaatgaaacagggaagtatgaccagttcaaggaaaaacaacaaacaaactaaaaaaaaaaaaaaaaaaaaacagaaaccatagctgaaaaatggcacaaaggtagatctactagacaaagactttaaaacaactgttttaaagatgttcaaagaattaaaggaagatatgaagagagtcaagaacatgatgtgtgaacaaaatggaaacataaataaaggcatagaaaacctaaaaacaaaccaaaaaatttagagctgaaaagtacaataattgaaatgaaaaattcactaaagaaatgaaaaggcagatttgagcaggcagaagaaagaatcagcaaagttgaagacaggaaaatttaaattattgactttggagaacagaaagaaaaaagatcgaagaaaaggagcagagcttaagggttctgtggacatcatcaagaagatcaaatacacactacaaaagactcaggagaaaaaaagtgggaaagggatagagagattattagaggaaataatggctgaaaacttaccaaatttaacaaaaggcataaatataaacattcaagactcaatgagattcaaataggataagctcaaagatacctagactgaaacacattacaatcaaattgttgaaagacatagataaagaatcttgaaagcagagagaagtgactcatcacacacaagaaatccaaaataaggttatcagctgattttttaatcaaaattttgaagaccagaggtagtaggttgatatagtcatggtgctgaaagaaaaaaaaactgtcagccaagaatcctatgtccagcagaagtgagggaaaacttaagacattccctgataaacagaaactaagagagttcactaccactagacctgctctgtaagaaatcctaaagggagtcctgcatgttgaaatgcaagaacactaaacagtaattcaaaggtataagaagaaataaagatcttagtagagataaatacatgggcaattataaagctcatattgttttaacaatggtttataatgctacttttgttttctacataattcagtacatttaagaaaaagcaattactagtttaaaggctagcattattgtgactttgtttcctaactccacatttttttctacataattaaagagaaattttctacataattcgtttttaaaaaccaattatttatgtttttggacacacaatgtttaaagatgtaattgtgtgacatcaataactgaaaagtgtgagatggaactgtaaatgaacaaagtgtttgtatgttattgaagttaacctggtataaattcaaattataatggtataatgttaaatgtaatccctgtggtaaccacaaagaaaatcattaaactatatagacgaaagaaaataaggaaattaaaacatttcactacagaaaacaatcaacacaaaggagatagtggtgcaggaaattagggacaaacaaaaaagctacaaggcatatagaaaacagaaaaacgctagaaataagaccctttttatgagtaattactttaaatatacatggataaactctccaatcaaagacagagattgacagagtgcattaaaaaaatatgatgcaattatatgttgcctacaaaaaacttactttagattcaaagacagaaatagattgaaagtaaaaggatatttgtacatccgtgttcacaccattattctcaagagtgaaaatgaagtatcaacccaatttttcgtcaacagaagaatagcaaaatatgatatatacatgcaatggaatattattcagtcttgaaaagaaagttctgtctgggtgcagtggctcacgcctgtactgccagcactttggaaggccaaggtgggcagatcacttgaggccaggagttcaaaccagcctggccaacatagtgacaccctgtatctactaaacatacaaaaaattagctgggtggggtgtcacatacctgtaatctcagctactcaggaggctgaggaatgagaattgcttgaacccaggaggcagaggttgcagtcagctgaaattgcaccagtgcactacaccctggatgacagaatgagaccctgcttggaaaaaaagaaaaaaagagtgtacattctgacatatgctacaacatggatgaaccttaagaacattatgctaagtgaaataatccaatcacaaaaagacaaatcctttatgatgccatttatatgaggtacctggttgtcaaattcaaagagacagaaagtagaatgggggtttccagggactgaagggaagggttggggagttgtttaaatgcttttaaagtttcaattttgcaagatgaaaagagttttggagatatatgattgtagaatgatatgagtctacataatatcaatgaactatatacttaaaatggataaaatggtaaattttataagtattttactgcaataaagaagttttttagaaaaaataaactcagagcacctcagcaaaaacccacagatcagttttagcagctgcagaaacaggagggccatagaactacttaaacctcgaagacaaaggagttgtgatgtttctcatccggggttgctctccagtccagctgaccttctggaaaaatatattttctctaatcagtttgagacatttaagtttataatggtgcacaacaaagaccatctacacataggactccatcagtgatcagaagagatctatagtaagtgtaggaaggaactcaagtgacttccctgttgtctgctgccttagagaatgcaggtctttagaccataagaccaccactcaacattcctgccaccaatgcgaaaaccaaatggtagtatgcacatcagtaacaaatacaggcttagttcagaaatagaaacagaaagtcacaaacacaacatggaaaccgaagcagtcaacgagagcaaggctgttacctcatcatgaaatccccaccagctcctttctgcacaagcggtctgcaaggagtgcctttcttgggcaacatggtttgttaggtctcctgagtgagtcccttggggtaccttggtgtgcccaacaatgcttaacagaagagttcgagaatgaagcactgtaaagagaaaataatctttacttgcagtttttcaagaaaatctggatttagaaaactggttcaccaaatacaaaatacaggtatttgaaggaaacacacacacacacacatacacacagtggaaagggtagcaaagttacaaggtttcagttagtccatcattgatgaaaatacagtcctttttctgcacaattatgttatcaccaatggtagtctcttaccagtattgcaaaaatcagacatatagtcattgttactagagactaagtaacttaaaagaaatggcccaaggattcatttctattgggaactgtagcaagaaagagtgactttgtttgtggtagtggtggtggtacagtcttgttttgtattgttttgatctgacaaagaacaagcttttctttttaaaaaaacaaaagatggaacgcctcacaaatttatgtattatctttgcacaggggccatgctaatctttctctgtatcattccaattttagtatatgtgctgccgaagcgagcaccatgatttccctttttcagatgtgagtccatgatagtggatcgttggtagcacatttattcaaaatagaagcaaggcaaggtatccactttgctttcataaatccaggtattctttgaacctgatgacctgcttgtctctctgacgggattttggtacgtgattctctcatataagtaatataactaattttgcatgtttttctttgtgtggaaaaataacattcaatttatccattaatattaagctttaaaattcacttggtttttactaccctctgtgttattcccgcgtgaaatctctgaatcctgtttccctgcattacctcaacatttccctgggctccaagccctgtcagttgcttcttaagaatttccataatggctgctctcatgtccttgatcctcccatgaccacctttttgtagtcacaggttcttgtttgttcctgaaatattatagtttcctgccaaatgaatgaatcactctattattttcagtctgtgtcatatcttttaatcaaattaaatctagaaggtagagtcagctgtgcatggtggcttacacctgtaatcccagcactttgggaggcagaggcaggcagatcacttgaggtcaggagtttgagaccagcctggctaacatggtgaaaccccatctatactaaaattcaaaaggtagccaggtgtggtggcatgtgcctgtagtcccagctactcgggaggctgaggcagaagaatcgcttgaacccaggagatggaggttgcattgagatgagatcataccactgcactccagcctggacaacagagtgagactgtcttaaaaaaaaaaaaaaaaaaaaagaagaagaaggtggagtagtcagctggagcagtcatctatttgcagtggttactggtgcctgctccttttgagggcctaagcaggtcattccaagacaggcacttcttctgccccatgccaggctcaaacacaggaggaagcttatgctctgcatccacagagaatctcagtgcaccacaggaccacagctgggctctaggtgccctttctgtccctgggactgtgaagaactgcccacaacctccacctggtgatccagcctctttcttccccagtcctaaaagaaccctacctccatccatttctctctctaaaaagaaaaggaaacaatttgaccaccttgatggtgtgaaactataaaaaaagtttgaaccacccactttgcagtttcctgttgccaatgtgatacaaaaaaagggaattaacttcttttaccctctgaagaaatctcagacctcaaagacccaaaagtctgcctgaaacagtagaaggagaggaatcaagattcctcctactgggcagcaagaatagctttttagctctttcaagtgtttagaaacttaggttaaaaagaaaatacaggatatggaacagttatagaagcacactaccttgagttgtagtgcttataatttcactagaagtctagaagaagagaacattattgtcaagaaaaagactatgtttcttccaccctcagttttactattctgaaaccttccttcttaatgcaccagaattctttttgtaaaatatcaagttgttcttgttgcccccttgacatacaagaaaaaatcctaaatgtacacctcctgaatcaagccttccataataactccagtcctatctaacttgtctcttccctgaactactgttataaacatacaacacaaggtcacttgcatctgtaattattctatgtcccacattttattatttccctaatcagcttcaaagtttctaaacactagaaagagctaaaaatctttttttgctacccaaatttcttgtgaagataggatttaaatttcactgtaaaaagacagcatttttcaacacataatcaaaggctaaaaaagaattgtaaacttttaaaataattaacaaactgccccgaggttttcttctccgtggaataatattacctgatttgtttctttacttggatggtcaaaaatttggactaaaatatattcctccagatagactgataaatagtagactgataaatagacttaatgaaaaatctccaattgcctagtaaaatgtcagtaacctatattggaaatactagaaataagataaatccaatgagtttcctcgacagtaaagttggggtaagttaaatataacagtgactcctggtcttttccataccatggggcacatggaaaatgatagtacttgaatggcacattggggtgagtggaagaggctgctctgcaggggttgggtaccctgccatctacttattatctataaataaactaacattacagggagacccgcatcttaatcaggactcaaggattggaaagccatggaggatgagactacatcttcatatttatctgacataattttcaaaatgataataccaacaaaactaaaaaatgctacagccaaattcttaaccctctcttcatttttggttttaaccttgacagtgtccaaggtcatgaaaccagtcctccatacacagtcaagggtgtaaatgtccccgtatatacaatgactggagtattttttcagttattttgcccttccttcatcactttccttataagaaaaaggaaaaaggaacacattgatcatttcatgtctgtggagctcaaatttgtcttctaatggtttgtgggggttaatgaactggtagaatctccagcatgctgagccctacgaaagtaaactcttaaccagagttaaggctgatttaatgataaatagataaactattttaggtgctgtcattagaaaataaatatgctacatttgggggtttgcaggcaaaccatttttgtcagacacttcctcagctatcatcaagtgaatgaacacacttttctatttcagtaatttaagtatcagcattttctctctaagctaaaataagccacctaaacataggataagagcagataccaaaattacaagggcctgtgttttatgtatcactgcctggaattaagatatcatcgcctactcccacaaggttcccttcctgctgccaggcaccatacaccagagaattaaatagcagaagaagactattatttatagatatgtacatggaggtgaaatatttcaaacagcctttaggagctagctaaatgtgcctaattgggggatgggagacaagaaagggatctaactttaggcacttgccaattccatctgaaaaatgtgagaacagccagctttgctacaggcactcatttacttacttccagaagtcaattaaaggagcagaaatggaagctgcaggtgggataaattaattgtcttgcagggctattggtaatgcctaaagtgctttgtaaactaaaagtactccataaatatgtcattataagtacctttgtcattgggaatagtaagattaataatgttaaagtgaattaaggaagcagaattggattgtattatatttttcacacaaaaacacaccaaattagtaagtgttacctggtagaactacacaataaaatcccatcagagagacaaacagcatcaggttactatagttcagaggacacatagttatagattgtcaagtacctctctcctgctttcagtgtttctccttgctttaaatgaatcaaagctcagtactcacatatgtgatcatgttccccacacatttttgctttgactctttttaaaaaatacaggccgcaacatagctttcattaaggtatttttgagggttatgttagaattcccatacatttttcttgacttctataaacatcaagcaagaacataataatagctaatacctatggagtcctgtgtccttgttcatttccatacattcactcatttatgctttacagcaaccttgtatggcaggtaccattattgtcttcctttagagattgaaaaaactgaggcttcagaggcatgaaataacttggccagtgatttgatcccaggtcaatctagcagcagagtggatgcactgccatgaggaatgactgtttttctctgtagatgtgtgtaaaactacccaatagggaacattcagtgatgggaaacaaacaattttgcataaacgtggcctctcgtattctcttctcccccatacccacctctgccactatctctgccttcaccttgacctcctttcaactcttctctttattttcttttccaggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataagtaagttacctggtgacgccatatctctgtcctggtaaaattggttctgaatgtgcctttcaactcctgatgacgggtagtactatgactgtcactggaaagcatttgtctctgagaatcaagagaaggaaaatggcaaatggtttccagtcttctctcttactgttggtaaaatggacttgacgatccagcacacccatgtgctccttccacatggcagcgacacgagttcaacctggatacatgaaggtattttgttgttgttcctctgtggtgggaagtccgtgtgttgatgatgtctctacatccctctgctctgtgcctcttcagctctgcaaccaagtcaggtccaccttaccaacatcacagtagccaccaagtcatagcaagtcaccatgcaggaaggatgggggaggagacagggcatgatggagtcagagaactcagttctcatctagtaccctcccttacaagctgtgagatgtggggcaaatatttaatttaacaagtcactatgcctatactttccaatctaaacctaagggagaggctgtcacaatatgctagctggaagagttgataatcaaatcttaaagaatgagtagaaatttcccaggcagtgcagatagtggtgagaaaggagggccttcgtgcagatagaacaaaaagagatgagacttggtgtcaaagcaactgcacctccttgaataagaatgcctcctagtttttaagaaccaacagtatcttactatatacagctggaaaatagcttcacaagccagcgcatcggtatatcagcaaggtgtcaattttacagaaaccttcactaaccttaattaaattttgcctcttggaagtccctcgatgtaattaaataagattaaaagggtaaacattttgttatcaagagtctatttcttgacttttcattccctgccaagccacccccaccccccattcttttacatgtaaatgctaaatagtttgttgttattaaacactttgagggacgcactttgaaactttctggaaattctgtctcattatttcacttaattcaggatagtaccaatgtattatagaagatttggagtttctgtttaagcacccagagacctccaaataggctcaatcaacaattttgcatttggatttgaatgttttctcatattaagtagaaaagccccactggactcatataataattgcgcagtggagactgttggcttgagctatatcttatgatattgtacttacaataaagtgctatcctacgtaggcaggaaaccatatggttttcttctttatttagcttcaatagacctttggaatctctaattgaagtgcttacctgttttgagcattaagatcttaatatggtaatgctttcttgagcatacacacccacacacacaataaaaccgtagtctgcaaaacaatctgatatattcttgtctatattcatgagacattcaaagattaaagtattttctctgaattatacagttagagagctttgaggagtggtttggcatatattaattctctccaactttatgagcattcctactgcaataagcatcactaaatgggcctaaagagaaaaaaaagttttattgagtcctatggtcaaataaaattatttggtgaaactaatttacaaatcactcgaagaaaccatctatgaaatgatattacaaatcacttgaagaaaccatctataaaataatacagatccatgttgctaaggtcctgataagccaggtccaatcttgattattgttaatgggaagatttttttcactaaagatgatctcataaatgccctttaatttggctgaaaatttacttatagaataggcgctcattctgtcttgttgttcctttatctctttttccaatgccaacagcctggatttacgagtttaataagaagtgttaaattggattgaatcaagcatcttcctggttacagttctcctgcttagtcagtctcattcactgtttcatgtagcttatctctttttttatatatatactgactaatttggagatcaaaacaaggtttttataactgcatttatcctcgtctcctacctacacttcagttttattattgcttttcactgctcttaaaacaaaatgaattcaggagaattgctccaaatttgagcatgaaactcaccatttctgactcaattctattataatagtaggtatggagattcccatggacttctagacaaattttaaggaaatagaatttatttattgaaaatcaaatttttggaactgaggataatttaataattgggaacggtaggtatacaaatacaccatagcttatttataaaatgattgctaatttgcccaccctaaattattccttaaaaacttatttctagaaataagttcagttcaaacctgatttttatttgtgatagtatgggaaaacacagatggaagaaacgtgccttgctatgatgctctagtttatgtatttatacatgttctttatatatacatatatatatatacaagcttaaatgtgcagtgatgttaatgagtcagattggcgagttgccaatcacagtctatcagaactgcacaactcacagcgtctggcggacacaaccaagggggctagtgttctgtgatcccaccgctggcacagctgtgttgacagccacaatgaactgcaccaactgaagtcctcaccacccctgatgtgacagctctagtgaagatcaaactccaattgtgtaattgttattaactcttatagtagtcttatactcgccattttgaaatcttaattatttattcttttcacatcattttaaacatacattatggacattctatcatgttcatctgtctcaagaatacatttggttttttttccccaattttaacagttatatgggaagtagtgttgaatgtgtcactatattttgtcataagacggaaaagctattaacagtcttaactgttactgtcagtaaagaactgtgtattgtggcttgggttataatcacttgtcacattagaaacacacaattgtccaagcccttcaatcaatatttagaagagtttttcaggtagaaatttccatggcatccatctagtgaatgcatcaaaattaaagtctaaaaagaaagcaaagtttctttaaccttcacatgttagtataacactgtgatgtattggcattttaattgagaggttaaaacctgctgttcgttacacattcacagtctcttttggttttgtaactatgcaaaagatagaaacaaaaactacacttttgtttctactcagaagcatttttgcacactaattgtatttcaactacactatcacgacctgaatattaatatatgtttttctagagttgcttggctattgtcatgaacaaatatttagctaaatgataaaatacaacaaaacatcacatttaatctttgttcagcattgattatatgagaatgaaatgcagcttcatctggattcatgaaaggatctaaaattctctgtctttaagtcaaaggaattacaggcataccttagagatattgtagttttggttccacactactgcaataaagcaaatatctcaataaagcaaatcacacaaatatttttgtttatgttgtagaaatatcttctttccttaaaagtcattaatcaacttctgctagctttaaacttttctcctgtagcttttttacctcaccaagccatcatataattaagagagttggctgggcacggtggatcacgtctgtaatcccagcactttggtaggctgaggcgggtggatcacgaggtcaggagttcgagaccagcctgaccaacatggtgaaaccccatctctactaaaaatacaaaatagctgggcatggtggcacacgcctgtaatcccagctactcaggaggctgaggaaggagaatcgcttgaacccgcgaggcagaggttgcagtgagccaagatctcgccactgcactccagcctaggcaacagagcaagactcagtctcaaaaaaaaaaaaaaaaaaaaagagtcagggccttgctgtggattgggttttagctgaagggaatgttgtggttgatatgatcttttatccaaaccactcaaactttctccatatcagcaataagcctgttttactttcttattattcgtgtgttcactggggtagcacttttaattttcttcaagaacttttcctttgcattcacaacttggctcactgtttggcacaagaggcccagcttttggcccgtcttgggttgtggcgtgccttcctcgctaagcttaatcatctcttgcttttgatttaaagtaagaggtgtgcaaccctttctttcacttgaacacttgggagccattgtagggttattaattggcctaatttctacattgttttgtcttatggaagagggaggcctgaggagagagaggaggaagggccagtctgtggagcagtcggaacacacaatatttcttgattacggttgctgtcttaggtgggtgcagttcgtggtgctccaaaacaattacagtagtaatatcagggagcactgatcatagatcaccataatagatataataataatgaagaggtttgaaatactacaagaattacagaaatgtgacacagctgtcccactcacatcttgcctttcctgtcttttcttcatcagacactctccaaaagtggtcaaggctgcatctcaggtcctcaacagcatgtggcagtaccgagatctgaggagtctctacaaaaaggtaaggctggcttcacctgggccctgagtccaaacactcaacacgggaccctgagaggcgtcacagacgtggagggcactttcccacagcctcagtcattgaaacacaactgaaacgagaatcagtgaagaagccagaaaagaggcaatgtgtcccctgagtagctcctaagatccatgaactttctggactggacagacctgtgctcacagggtcttaccctaagtcatcttacagaaaagaaaataagctcattttcctgagcttcagtattctacagtagactaacaagtaatgacagagggattttggggaaaaaaaaatcaacaaatgttaacaagtaattttggaaatatatatatatatatggaaagatatatatatatatggaaagatatatatatatatatgtatatatatctttatatatggaaagagagaaacagagcacgtaattcaggaaatcaagaaccactgcaaactaggaacactgaataggagactcaactgtctggcccacgtcactaagcccctgagaacctcacagtgttactggccagaaggaaaaagacagtgctcccagtgacaaacgtggatcaccaagatgctcggcatttgttcctctcacaaggcaggcaggaattcatatcgcatacctccaaagagtcttcacccccaacatggctcaaaaatcccttaagagaaaaaagtcacatctagaaagttttattcaaggcctcatttccaaaatctgctcaataaggggtgcctaacttttcctttttggttaggaggggagaatttttttttttttaacatttcccagaagttgttgttttattgtgacaaggccagcaagcatgggagtttaaattcgagttaacaaataggggtagaaggccatgtgcagtggctcacacctgtaatcccagcatgttgggaggctgaggtaggcagatcacctgaggtcaggagtttgagaccagcctggccaacatggtgaaaccgtctctactaataattcaaaaaaaaataaaaagctcggcgtggtagcggcgcctgtaatcccagctactcaggaggctgaggcaggagaatcacttgaacctgggaggcagaggttgaggtgagctgagatcgcactactggactgtagcctgggcaacagagcgagactccatctcaaaaaaaaaaatatataggggatagaggacatcaccaataagcggggagaatggcataggcattggtttccatgcagggattcaggaagcacaaacaggactacagaagggtgcctgggcttccatcagcaactgcccacagcacccacctgcagccccctggccacttgcagggagtgggaaagccaagatcattgctgcctccatccccatctatagcccccatcccccaggtcaccggccactcactggccagggacgtgggaccacagtaaggggctcacatcatagggaatgagacccatcttgccagagggaaaatttgtatttttctaagcaatgggggaaaaaaatatttaatagctgtctcaactaagttagagtctatttctagatttcccccaaggcctttctaacttcccttaactattcattactttgcacttgaagttttataaagtgtagcctatatatttctctttcaaaattttcctgttccctaagaggaagtgtgtttaagttgaaacagaatgcaaaattaagtggaagttctagatcaatgagagtcatccctcagtatacacaggggattggttccaggactgcggcagatagcaaaatccgtgaatattcaaggccctatggaaattagtcagccctccttatacatgggttttgcatctcgcaaatactgtattttttatctgcatttggttgaaaaaaatctgcatattagtggacccacagtgttaaacccatatggctcaagggacaactgttaagtccttcacaaagcatttcatataatgggttagcataagccttttatctacaatgttttgggttccattctattttgtttgaaattcctatcccagcctccttagttaattccttcttgaattcctccaggaggcaaatgaagtctcgcccaggaaagagtccttcagctaaataggcagccagaaatgaggaacatggtataaattagaaaggaactggccattctgaatcagtggctccagaagctcaatgaaatattactgcctgaaataaaaccctctttcctttagatcctgaacgtttcctgtttgctgaaataaaccttctgatacttctgtgcattgaagggaagcagcttttagacactctccaggctctttcttgaatagtcatatgagtcttccatcttaatgtttttcattgttgttagtagagttcaaaaagcataattgtctgtctatttccatgaaaaaaagaatgtgttgacaggaatttaatggagctaaaactcaagagttgaagatgcttaaaatatgtttcatttgaagagattcaagaaggatggactggacaaatgaatggtgatgttttcagtggacccatgatttaaaaatatcgagaaagagctgttcttaataattaccaaattatgcagttgtgaaatgaaaggaagatctttgtgcccagtgtcataagtgctgctaatagcaaagctcaaaattcaaaaaagctttccttttgaaaagctcctttgtgagaaaaccaaattcattcatctttatgaattgtttttaatcagtggggaaatagatttctattttgttcttcactgacaatttgcatatcattgaaaaaatgtctgatccatatcttttaattatccatgcttcgaatctatttattaaacatctattctaggcttagcaaaggaagcgttccaaaggaaaacataagatatgggaaggaggtactaggggtaaagatgaaatatgaaactataatgggcaacttcattcagttctgaattacatactacaaattttaaagcatgaattaagggaaagaaacttatagaccaaatctggagaggcatttatggagtttgcataattaggaggtaagagataaggacattatggataaaagggaaagtgtgaggggagagatgggaattggattgagagttacatgtccgtggaacagaattcggcgccatctgtcatgctcattttcttgtcgaacccaggtacagaggccagaatgtcatttcattagctcacctactttatgttatctagggagacacattctgattcaaatcagaatattcttccagctgggtgtattgattaatataaaactatgtttgattcatgctgcatttggaaccaaagcatatttgtatcatcggaacctttgacttttgtgaagcttggccttctgggttattttgccctaatggaacatcaacagatgtaggagaatgtgatcacttgcaggctaaagaatgcatcacccttttaaagccagtctttaagtttagataaccgcaaatagaacttagatgttttgtgtcattgcagaggatattttctaaaggaaaagacgatgtgccatgggaagagactggatgtcggggtacaagagaagtaggagatggaaagttcttgactttttagaaccttgggacttaaaaagaaatggagtgactgaaataatagggtgcttatgtttgactatggttggggaactgtcaggatggctggttttgaaggaaagaagatgggtgagggggaggtcatagaattaaaagattatagaaatcatcatgtataaattcttagatgataccttaataatctgcacaacatctccaagaagtagttgcattggttgggacccaaaactataggagctgagactacacagggatccctttccctctcatggagctgtacgtgctcaggcaggtggcccaaggccagcaggtgaccttgatgcctgtcacattgctctgccttgcaaaagaaacatcattcctgcctgtgtaagcaaagcaccctggctctgcccacttctcattccagcccatagggtgagagaggggagaggggagggcaagtggcacagaagttgccagtctcgggctcacaccccggggtgagagctcagtcccatcgccacagccccctgccagggaggatggggacagggggctgcataacccctgcaaaaggtttgtggcaggagaagaaaggcagtaccgttccagcagtcattttcttcccaaatggctttaatgtcagctgtaatcacaacctaatgaggcatgttatcccattttggggtaactgtaatcatccaaaacttcttacttatattaagcaaaaatctcattatttgcaacttctgtcctctaaaagctgtactggaaaagtctaatctgtcttctctgcaatagccttcctggatttgaagctagccatctttatctacaaggtcatttcttttctaggtctaaaatgtgtaggggaggaaaagaaatatcctccctcacccatcactaggttcatggctgaagcccctataatgaaagacaaattatagtaacaagagaaaagcatacaaaattatctatataattagaaaattacatgagataattgcatgccaattaattatatgagaacctctgtaaggaaataaaggcccaaagaaacaggtaaacttgtgtatttttatgcttaagtttgatggagagtggacacccatggagaagtctgattggaggacaaaagggtatgatctaatgttgataaacaaggagatcttacggattcctctgtgggcccctgtgagttcagagataaggctgttcctttgctccagtataaggaggcacctctcgaatgagggttttatgacctgcttaagggaagaagcgtgaggggaaggtgagagagatctttctgcctctgttgttttcccaaatgccaaggtgccatatttggggttagcatgaatcccatcacatgctgaattctaatatgtcagcctttccacagccttcaccatgctatccttttttgccaaatgcatgtaagtttgttggtatccctttggtaatatagcaccccaaaatgaacgtattcctccaagcttgtttgaagcagaggagaatagacagagactatgctttcctgatgagggacactcaacttctactcataaaactggagatcacattggtgtctgaaaggctcatcctacaatttggtgaaatacaaagagtgcatggccaggggtccacagcacagccctgccacttaccagcagcatgaccttgggcaggtgacttgagaccccttgtccatcagtgtaagaactgacttccggcagccctctggccacctctgctgaggggtggaacaccatgagtagccctccgattcaccaggtttcagatgcgctagggttgcttggcagccggttatctgtacctgataagcagccattcctgatgaagagccaccaggaaagtaaacgacctcttaaaatggtctctggctattcttagacctggcagcatgttctctggaagcagcgggacaagccctcagatctttggaggtttggaagcctgggtcaccatgatgccttccttccactttatgtatccaagtctgtatctttccttgacctttgtgttaaagaaccttcatggcctttcatgaagtctgtgggcatctctccctcaatcccaccccctcccttggttttcccatccatgatgggaaagccataacacttgcctcagtggattgctgatgtctcaaatggaacagcagtcatcacagtgctttgtaaaatggaaagtaatatatccatgggagttgctgccattaattcaacaacacttttccaagctgtttgattggcaagtgccgtctctgccatcctgtccacaggcagctgaaggtttggatccgaggatttcattttatcatcatcatcatcatcatcactagtcacctctgcctacatttttacagctcctctccccctggtctctctactctgtctcctctagtcccactgtctttctgctttcccacggtctttctcctttctcccatgcagctctgcctgctagcgatattcctataggaaacagagtcccatgtttacaacagagagtgctaggtgctgaaagctggtgatcagaatggaggggatgctacctgcatgcttccgtgcccttgcctctccgtggactgcttgcctggaagacaagccaggccattcaaacagaccctgtaaagttactatggaaagggtcagggcagtccctgttgttaaagtggtagatgatttttccaatgttcagcttatggtcctgaagctcattttgctctaagaatctcaaagtgcttcagagagaacagcgtccactcagtatctctccgaatgaattaaaatccatagttcaggcggggcatggtggctcatgcctgtaatcccagcactttgggaggctgagataggcagatcacttgaggtcaggagttcaacaccagcctggccaacatggtaaaaccccatctctactaaaaatacaaaaattagccgggtgtggcagtgcaatccgcctgtaatcccagctactcgggaggcagaggtgggagaatcgcttgaacccaagaggtggaggctgcattgagcagagatcacaccactgcactccagcctgggtgacagagtgaggccctgtctcaaaaaataaaaataaaaaataaataaaatccatagttcctaagcgtatggatcaaatcacaggtagatcagacgtcagacccaacctcttgttgacaagcaatggggttagaaaccagatgcattatccctcctaatgttagtggtctggtgtttttatggttgtgcccccctccactccaccccacacacaatgttgttatcttgcacagtgagctcatgtcttgaagaatgccagactgcctgtgcttgaaacagagtaagatcatatttctctgaatagagacactgtattcactcttgccttcgtgatgagagaaagaaaacgtaaaactaatctttcaatgtccttccttttattgtcagagaagatagactcttgggttgcacagcaagtgaagaatgagctttgatgggagtggagtcatgcccttcatggcctgtctcacaccaggctctctttccttactgctcttggattcatttcattggctcttgcggccattgcactcacaaaacaagaaatcaataagtaattatagatgggtaagggaatgcctgtagatttcctcacatgtccaaatcagagtggatgaaggagtgaatacagccttttgtcatctttcgcagcttgcttgtgggagactgaccactctacatagatgagccagtagccatggccctgcaaactgaagtcatgttctcatgtttaacattactccatcaccctcatctgctggacatttgaaaaacaataccagattccagtgagaattagaaagatactttgaaatattgtcgaggaaaaacacaatatagtcaaaattcataattttatttaagctttgcagtatgaagggtgaggaatactgaagggctttaatatgtcttccaatatgttgccattttgagaattaatagattctactttctgggtatctaagatagggatgaaaaagcagtaaatcctctatagaaataaactaccaaatgtagagctgtcattttatcaaggaaattgcttaatgggaatttattaatcttcctactgtgctggaaaattcttcaacaacagattattggaagaacataaggactttcagccagattttaaaacaacccaaggctagtgtccacaaggtttgcaattgtagctcctcaagttctttcttttctaaatcacttgatgtcaagtaagggtagaaaacaaaaaggctaaggttaaactcagctaccatactgtctccttcataaatctggacgtttacttgttgatgtttggtattgacaaagaaggtctttcttcacgaggtctcctgacctctctgagacaactctcagacactcatcatatgatatctgtccaaaagcaaaggcacaaatgggaaaagaagcaaaaatcaattgtgcaaaagtggaaatcaatgcacatggcagttgctaaacaagaagtcactaagttacagctgttgctgggatagatccccaagtcaggggaaatcccatatagcagtacccaaactaaacacttcctctataattccaccatttcacaaggcttcgctcgtaacatttttgaatcaaaccctacaaaaataccccagagacaaaaggcagaatcaaaggaccagatcaggagctagtaaactcagtaagtttaatgtaagtctacatccattcttctcacttactttggggcaattaactcaaacttactccctcgttttctggtggatccagtagattgggtgatatcacatctatgagaactcggtgtgcttgagagacagcgtgatcagtttcttctctcttcccagctccatctcttctccctccccttctcataagctgtggcttcccctgtctcaatgcctcccaatgaggttgagctaagtgggaaaggagactcaaggagaggagagcagaacctgaccatcttggttatatcctggctctggtacactctgcccatgggagatgtctgctggctagctccatctctcatgagggcagtggggtgggttgctcagaagtaccaccctgcaaccaaggacctcccaactggggatgcctgacctccacagccatccgcctcagaattctcaatcagcctcagactacacacagaccagggaagatacaaattttgtgcccctgtagcttttgtcattttggaagtcctatttaagaagaagagtacactttatgaatataaaattaggtacagaccctggaaggggcccatgcgatgggcgggcatgaaagttcatggctccatggtcagttcacctctggcactgaatctctgtattgccccgctaatgccactgaagacaccaggcctgccacccccaaacttcagggagctcatggtgaaggtctttacatagtccactccctgggcttctggagagggaggctgaggaatccccaaccaattgattacttccaaggaagttctcaccaccagccgcttccaccctcagcctaatcttatataatctggagttgagtcatatgctaatactgcagaaccctattttgtccaccatttttgcaactccgagtggaaggtctaagacttcgagaaagtggggcaagggggcatctattattctttgccttgcttgggaccttagccagaacagagacgataagaaaattacattaacatcctggcatactaccttatcatcagtatttaattatctacaagttttctagagaatctgtttccttgccttttccagcttctaaaggctgcctgcattccttggctggtggcctccttctccaccatcagaggcagcagtaccgcatctttgaaatttctttgcttatgttgtcgtactgcctgctctgtgaccccccgagtctctcttataaggaacaacccttgagatgacattgggcctactgggatattcagaatgatctctccctttcaaggtctttaacttcatcacatctgcaaagttcctttggccatttaaggtagcatattcaccggttctgggaattaggatggtgacatcttctatgggggaggcagtattattcagtctcccactccctctcacataaaagcctgagtgtaatgatcaaagtctgatataacgcctgccagagccaggggtttggctcctcctaactccatgctcaccacctctggagtgttgccctcatctgtattatccacattggctatcagtttgcccacattccaaacaactggaatggaaaagagccagggagggcatgcctttttcttttagagacaagaatgtaaatacttccagttcttaatcaagtggccacccacatctccctgtctaggggcttaactgaaaagccgagtttcattacacggtgcgaaagtgaagaaaggctacggagatgttcattccctggacatccacgctatgtgtgcaacagcaccaatgctccttttgagtatctgtgcccagtttttataaaagccacattcttgggagatcccacagtgctgtcatttcgttggaaatacttccacagtaattaccaattggcttcaaccttgaaaacggccccaagtccatgactcctttgccctatgcagggaggccagccagttcgatggaaagagaactgtacgttttcagactccgttttgtagctggaacaatataagaacattagcaacaaccaagggaagaagtgaggtcacagaatgtggaactgtctcagatgtttcttgttgttgccacgtgtcctgtcataaccacgtgcccgtgacaggctgccagcagttcccgaggttaaagctgagtgaactcacagttcccatgaactgctctgagagagctgttcatgccgtcctcaccgccagtgctccatttaaccagatgacagattggccgctggtaaggtatgtagcataaaataaaagtatacagcaattgggtttttctctatgccagtctatgcgatagtacccccattttcttattctccttaataccatgtgattcctcttagagcagtcctgtcaatcctactagcaaatggccactcctagtagcttacattcattcgtaccttcaatgcatatttactgagtacctgctggatcatctgctcccttctaggttctggaaattctgaagtggatacatccacattgggttacctttccccagttacacagtggcatgcgttttagcaattttttcttgattgtttcactttgtgcttacttttattgggttctattttaaaatagaaatatatatttattccctatttatggtccaggcctcttgttaagtcgttttctcctgacattgtccattttcctcctcctgtttcttcatcctctccctctggtcattcttcccctagagatacatatgctcttcgtgcttctatcttacgatgtttgagaaatgtcctctccccatccttctccatcttctgccttctcactttctgctctcccatggtccagccttcacaatgaggtttctaggaaggttggagttcattcatggtgcctttcttacattctgttgtgctcatcaacccctagcagtcagtcctcatgcctccacggaaagggctcctaactggagcatccaacgagtctcattgcctgtgtgacttagggagggctccccactgtaacacgcagacctaaacatctaatgatccaactacacgaaagtttattttcttgctcctgtagtcatcctggacaggtgttcaagtagatgggtcagctcttctccatgtgggcactcgggacccagactcctccttccatctgtggctctggcacgccgtaagggccgcagctatacctggcaacacacatgcccgctgcctcacctccattggctagatctccatcacgtgggtgtgaaaggctgccacaaggagaggctgggacatgtggtctagatgggcatccaggaagaaaagggcatggactggggaggccctgacacatctttctctgttaaacagcctcctccctggctgctttgtcactattcttatttttctctatgtgggaaagcgccccttctcagtcttttttgccaataccctggtcctggtcttccctgcaacatccttgtttgggaccctatacctgctaatgtagatgatctcatctgctcccatggtttttttgttgttgttttttttaatagaacctgtctcatgagaacttcacagcatataggcaagatcccttcacaaaccactaccatcttaagacaattgttttttaattatactttgagttctgggatacatgtgcagaacatgcaggtttgttacataggtatacagatgccatggtggtttgctgcaccctgctcccatggtttttaaatgcatttgaagactagtttgtatccacatttatttctctatctggtcttcactgtttaacactaaacccatccatacaactacccacatgacatctgcacttagatggctcatcagctgtaactgtccatacatccagtgcttagctctcagtatattccctaaatctattcttcttccgtggttgcccatctcagtaaatagcacccaacccaccttgttgttcttttcagaaatctgagagttatccaactaatacttccttctttcttatctccactctatttttcacaaaccctgatgatatatttcctaaatatctcccatacccaactatgtctcccatccttacttccatcatcatctgtccctggtcctggtacaatattactgcctaattggttttctggaatcaacgttaccatcttcagtctattttccattaagcattcagaatatacttttaaaaatcccgatctgacctggccattctcctgattaaaactcttcagtaccttccattttctcacaaagtcctgctcacctccctgcgctgacttccgtccaccctgcctgcgatcgctttgcctcagccacgctgttcttgcttccccttgctcttcctctgcaggtacaaagcagtttccacctcagagccttggcattgcctgggcacaggtcaattcctcccccaggaatgcctccccttctctgcctccaatcctggttattgctgccccagtgtaactataacaccctccagaaaaacttcctgactttccccagctctctaaggctaatagcagtccttcccaataacctgtacttttccttcatggctcttacagcctggctattgatgtgatcatgtctgaacacctgtttctccttcatcttcccctcaacaaccatgccagtctctcttttcttgccctgtgctcagcatggtgctagctacttactaatttttattgaataaaagcaccagtgtagctaccccagagtgtaagcctagcagagggcatgttcaatgactctgcttccattcacattgtcattagcatttttcttttttttttttttttttttgtgagaaggagtttcactcttgttgcccaggctggagtgtaatggcatgatctcagcttactgcaacctctgcaaaaacgaaacagttcaagcaattctcctgcctcagcctcccaagtagctgagattataggcacgtgccaccatgcccagctaattttgtacttttagtagagacagggtttctccatgttgctgaggctgatctcaaactcccgatctcaggtgatccacccacctcggcctctcaaagtgctgggattccaggcattagccactgcgcccggcctgtcagaagcattttgaaggagactggaatatagagaacttgaagttgagacccagcgtaaacatcgaatttgttccccagtgatgagtgtatatgtaaaatagctgactgttcaaatgctcaaatgacatattagaagctagacatttgtattcctaaatctgaagactggactgttcagttttatcctgaacttaactttgcagtactaattgaaacacagaggacattgttaaagctcatccaagtcagatctttgttttaaggcctcaaaagcaaagccagggaggtaagaggactgatatggtcttatttcaatttcccaggtgttttcgtttctttgtttgttttggttttttgcattccattggtacctattaactcctagcggttaacaatggtatactttcttctactaaatcatatacattttttccaacttttcaaatcttcttggttacactggttctttagaattagcccagtagcagtaaattgaattcctaaaacagatttacacagtatttgcttttaaaagatggtgttgcacaagatccttatgcttatacgtactgtacctttaagtatccaaatcaatttaattaaatttcattagaagcaacagagctgaaacaaactaatgacagcaactggtatgtcaggtggtatttatttgtacattaaactgcaaatactcccttttggcccttaaaatttagtttaaatatttaactctaatagctcttggaattgttgatggaattagttttaatgaatctttaacaaacagtttaccttaaaaatagatgggagcttgttttattacagcagagaggagcagaaggttttgtagttaagcaaaatctggcttggtctttagtcacacagactgtgcatcagaatattctaccttcagtttattgtatttaataccttttcttgaaataagaaggaagtgtatgtgtaaatgccactaatttgaaatattttcattctctgcttaatgtgattacattaataggtttcttccactcaaaaatgactggaaaactggtacaattttgaacaatcaggcttctgatacgtgagcattaatgtcttagctggttacctaaggcaatgatttctgttttgactttcatctgaaaaataggtccccagcgaagtagtcttgcttgtgaatgtaagtactaagccctgagtgttacaggctggtgcatgggtgagcttgggttactaaaagcccaacagatttttgccacacttttctttatatctcaagtcacttaaaaaaaaaattagacttgacaagctttgtgggctgtagagccttcaaggacagctaaggtgaaaagcttgtgtttgtgacttcagtaccaaatagtctgtgtatggccactgaggaatcctcgcttagaggccaaatcttgctacattaaaaaacttccagaactttttaaaaaacaggtagaaaaaggccatacataggccaacagtgtcctagtcattattttgggttccaattaatatccccagtagaaataaacaagcattgttcattttcaaagttaattatttcttgaagctcctgggtcagagaagtctcttataagaaaatagttgatgaatctaacttctaaggatagaagacaaagtttccaaaactctctttggaaacaaaattatcaatagaaacatcaacattgaccatatcatcacagctgtggctattcactgggtcaccctccaccccatcagggtcaagtttctaaaagttgtcttccaggagcagggtcagaagccaccatgcacgtaactcaaaattccattttctgctaaatctcatctgttgaaacaccttaatgaggatttggtatttagcctgttttctctccccataatcaccaaatccactcaaccttcatttgagcagcccttgaaatattcactctcccctcccaccttctctctaaactctattacatggaatgagccaacttctctccctaatcccctttcctcctcctccatcaaggagtatccttctccatcctttctgtgattcagcagaagtagggtgctctcacctgctcaactcaaaatggcaggatgtcccttcatagagggaggcgggagcctcagaacacatgggtcattctcattccaccacatctaaattctctccactctcttattgacatgctctgcatgttttctggagcaccactggtcatcactgttccctacccagtaatattcccacaaggtgacccatccagaaaccaaccccttcagtttagtaggcacattctggaagcaggtgtggactgctgtacccagccctaaaaggaattggggcatagctaatgagaaaggtaatatactctccccttttatcctgtttcctgattcccctatggatctgtgtttgtggggaactgaatgcatttgccatgggcaggtacctatatcttcttctgagctccatggggcaagaagcactggaggtggagggacaagctgtgtgctccaactgagtcagcacccacccaggggccagaggtggcagagataatgatgcttcaaaattattttccagaccggttaaagaggaggcaattgtatgtactcacactgaaacatggtcagtggagaggaattaccatttaaaatagagcaggcaagccaaaggccacttttcttgtgattgttgttaggtactattttacctaagctaacactacctttagcacagttgcgagtatgtcataaaagacagatctaccaacagcagaagatgattctgatgaggttactctgagctacaattaaaagaaaaaggttctaaggctctgaatgtatttatttcttatagaatagagtgtaagaaccgtggatgctagctataaaacctgtgaaattgattatcatttcattttacaataattaatactgtcatcttaaatcattgactccagctagcattgattaggcacctctgtgttccaggtactatgctagataccacggcttcagaaataaatgaggcacccttgctgcctcacagctagggagacagcctgcattgctaaagtctgtattgtgatgtaaaagcattttattactatcatggaaagaaaactggttgcattactgaaaactccccccaaaccagggtggcataatttatttggcaatagtaattgaatgaacatgcattacctgcctcctgtttgcctaatacagaaccaagcaggataagatttaacaggtagaaaaagacaaggtgccctgctatgtcatagagctgcctgatcaaaggtggggatgtttgaaattgagtctcataagcagtgcatgctgggtgatcaggtgtgattggggctcagtgtgtgtggcacctctctggcctgagattttgacctgttttgttactatagaagtcaaccttgggaatggagactgaagggcctcctgggatttagcactttaaaaaatgtgccccaacttgtcactgacacctatgcaaagaaaccccaagccaatggttcacagccctggctgttcattagcatccatttgggggaggagtggagcttttgaaaataaggatacccaggccctacccggaataacctaaagagaacctcagggctggggcccaggcattactatttttaaaactccccagcctgatgagtcacattgcccttaatgtgtggaaaagaagctgagatggagcttaccagtaattgtgagagaagggccaactcctgacagctctctaattccacctctctatctgctgagacacccagggttagcaagccaagtagtgaaaagatattcatgagaatagttttgagccttgccagacagttctagctcatcccctgcatacaaagctaacaaactcctgtgctcatctgaactgaatgtcgtgcacatttttttctttcttgagacagagtttcattctttcacccaggctggagtgcagtggcacaatctcggctcactgcaacctctgccttacggtttcaagcgattctcctgcctcagcctcccgagtagctgggattacaggcacccaccacgacgcccagctaatttttgtgtttttagtagagacggggtttcaccctgttggtcaggctggtctcaaactcctgacctcatgatctgcccgcctcggcctcccaaagtgctgggattacaggcgtgagccactgcgctcagccacacaatttctagaataagaagctgtggctcaagtgtgtgttgtcctaacctcctgtagaccagtccgaatgaaagctacttagtcccctcattcaaactgttagtagaagtctctctagtaatacattcttcttggcgatgtttacaggatgttcagaaatataaaatggagagtgttatagattcagggccgtcgaaatccataaaaagaagacctgtatcaactaaacagactgaccacgtcctagaaataccgtgaagaccgatggtagtggggctgtggggatgaacatcgcccgattgtcgtgcacattggaaatgcccgtgtggacgattgtagctttggggaataataaagtttcataagaaacacattgaaaacttgagcacagaggctgaaagtggtggagggacagctaaagggtgtaagataaagaacatcagattgttcctggtggcaatttaaagttcagtgactttgaactcatcttcttttttggatttctatctctatatacttggaacaatttaacaacctccagttttaagtgtaatgtgttaaaaataaaaaccaatttgaggcacagatatcatatcacatttttgacagcttagctgcgtcttcagctgaagggcacaacttgtgggtcagtctgttgaaggtgaacgacagatagtaaaagagttctttatcatcaataggaaggattcatggcccttccccggttaccgtggtgattcttcactctccctgcttcttccctgggctttcttatctaacccctatgagctgtacaggtggtgcaaagaagagctaaggtaaaatgcccaatataacagaattcacaaaagaagtctctggcctacaataagttgatattttaacaagaaaatacagtgattaaagaggcaaataatgattgaaatgatatgtgcccgagttgtatatatttatgtgaaccacctccaagccattctgagtgacagtgggaagtaaatgaataatagattgattgctagctggctagataacaaaaatatacatggctagtggaatagaaggaatgtcagcttagcaataactttcccttcttatttaaaaagtgaaacattattttaattgaatgactaaagattttatacaataaaagatgaggaaggccatgagatttgtgctcaaggtgtttgtaatgagtggtgattgatctatgccatgggccagctgcaccctagcctctagcatctagtgttccatgagtttccatgacatttggcagctgctcctctatatctgtgggaaattggttacaggacttcccaaggataccagaatttgtagatgctcaagtcccggctgtattaataaaatggtgcagtatttgcatataacctacgcacattttcctgtaaactttaaatcatttctagattaattataatatgtaatgttaatacaatgtgctatgaaaataattgcattgtttagggaaggatgacaagaaaaaacaacatgtacatgttcagtacagacaatatgttttggaatattttccaccctaggttggtgaaatccatggatgtggaacccacagatacagagggccaactgtatgtggcatcggaactaaagttttaaagtcctttctgggcattgttgagcatagcagtgttgaagttgtgcagtttagtcactgtagccttcactctgcatcgatgaatgagagaggggagatggagaagatcacctcttctcacagcacacaaattttatgtttgtctcattgcagtgtagaaggtattctgttcctcctggggcttctgagctgtgggtcaggaaacagctctaacgaagatatttattgggtgtttactctgccccattccttaagctcccttctcccctccattcaaagtgcctatacccacaggcatgcagtccctggccatcctcagagggtctgagtcagggattgcttctccgtttctcccaccacactccgctgtcatcaccctcagttgtatactaacccaatcacatacagacaagttacctgcgggaccacacttctgccaggcatttgcattttccatatttgattttatgaaggatttgaaaattttttgagtgcatccatataggagttcctttgtaagcaattttgttattacactcagttttctgacatttccagaaatgttaatacttaaatggttgcagtatagtctaaacatcatgaaatctgagttgctgagcaacacatatctccaatcacctgcataagagagcaatgctaacaaacctactgatgtctcaccaagtgaaaccagtcctacagctgtgccacatttaggtctagtgtgtccttaggtcttagaacataataaatatttagccaatattcacattgtaaagtaccttgttcacctttaataccacacagaatatcatcacattcatagccaaagaagccaaggttttgactaaacgactgtcccgagccactacttggaatcccaaagcacaccttctacattgcaatgagacaaacataaaatgatctgtccccattcagtcatatttaggacttctgccctctacaaagcatttccttcaaaagacagggatttaaattttttttttttttttttaagatggagtctagctctgttgccaggctggagtgcagtggtgtgatctcagctcactgcaatctccgcctcccagcttcaagtgattctcctgcctcagcctcccgagtagctaggattacaggcacgcactgccacgcccagctaatttttgtatttttggtaaagacggggtttcaccatgttggccagaatggtcttgatctcttgacctcgtgatctgcccgcctcggcctcccaaagtgctgggattacaggcgtgagccaccgctcctggcctaaaaaaaatgtttttaatcgttcccatacataagtaatggacacatacattgttgaaatatcttccatcctgaacgtgtttttggtaagactgctcctcctctgtgtttgcctccaccctccggaggatttcagagaaccccacagaactccagtggagacattttctcctgccgtgatacctacctaccacccccacccttccctaaggaggcatttatttgtaacttacacccttcatctctcatcacctcagctgtcacaatcacccaagcctcctgggacgaccatcattacctggacccctcgatcaaaggctctgagcagccagttatcccccatatattccacctgtcttctgtccacctcccatttcttttccctctttaacctgtggttaaaaatcagcaaaattggccgggcacagtggctcacacctgtaatcccaacactttgggaggctgaggcaggcggatcaagaggtcaggagatcaagaccatcctggccaacatggtgaaactccgtctctactaaaaatataaaaattagctgggtgtggtggtgcatgcctgtaatcccagatattcgggaggctgaggcacgagaattgcttgaacccaggaggtggagtttgcagcgagccaagatcacgccattgcactccagcctggtgacagagcgagactccgtctcaaaagaaaaataaataaataaatcagcaaaatcccctgtgtccgtttcgcaaacctcttctgctcatctcctgtcggccctgaggacacagccccccgagccccctcctcgagggctgtttaatttcccacccaccctccctcccttgtgtcccaccctggaggtggaacagacgtccttcttggagcagtcgtctttcttgccccctcctcattgctcttttgagaaggatctccgctcccctccctcaagaaaacccccagcacctgtgaagtatcctcccaacagcctgtggccctcataagcccaccagtaccctgatcaatatacactctccatatcgtctctagcacctacattttcctccctactgggcttagcttccgtgacgttcccttgtctctctccaagttgcctgatgacccatcaactctacccactccacacctgccctagggcagctgactgtggctggagagaggcacacacggatgctgaccagtcagctcctttttggttcattgccacagcctccagccctgtccggcaccccggccacttgccctggccagtcagctcgctccccacccaactcaaggaccactccacatccccgtccccttccttcctcccttccctttctctcttctctctgttctctaagctccaacccttccttattctcagcagatgacctcacttcttctcattttccataagaaaatgcaaaaaacaaaaaaatcaagagtgaatatccttatcttcctgtcaccccatctaccagtctcttccccatgtccatggccacagtctgtttctgtgggcagtgaccccattgctcacttaatcttatccacctttcctgtcttgagaatgttcttcctgccatttttccctttctctcctatgtccccaggtttttccttctctgcattcagtcattcccatcagcacacgaaatactgcaatatcttctaggtgatctatgaaaacatctctccagccctcactctcttcaagcccatttctccatttccgtttaaaataaaactttgccaaaggcttgtctgtactcactgtctccccttcaccaattctcattatcttttgggaccgctggagttagacatttaccaacctgaccaaagaaagcacttttgtccccgtcacgaggacttccttcctcccagaccaccaggcagctcttggtcctcctcggtattcggttggtctccttctcctcctcacgcattgctcctttggtcttgcctgatgccacagtcacaccctcctgatgcttcctgtagttcactgggttccttcttggtctcctttgaagcttcccctactctttgcacccctctcaatattggaatgtcctcaggctgactcagcctctgccttctgcttttctttatttgcattcgcttacaggtttgcatccattctctttgctttaaataatatctatatgctgacgtccaaaattctgcctccagccctgagatcccagtttgcagatcctgcttccttctctgtccctcttcggtaaccatatacgtccccatgaggcagtcctagttccactccctaaagctgcttccctccctcccattgttcctggctcagtgaaggggacctcaggcccctgtggttcacaccagaagcactgcggtaaggcttgattcctctttcccacaccaatagccatgccaccagcaaaccctccagtgtggataccagatctgcacgcttcccaccaccagcacccttcaagcctgggccatctctcctctgtccaggggagtgacctcccaagcagctttgctgtggctactcctccccaaactgtcctggacacccagagctttcctgtcttcctggccccctgctcacgcctattcagtcccaggagcctgttctcacaccagcgaagccgttcccacccagggccttcacatctgttcttctgtgggctgggaagccaagatctgtgtcaccagggtctggttcaattgtcatctgcaggtccttctgcaacgttaaggctcccgacagcacctccctgaccccactccacaaaatagagatgccagcatcctcacccctacttttctatacccaccccgcccctccttccccgccccccttcctccttcccggcccccgctcctctttccccacccctttcctccttccccgccccgttcctcgttccccgcccccctcctccttccccggccccttcctccttccccgcccccctcctccttccccggcccccgctcctccatccccgcccccttcctccgtccccgcccccgctcctccatccccgtcccagctcctccatctccccccaccccgctcctctatccccgcccctgctcgtctatcccctaatccggcttggtttttccttccaagcacttgttagaatgccacgttagtattaatatgttttttgtaacttgtgtattgtttgactttgggtggcctatttactttcgaaggctcaaattcttcctgtagaatgcagataatggtatccattagtttggttttatttccattagagtaatatgtccaatattactgacattatagcaaaggaaagcaggcactgtcccagcccctgttcccactttacattggcacttgttttcaattctttagcttttttttctgataatatttagacttttaaggggctcaaaactctatcaaaaatcattgaaaacataaatagatgaattaataaagaacaaaatgcatactcatttccatgttcctaattcttattagatacaccaagactaatctttgtgtatctaattctcgttattcctgttctacttgactgataggataaagccagaatgagaggtgcatgattttaaaagatattacccagcttacttactaggtgctaactgtgtggcaagattctctgaacaatcccaagagaacaaagcattgagccccttaaaagtctaaatgttgtcaggggaaaaaaataaaaaatctaaaagaattgaaagcaatggcctctgtaaaggaggatttgggggtggagcaggtgactgcttttctttgctataatgttagtactatttaacatgttactttgataaaaataaaatctatttaaaaaagaaaaaaagactggaaggaaataccatgacaggttaacaggagttctctcaggtggagagggtggaattaccacctatttttattttcttctttatgctttgtaaattcacaaaataatctgtgatatatttatgcggtttttataaggaaaaatagtatagatgctttctgtatattaactagatgtcagaagcctaacggaggcttggtaggatgcattttgaatatgctctatattgaaaaatatcattcctggagcagaccagcttggagacaggcgagggtgggcatttggggctggaaaggacacaggcaggtaaacgggaagggaggacgctgccctggattctggttgccaacagataggtcctgggagcaaaggggtaaacccttgtggaaaatcttgaggcagcggaagagggagccaggcagagctggaaccaggtcggcaaaaaatagacagtttccgggtcccctaacattctgagcatcgtattttcatcgaagtcgaagcttctgaccagagcgggtttgtaaagggaccatttattcaacattcatgaaggaaagcaggccctacccgccaggctctctggagggaaggaggtgtgtcttcattcacatttggctctgttcacctccatgagagcgcagaacttcaagaacctcttctgacacaccatagaaatattatgcaaatccagatacttggaacttaaaaatgtccggaggtgaaaaatcactctgtcttgcccatctaacaggagcgtgctgtgttttgcaggatggatggtcacaataccactttgtagcctcgtcttcaaccatcgagagggaccggcaaaggccctactcctcctcccgcacgccctccatctcccctgtgcgcgtgtctcccaacaaccgctcaggtaagaggctgccgtggctagccagccaggctttatttctcgttgagcaaagacggtccttcccagtccgtgagccaacccgtactcagaggagagccttccattcagaccttcgctagaagtaggaaatgaatctgttctttgtactgtggtggccactctgtgttttgtatacacagactcagagcaaatctccttctctaacaggttcttatgcatgacatgcacgtaatgaacctgaattcaggaggaacgagtataaagaaaactgtcatgtgtctgcaaatccggggtttccgtggacaatttttccaacttaaaatagtttgagttggcctggcgaggtggctcatgcctgtaatcccagcatgttaagaggctgaggcaggcggattgcctgagctcgggagttcgaaaccatcctgggcaacatggtgaaaccccgtctctagtaaaaatacaaaaattagccgggcttgttggcacacgcctgtaatcccagctactcgggaggctgaggcaggagaatcacttgaacccgggaggccgagatttcagtgagcagagatcgcgccactgcaccccagcctgggtgacagagtgagactccgtctcaataaataaataaataaataaaataaaaatagtttgagttgcattttgtcataattgggataaaaagttgaggagaccaaatgtgctttcttccttcagtgtgatatacatttgacacatagcactgatgctttcataactgttccacatctaattggcttttcattattaatgataaaccggcagatgccactgataaattattatcgtagccaactataacttccatgtcattccatttaatttttttctaattttgtcacattcctattgcttaaattttgaacttcttgtattcgtaaaaatacttgatttttataccctttttaattcacattaagaaatgccaaaaatcagaggaaagatgaaaggcaaatgtgaacacaccatttagtaatataaatggcataaatttgctgttttcctcacagtttagtttttaaaacttttattttgatttctgcattttgattttgttctgagagtgaaagatggataacaagttatatgcacccacacagatgacagctatgtaggctcttatttatgaaagctttcttcctactcttctctgccctctccctgctgaggaaatcctattctctgaaatgacacctgggaggacctggtagagagcattgcccagcaaagtggtctccctacccgcgagaatgatggttgcagaactccacgccagactttactgtcaacatgatgagaaatgaatggccaatatctgactgaaataaatggcccgctcccagctctgtgaaagctgatccttctagtgtactgtcattgcttatcacatttagtccaaccctgggtgacgatcaggaaccccctgtacctgtggaaacgtccacccatctcagaagcatggaggtggcctcttaggcctcttatttctgtaattccagcaggcttaaaaagataaagcgcatggagtgtggaaagcatatggatggtgtcttttggaaagcagtgattattaagaattacagtgagccaatcagtgttatgagaatgaaacgacatgatggatcggcaagggctggaagagagaagcagccttttctcgcgagcaggcagggctgtgttcaaccagccatgcagacagtgcgctgcctcaggacttcctaggcgaggcacatccagacacctaataaacacttgtttgcgtgatttgatttttcccagaacttaatcctgatttaccagagacttggagcaccgctgtgtgtgaggtctcaggagataattacacacttgatgtggtttaataaacaccaccatctgggcaatattggattctaattttaaaagctgtggtcaacaggttttaaaatattgtcccttcatgattatgtggcagtaactcataaaaggctaacctttattagggaagacccagaggcaaaagggcaaaggcaggaagagagactttcctggaagagaaagatggtgaaccaaagagaagggggcagcaggtggaagaggttagcgaggaaccagcgagcagacaggaactggatgcagagcccagttgagtgacagggcacagagcttgctaaggactcagttgttcttgcagaggttccctctccaagcaacagaaccccaatcttcatacgacacagtggctgcccctcacatctccccagattcacattcgggacagagatggcccaagtcccagcctttgtcctctcccctggaacctctcttccctcacagcagagcctgggcattctctccacctacacagggtcactgtggatcagggaggttcagtccttgatcaagtcattgcagctccaggcttgtcctacaagtgatgaaggtgctgcagctgtctgagctgcatggttttcttccctgtctgccattgcatttgtacccaggacttctggccagctggcattgggtggggttcaagcctcagtattttttttaaaggattccaggtaatgaattctaataggcatccaggatccaaaacccgtgatggcttcaagagctgagcattgaggcgtgattttattttgataggtttgagagggtggcaacaacccatgtttatcttcccagcacttggctgtaacgtctgttgggcacttctgcctctcattctactttatttggacatccatttccttactcgattgagagctgcacaagttcaggaagagccacgtgatctgcatgtctgccttgcacagtggctagcacaggaatttgtacatagaagatataagggtgacaaactgaatcacatgactcagtgacatgagaggtgccttgggggaccacagacccaaggagcaaagagaccctacagagggtgtgaatgataagctcgaaggtaaactgaagtttggctggggaggagctttgacactagcaaaggaaagagagatttatcctaaaaatcagagtgctctagggattcctagccttaatagtcaccaagtatgctcagtaaatatggattctgaagcccgtcactgaaaattcagactcaaaaggtccaggatgggctctgggcatccataaattctcaagtgagtgttgagggtaaacaaggctctgaagcactgccctgggctatgggagctggggagagcttcctgacagaaggacacggcacctgagctcctgcggagctggacacagctgcaggtgcccacagggtggggtgcgcgaccagctgccccctcacccagacgcatggctcctgccaacctctcccagtgcccctctgcactggcaggaaggttgagttgctgccaatccattcagtcactcatgaaaattcaacctccttttactgacttccttgcctctgagttcagcttttcctctcttctagtaccagttttttaaggactcctggaatttcccaggaggatcctccaattacaacccagcactttagaaatgggtgtaagaggaacggcagggctcagcctcccagccagacaggcagtgagtggctgaggtgtaaggagggcctcagagattattggggtgtttatgcaaaaagctggagcaagaatgccctagcaggaactagagctgcctccatgcccctccccagcccaccccagccacagacaaagaaggtctttgtgggcttggttatttttgccccacaaatcatcctgtgtagagagctgtttcctctgacttttttaaaggcagtttctaggtgactcagtgtttaagtaaaactgcatttattttaatcaaggattagtcaatatcagtaatagatcttctgaaacacatctaattaaggaagggagcacgggaaggaaagggaaggaaaagagaagagaaaggaagaaaccaaaagcagtctcattcctaaactgccccacacaccttgggcaggtcacgtcccctccatgatctctctctgaggaagatggccccaggatgtggtccccagttgccagcctccaaatcacatgccctctaactataaagcatcagttgtcacaggtgagggaatggggcagggacaagagccaaaactgccaaaaaataaaaattaaaaagaaaacccatcaggtcctcacgtaggcattgagatgcgggaccatgcatagtgaggaccctgactgtgtggaaggcacacacgctgtgggatgagatgcagaaaatcccccttttgatttctttatgtagcaagtgccccagcttcacctcgggaaatgatcagcctcaaagaaaggaaaacagactacgagtgcaccggcagcaacgccacctaccacggagctaaaggcgaacacacttccaggaaagatgccatgacaggtgagcgcccctcgcgcgccccctcctggaacttggtggcttgacccgcgacaaggcagagatatgggacatcaggcttcacggggctggctgcgcttggctgctgagcaggacttagcagctgtccagtcacttgagagcttgataatgatgatttccaagaattgggactaagaatagaggcataactaagataaaatgttttctacccatgttttatcggtcctttcctcttgtttgcccagctcataatattctttcaaattagagagaatattcccacatatttcttcctcattgacatcacccactggggaggggactcgatggaggcagtgtagttaggccctgtgcattaggaatggagggaactgaaaagaaggtggaaggggaggggaggggaggggaggtggggaggggaatagagtggggaggggaggagaggggagtggggaggggagggacggggaatggaaagaggagggcaggaggaggatttaaggggaactgcatgaaactgctgttgagatattttcccctcttgccatgatacaacctcttacgtgacatatcccaaagaagcttccttagagctgatgactgcagattccctggggaggcattcatctttcacgctcgtcatccctcacgatctcagtcacagccattgccttcctttctcatcagccaagactctatggaggccagaattggtacagtgggtatctgtctctgccccctccactgtgccatgcccagcccatctgataacagggcttacccttaagtcactgtatagtctgtacgtcttgtacactctgtatatgcttctgttgaggcactcacagccccctccaagctctccatacctcaccctctccctggatggccctcctccaagaagcaggatgtgggctctggctgtagagggagttataccttaaaagcaaagctgccggagccctgaggacctttcaacggggaccccacatcctctttaccacatgggcatggagatgggtccctgctgaaaataggctatgaggaagagcctttaatagaacaaggccatgttagagcattcataaagctggggcgcaaagggcgccgtgcagacactgagaccctcttaggagaggaatctgaagagcaggaggcagttctccagtagtatttaggtgtagactggcagggaagcagagcagacaaattggatgatttattaaaatgccttccaaaccaggacagcgaagataaatttttctaatagcaaatgcatttaccccagcggcagtgttttccgtgttaactctgctcagctgcgtaaagaaaactataataaacggatgtttcttatccctgcccccaggagcacattctgcctccatgtgcagaccctacaagggaacacctcagcgctgctcctgagacgtttcctgaacgggagaacctaactcattacatggactctaggttactattcacattcactgtttccccttacatgttgccgcgtagatgaacaggaacaaagaaagctgtgaatctgaattctgagtccctggagtctagacattcggcagaggatcccatttgtactgattatgctgagctagtcatgacaccaaattcaactgaccctttcaatgtgcagttatcattgccctgggtagccacatcaccagctgtctgggatgatacactgagattaaggaacagttgtgagatcgactgcattattattcagtttcatgtttctctttaactctcttgcccaagagaatcattcaaaaggccttcaggtgtgggtgtgcgtgtttatgtcaaaacagttccaatggcacataattgtgccctggactcaaaataaaataaaacataaaatttactatgtttctgatatttaatcttcttagaaaatggcagggatcttgacaatttcagtgtatgtaattcttcaaacttatttagaggcttaaacagctttgctctaacttacttaaaaatgcaattcaggagtacactctcaatcatgtagcaagccagaaagaacattgagatctttattgaatattatgtgtatatagggaagttcctctaaagccaatgggtgctatgtaaacgccgattgttattatcacaacaatgatggtggtggtggtggtagtgagggtgatggaggtgatggtgggatagcagaagtgaggatagtggtggtttgccactttcagtagtggtatgaataagtccccagccaagccaggtggaagccagtctttcacatattgatggggatattgagtttacaacccccaccttgcaggatgttagcaaatgcccatcattccagggtttacttgcaaaatcagatttcttgtggccccaacatcaaaagcaatgctttttcttgttcaagaacaaatctacggaacatttaaagttcagtgcattgaaagataacctgaaaaactgccatcttccttgtttcattccctgccaagaaaacattccctctgatatgaaaaccacaagggaagcttcatccccaaaatgcagcctatgagggctggaagtgcaaacatctctttgatggagctgtcatctcttctgctgagctcttagaagttcagatccatctaggtgtttattccaggcttcccccaccctccttttctggattcattttctagcttggatgaagcctcataaaattcttctctcctaagtgtttctctgccactggagagccctgagaaatccagttggctattcattcaggcatgccggcttccatagcgagttcttgcagccctgcatgcctgggaacctcacgtgttcagttcacctcaagaaagggctgcagcatcccagcagctccactgcctgagttttaaattcacctggaggttttcccttcccatctgaacttcccacataccctttcatccaatggtctgtttgttttttgtcagtgtctttcttatgccatttatttatgtatttatttatttatttatttatttatttatttttgagacggagtttcactgtgtcgcccaggctggagtgcagtggcgcaatctcagctcactgtaacctccacctcccgggttcaagcaattctcctgcctcagcgtttcgagtagctgggattacaggcacctgccaccatgcccggctaatttttatatttttagtagagacagggtttaaccatgttggccaggctggtcttgaactcctgacatcaagtgatcttcccgcctcatcctctcaaactgctgggattacaggcatgagccaccacacccggcctcttatgcctttgaaagtcgttctagtcttcaatgtgttgattcagttgggaattgggtatttgggggctgttagaaaaatagaaaggcattcttctgtgagtccactattagctcggtcatatgagggcagagcctctgtgaattcctctgcctcacgtgtctgtaaaggtaattcagtctcagctatggtctcgtttaaacgagtgaggggaaagaacttccagtattaacatcctaggctcagaagccacaaactgtgcctcgtgcttttaagattcctctggtgagagcgtctcagtgtctgtttatgatttcacaacagggagggaggccaagactgcaatagtgcaaacgttctaaaaaatatatgcatttaattctgagcaacagaaaaaacaaaatttcaccttattcctcaagtgacattttctatcagcaaattatagctctgaaggcagatctatctaaggtttacccatttattcattcagcaaatggggcacttactctatgggtgtccactgaggccaggtgctgtgccaggttctgaggatacatacggaggtagcagcaggacagactgtttctctctcaagggccttctgctctggaagaggaaggcagacagtacataaggtaaacagtataacaagttcccagcaagatgatactgcactgtgtttagtaggaagaagaaactgatcagggtaatgagatgggggtgcaggcggaaggggttacttcacttgacgtgggaggaggagacatttgaagtctgagggaagcgagttccagggagaaagatcagcaaagacaacctcaccgaagctaaacaagtttggcccgctctgaggaaggagggtcggcaaagctgggactcctttaacaggaggagaggagggagaaatgtgttaggattttaggcaggaaacaaaccttgcagggcctcatggccatagtggagagccgtctcagggtgaagggcattggagcattacaagcagagaaagagacagaacccaacttgtgttacaaagacagcattctaactgttggtaacagggtggatggaggaatcaggctgggcagagtggaagttgggccttcgaggaggatttggtagcaatggtccagagagagatggtggtttgcaccataatacagagacaggagtgacatgcattcaaccagagaggataacagaatggtctttaaaatggaaaaatggactttcggctctcactttctaagctgaattctccaggaggaattttattgcacagctgtagtgaactcttaggtaaaaaatcatgggtggagtgaacttagaccttgagaggttatactgacctttctcttgtggcctataggtagagtgatcctacttcattatcccctaaatactggaagcaaacaatgagcccttcctagttttagagtgttttataccccactgacacaagacagcattttccaaagcttttttaaaaaaaaatttatgaatacataatagttgtacttacttatggggtccatgtgattttttgatacaagtatacagtgtataacaatcaaataagggtaatgagataccatcaccttaaacatttattatttatgttaggaacatcccaattccattattctagttgttctgaaatatacaataaattactgtgaattatggttgccctatggtgctatgaaacactagatcttttctcttctaactgtatttttctacccattaaccatcccctcttattcctctctcccaactccacttctcagtctctgataaccatcattctactgtccatcttcatagatcaattttttttagcttccgcatattccacatgtgcgtgagaacataccatatttgtctttctgtgcctggcttgtttcacttaacataaatcacctccagttccaccacgttgctgcaagtgacaggatttcattctttttatggccaaacagtactctattgtgtacatataccacattttctttaaccattcatctgttggtggacacttgggttgattccacatctaggctattgtcaacagcactgcaataaacatgggaatgcagatatcttttgatacactgatttcctttctttctaatatacacccagcagtgggattgctaggtgatatggtcattctaccaaagatttcttgaaccatgacccttcagcagctgtgaagggagtggtggcctgtgcccttcctctgagtgggtggcttgagcttcaagggtttcccataaggaagtgggctaataggccccctctctgggccttcagaagctgctggcaactagaggagaccttcatctctttcgtctagacgacaggcaagccagacaacagagtgggatcctccctctgcatctagtttgattccaaagccgcaggcttccagatacatgggggacatgcaggcgatgccccctgcccgtcctttgggtctgtaagaaatgaactgtctgaaagatgatcaagcacttctgtgagctcaaattagaaattttattcttgtcactctccggctaaaagctaagctgctgatacagactcctgcatgcttcagtgcaggtgacaagcctttattacctgccagttttcaccagaaaagaaggccataaaacttacaaaatgaccatctgtttgcagcatctgccctgaccctgtctgtgatgtgaacattattgcaagcggctgacatgctgtggggattttctagaataactgttctccttttttaatatctgtatgtaaaatgaagtgttcagggccaaagaatgtcttctacttggaatggtccccaagaaaacaagctttgttagggcaagaacttgcttcaataacaactattccttatttgtaatgttgttttctttgctaaacttttgttttccttttgcttttagctcaaaacactggaatttcaactttgtataggaattcttatggtgcgcccgctgaagacatcaaacacaaccaggtaaagtaaatgcaacacgtttgtatttccttttcagtgtgactcatgtgaaataacctggaattttaaacataaactttcatccaacatacataaagaactgaaaaagaaggcaacgtcccctgaggccctctcctcacgcctgttgcagcgtgtgtgtgtctgtgtgtgtgtgtgtgtgtgtgtgtgtgtgtgttggactcggcagaacagcctcaaatgtgcaaacggcctttgaacctcatgcttgatctggtgcagaaggcaagtattctgctatggtgcaaaactaaaagaaacccccaaatagacaactgtaagatgtcactaaacaggaattgtctaattactggacagagatggagtagctcctgtaaccctgcaaatgcattaggaaggaagcattcattatacatgatcactaccaataaaggagacacagcaagttcaatagagaacttgtaaaagaacacataaataagttctattattctgcaatacatgaaatgcattgtagtgtcttgctactcaaagtctagttggggaaccagcagcatcaatgttacccagaatcttgttagaaacacaggagagattcttctctggctcctaaccctaacccgtccaagattttctgcagcacagttgcattctaattagatgcgcttgtgtgcacattcaggtttgaggagaactgaacagtagattctttttattattattattattttatttttattattatactttaagttctggggtacatgtgcagaatgtgcagttttggtacataggtatacacgtgccacggtggttttctgcacccatcaacccgacatccaaattaggtatttctcctaatgttatccctcccctagcccctgacccccagcaggccccagtgtgtgatgttcccctatgtccatgtgttctcattgttcaactcccacttatgagtgagaacatgcagtgtttggttttctgttcttgtgatagtttcctgagaatgatgtttccagcttcatccatgtccctgcaaaggacatgaactcatcctttttttatggctgcatagtattccatggtatatatgtgccacattttctttatccagtctatcattgatggacatttgggttggttccaagtgcttgctattgtgaatagagtgccacaataaatgtacgtgtacatgtgtctttatagtagaatgatttataaccctttgggtatatacccagtaatgggatcactgggtcaaatggtatttctggttctaaatccttgaggaatcgccacactgtcttccacaatggttgaactaatttacactcccaccaacagtgtaaaagcgttcctatttctccacatcctctccagcatctcgtttcctgactttttaatgatcgccattctgactggtgtgagatggtatctcattgtggttttgatttgcatttctctgatggccagtgatgaagagcattttttcatatgtctgttggctgcataaaagtcttcttttgagaagtgtctgttcatatcctttgctcactttttgatgggttttttttttcttgtaaatttgtttaagttctttatagattctggatattagcccttcgtcagatggatagattgcaaaaaatttctcccattctatagttgcctgttcactctgatgatagtttcttttgccgtgcaggagctcttaatttaattagatcccatttgtcgattttgacttttgttgccattgcttttggagttttggacatgaagtctttgcccatgcctacatcctgaatggtattgcccaggttttcttctatgattcctatggtcctgggtcgtatgtttaagtctttgatacatcttgagttgatttttgtataaggtgtaaggaaggggtccagtttcagttttctgcatatggctagctagttttcccaacaacatttattaaatagggaatcttttccccattgcttgtttgtgtcaggtttgtcaaagatcagatggttgtagatgtgtggtgttatttctaaggcctctgttctattcctttagtctatatatctgaacagtagattcttaaggaaccaatctgagagagagagagagagtatatgtgtgtgttactctgcaaacatttattgaaggctcattttctctggctctgcaggaactataaaagccaaaagacacagttgttccccctcgttgatcagaaacttcatacatctctccttcccatggtgggcatcagcccactccatgtgcagcactctggaaaacatatggtgttgtctgtgaccccctggtgaatggcttggcccccatggcctatttgatgtgttgctaacatctaatcagcctcccctcagttctagtatttgctaaaagcaaagaagccaatgactaaataaatagggtcatgagctgtagacaccaggtcaccagggaggccccaactattcacttgccaacctgcctccataaaggcaaacagaaacaaaatgtattagaaatgccaacttcatttatggaaatcaatcatgcttcttgcagcaaatattatgaaattctggatgtacagtaagcagattattgccaattattacagattcttgtcaggttgtaataggaccatgattttgccgccaagagtgtgagattcatcttgagtcccctcaggtagagagaagctcctcattggaaccagctccctctgcaccagccttccttccccgggagttggcattgaagaaacgccctgacatggccaggggtctctggcatctcacagagtggctgcagtaggttccaaaagactgcttgccatctagatttagaggacagtctataatggctctaaggggcaccttctttttacgtaagcagatcccgagcatttaagcaaatgagaattaatgtgctaagatggcatccttgccatgagtgtgaacaccacctagccatagcctttctcccagaggtctccagaatgtgcttgactcagtctcagagtgaaacaccaaggccactgggcctcaggcaaatgttgctaaaatccaccctggatggagagcaagctccgcatctctcgtcaggaccgaggcattgcaggcaagcccccggcagagctgagtcctatcttcatagctcaggaccaccatcattccctgtaagggaccagccaagggaagtggataattggatcattctatcttagcctaacatccatttttaaacgtccaccaaagagagggttcccccccctccccaaaaagtatttccaaggagatcataatgacactccattgaacttggagaggaaggaaagaaagcattttacttcttttagactatgttataggaataaaccttgtcttcacttgcagttttctctttggggactcaataaagtgcaaccatcctaacccttcaaaagacatgttttcactctcttccggttgggagtcctagagaggactcataaacagtatccctgacttggattctctggccatagaggtgtaaccaaccattctaggtggaatgctttcatgttgggagcttccctgggccaaaagttaccccagaactttgcgcctggaacagtttcaccaggagggatcctccagggtttggtcagtttcagcatcgaagcttgtcctctgctgagcgctcctgtctcccgggtggctcagtcaccagccaggtctcacaggcttcacactgggtagtgactgagcttatggggaagcaattcatggagggaaatcagtttcaagtggatctccaagataaggcaaaagacagtgagagctgagaaagagacgcctgcaccagacacatggccacacgtgggtgctgctcctgtgacctgggactcaggcacattttcagtgaactctgagcttaaagcctcctagaagaaacaatcagtagtataaaacacagttcgtgatctttggtttgaatgtctgaggtcaacgggttacagacatcactttaagacttaactgactaggtgcagtggctaatgcctgtaatcctagcattttgggaggccgaggcaggcagatcgcttgagctcaggagttcaagaccagcttgggcaacatagcaaaactgtgtgtctacaaaaaatacaaaaattagctgggcatggtggtgtgtgcctgtagtcccagctagctgggatgctgaggcaggaggaaggcttgaacctggaaggtggaggctacagtgagccataattgcactactgcactccagcctgagtgacaaagcgagaccctgtctcaaaaaaaaaaaaagacttaactatgcatactttccaaacatccttttgagcttctaccagtccaccccataattacaaagagaaatatcatgttgaacggtatctatctagctgacaacaggatttttgttcaggaactagaaacaaagagctttgctgttttgatgaccaatatttaaatgataacaaaaccggaatcttgagttccttcctggtgtccttagttccactgtcacgtgagcaggccagttgtaattgtctgcagaaatgaggaagatgagatcccaggaggatacgtgtttccttcagtcccccagccaggaagaggcaaatactcatcttggttcttctgtcttcctgtcccattttttttacctctgtgccaatggttctcaaattggagcatgagccagaattccccaaagggctgttaaagcacagattgctggggcccatcgccagaggccctgattcagtaggtctggagtgggacccagtaatctgcatttctaacaagttcccaggtgatgctgatgctgctggtcttgggattatgctttgaagaccactgatacttcatatctggcctccttcattttctgtgaacactctgagtctttctatgaacactctgagacatggaaaagttggaagagctatactgggctactatttcccttgtgttcaaaataaatccagtttcctggcaaattcattaaggaataaacccaaagaagtcttttgtcattatgctaacagagttggaaggtgtcatgacactatccttcataatttagagtgaatattctactgttgaggaaaaagttcagcaaagatgacttggtagaaacagaagccatggaacagagcgcagagagcgtgagcatattgaccctggagtgagctgctggtcaccacccctttccaaaacaagatgcagcgttaaggcaaagaaggcaaaagcttcgggcttgcgtattcctgggcttctctagaccgtaacagacacccagattcagaaatcccctctgctctattggggcatcattctacatccctcatccaaatctggctgatgcaaactgtgcaatttttaatgcatttatttttagctcttatgtgaggagggctttgggaggggtcatttcatcagccagattttcaactgtcagatattcccttaaagtttaaaatgcagccaatattcctccactgtggatgtgtttcaccagcaaacgtccataccacaagagcaaataccacaagacgtccataccacaagagcaaataccacaagataccacaagagcaaataccacagaaatgtccataccacaagagcaaataccacagtgagcaaattctgtctctccgggtgcagcagtgacacgtgtcacctgtgacagttcatttgtacacacttttgggactggggcaccaaacctcagaagtgattggtgtgggattttatgaacagtacagatgaatgaagaagttaattctctggggtaagaggctgaaaaagctgatacccagctcccaaatgttcaccaaccagagagaacatgacaacagtcaaagcaatttgaacgaggttgtgcaaaagaaccaaaaaaatgaaagcagaagccactttggaggagagctataacccttgtgagtgactcctcctgaagatgtccctgtcccctgcactgccttccctggcccccaaaaatccataagaaaacacaccgcttcttggtctcttttgtccaccgactttcttatcttagagcctagagtcagctccttgaggcctgtcctccaaggtttggccaccttggctctgatgggactggactacgttggtagaacacctgggttttagagtcagccagccgtatgttccagttccagttcacaacaccactagctatgacgttttggagaagtttcttaacttctctgtgcttcagttttctcatctataaggtgggagtttgcttgagggatggatggatggatggattggtgggtggataggaagacagacagatgatagattatagatattgatgtagacagacacaaacacacataaatatttatgactactggagtattaaagaatttgctaaatgttgaatagggtgccctgctgaacaagaaacacagcaaatctagttccctccctgtataatttttccaaacttctagattctgagcctttgcatgtcttgcacttggaaaacagccctgtgttggagtggagttcagcagcacacaagcagagctcttcaaagaatagcaaagggcaccccaacctagcaacgcagtccagtagacctggacttagcagtatttaattgcagatgttgcacattcattccaaatgttcctctcatcctttgttagctctcaggctaacaaaggtttatcctctatggacttttggacttctgtaggtagacagaaacctcattcattcagctaccactaactagacacgtgggacatcctagacagctgctgtgatgaagttcaccacttctttgaagatcaggttgattactagtataaatcaatgacatatataagagggagtttcacttacttgagagaagaattatgtgtaagcctttaaaagcattcatttacacacaacgtgctaattacaaatcattatctattaactaagaccaatttctagagaacgtttccgtgctgaactttagttaaattaatagggagtcactgagtccacccaaaagtgatcaaacagtatttctttaagagtgtttaataattcacaccagatctcctccccaattactgcacattagcagagctttgtgcatcccggtatgcacttgctgtagggttaacctcaccctataccttgggaggttctgctcatttcaggggcaggtgcttgaaaagggaccccagggactagaacagatacaaatgcaccaatgtttattgcaacattatttacagcagctaaaaggtaaaaataacccaagcgtccatcaatggatgaatggataaataaaatgtggtctatgcataccatggactattttattcttatatatatacaatcatgggggtgcaagtgcagttttgctacattgaggtaaagtcatggccttcagtgcattcatcagtggagcaatgcacatcatacagtggaatattattcagccacaaaaacggatcaaggtctgccatgtgcaacaccatggatggaccatgcaaactttatgctaagtgaaagaagccagtcacacaaggacaaacactctctgcagtgcctatattaggcagatttctagagacagaaagtagaatggtgcttgccatgggctgagagagaggggatgaggaattacatttaatgggcacagagtttctgtttgggatgatttaaaaagtggtggaaacggatggtggtgatggttgcacaacactgtgaatgttcttaatgccacctaattaatcttacacttcaacatttcttaaagcaagctgttttatgttatgtatattttgccatgataaagattatgtagaatgatagcacgtggacctaggatccaattttcaaaaggaaagccaatgacagttggcagttttggagaagcagggccacagtggtgaatgcctggatatacacagcctattctttgaaggagagttgggtgccggggcaagaggcaggctgagtcaagggaaaccaagtaacccagtgtggctcttctttcccgtttaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtgagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaagaaattggctgccatcgtcctttaaaactggcttcccttcacgctacatagtttaattcagctccaagtctcaagtaaatggttctttctccaaatttaacaacaatcaaatgatgatagtcaattcacgcatagttttggaaatgaaaagttaactttcagaatagagcagtagacagaaatgtatgtgtgaattatgtactagttggacatacaggactccacatttctggattccctcacaggaatgcttcagaccctctagagagagagaaacatggcacattgaagacagggtttccacttcatctgtatcatacaatgcaacagtaaagagaatgtgatatggacatgacttccctataacataagggctggcttaacctttccagaagaaagcaataggactcattctctggttggagttgtgccacagaattaatgtgctatggaattcctcctcctagtagaaaccgtatattttctttatgatttttgagtcttaatgcatgccctacatttgcgactcatgaagaccaaggatgtctttgcatcccataattctttgagagcacattgtgccaggctgtgattagctgactcagctaggagcctccagcatcagaaggagagatagtgggaaaaatttaaaagtgtttgtaattattcaagccaatccatttttcctttttaggcacatatacaaatagattgaggatagatatagacagagagagagagagagagatgacagataatacatagctatagatagatgatagatggtggatggataggtagatggaggtaggtaagtcaatagatggggtcttacttgaactatgaaatagcctaaagcccccacaggttcccttggcaaagaaggttggtcagccagtgatttattgtttgtaacatgggatgtattggataaaagccccaagtgacaagaagcctttgttttggctttgattgtcctgaaagtaagtaagaccccctcccacaagtggctgtgtcttgcatctacaagagcctccagaccctgaattttcctacagaaatgggaatggtgtttttcagaggaaagaggggaagcgaggaaatttctttttctgttcagtccctatggtagaccataaaaacccaatgcacttaataagatgtacaacacagacccccttttttttttgttcttgagggtattggtcaccagggactgattaagaaacagtccctataccattataccattatggataatagtagcatttaacaataagatctttttattatcacacattaatgttatg

SEQ ID NO: 16111 - DNA, 12768 bp, Human
gcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcattgattattgcaaaatcgtattcagtatcaaatagaaatagtcttgtcctctaatccccacagaatgtttaaatccagcccagggagccagttggggcgtcccaacaaatacgccctcgagaattagcgatgttccccttacaatgaaagtcaattgctgcataataactgggccaaagaatttcgttagtttaaattttaaaaattagtattgcactttgctttcaagtttgggtggcaagtaccgaaggggagagggaagcagcgtttgtgtggaaggaagtttcgttttctgtctaaacatgtgggacctgggtgtctacctctccagtcgagagctctctgcaggctctctcccaacttcctgcacctcctcaccctcaccttacccgtggcgctcgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccgcgggagatgccacttcgggcgacagcggcgagacgccgctgtccgcaactcctgggcgggtaggaccgtctgctgcctctgcggcccttggggcagactccccaggagtcccttcctctctcctcccgcccgggggccgggaccgcgctgtgcccacggagggaactgggcgtctctggcgcactggggctccagctgcatgatcccagctcagaccttaagcctcagtggggtgtaggtgggatgggatgtgtttttaggagatgaggagaccccggttgttgagtcgctccccaaatgcgcagtttcttaactccaggtgacatccgtcttttggaggaacgagtgaaggccgtttaggcgaaagaggggtgggtttcagtatttggatcccttcccccagctctgccaatctcaggtgtgtttacggtggaggtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccctcagacgtggcttttacgcacgaagtctctgtccaaaggggtcagatgaggctacctgctagcgacaccttggcggacactcctccaaggccggcttgtcacctgccccgctacctcctcggggaagcacgaaaacaaccgaagtttggctttcaaaagaagtgggggctggggagtggtggtgggggtgcccgaggccagatggggccgtaagagctcgcgagtgctccagcctgtcggacaggttgagctagagtttcggagagtgggagggaagaaggaggcggcgagcgggaagaggaagaagacgcaggcagcgctaggcgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggttcccggcgccccgagacccctgggcagatggggacgcatcctttagaaactgagtcgggccgcccaggggcgagggaacgtgcgcgggcaaggctgcccaatttccagggttcttcatgccccctctgcgccccgacgtgcgagaacactgcccttggcagtgcagggcgcccccacttattactcccctcggctgggcccggccagcagggagggccgccctgtgcgcgcgctccctcttcacttcccagggcggcgcagggtggcgggccctgctttccgagcgccgcccgctcggaggtctttgtcccgagggcgtggaagggagggtcccgggggcgggggaggtgcgcatttcccgcgccgcgcactctatccgcgcctgccgcgctgccacctccagcagtccctgcgtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccgccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcaggtgagcggcgctgcggctcctgaccggacctgttcaccctacggccttctgcccccaccccgcactcctctaggctcccccgaacttaagggaattttgtcctctctcccccagaatgtcgacgaccagcacctgttgctgcacgatcagacagtcattcgcaaaggtaaatagcaaggtggcatcgtctaactctggtcacacgatctgggcttgtgaagttgactggcaaggttgggggtatttggtggccagcgtgggacatttgtggtagaagggactgaaagggattcatggaagctagattttaggagtgacagaaagggatttccctccgacctcctaggagctgtctcttcatctccggagttgttactgcctagttttttttcttggaaaaatgtccatgaattccagtgggtgtttcacaatgtgagagaaagtcttccagagcgagtgaacactgatttaacttgaaaaacaacaagaaaaaagtcacaggcacaccttcgttgagtggttggttctgtaacaattttaattgttgaataagttgtgattttatttttgatttcaaacacgtgtatggaaaacctccttaattctgacctgcaagaaaagttttgaagcaatttggcctaccaaatgaatacctgtaaaaggaacagagcttggaatgatctgtcagagggagagttttgcaggatggggaggaggggatttggaaaattggattacttggtgagtgagtggtttatgaaattaagttacttaactgacaggattaccaggattaccattttgactgttttgggaaatagagtaggcctaaattgaaggtagttttggcctgttacttgaactgcttaaatggattgaggatggaggaaaaatggattttaaagaaaaactcagaaaagactacaaattttcagtaaacttagaacgtattagtttggatgattaaatttactgtgatcaactgcactgaaaaattttggaaagaatcttaatgtgtcctatgattttggttgttcttgaggggaaaaaactcaccgtttatttagtattgaagcagtcttctgaaaacaaatgttctaattaaatagttttcagcagctgctaggaaaaaaaaaaaaagaaaccctccaagctttggatcttcactaattaacttcccaaggtgttaacttgtgaatttcagattagatttgtctctgaagtagggggcttttttaaaaagtcagccatggccaggtgcagtggctgacacctctaatcccagcactttgggaggccaaggtgggcagatcacttgaggtcaggagtttgagaccagcctggctaacatggtgaaactccatctctactaaaaatacaaaaaattagctggatgtagtggtgggcacctgctggagaattacttgagcccgcaagctgaggctgcagtgagcagagatcacaccactgcactccagcctgggccacagagtgagactcttattattttttttttttaaataaagtcagcctgcagttgatcgtggggtgtgcaatgatgcttgtctaaagatcactttcagctttggttattggttttgaaaaggtctcttttgctcagagagagctcttgtgactgccagctctgaccttcattcacaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaaggtacttggggcacaattctaggcatagtggttgggtagttgaaggtgagtgtatcagaggcccaggaggtatttttaacatttatgtgactttatgcctaacactgaattctaatcgggttagagttttagtacatttcttctcctttagaaagtgccaaatgtgggaggaagtgctaaaacgacgctcacaaattctcacttggttagaatttgatcccatgtatgaagtgatagcatctgtattgaggggaggtggggggagcaccctgggtttgttccccagggagtttttgtggggccgttgtagtttcacaagtgaaaatttgtctgctcccatacaatttgaaatattcggtgatgcagagttggatgctaggaaagattgattttgtatcttacggggactaattgaaagaggaccctgctatcacttttcattatggttcacgtgatgtagatagtctttgatgggtttcagctttgacagcagcactttaggagtttagaatttttaaagtgtgcgtgtgtatgtgtttttgtttttgagagtagccagagtcaatttttctttttcttagagccaaatcgaaaaatggaggccggtccttgcgggagaagttggacaagattgggttgaatcttccggccgggaggcggaaagccgctcatgtgactctcctgacatccttagtagaaggtcagtggggttttgtttttggttcgtgatgtttttaatttgtgcctgtgtctttaatacttattgcagaaaaactggaaaacaactcttaaaacttggttgcaagtagagatgaaagcaattggaattgttctctaagtttattggaatgaatcacagttaattttatcgaataagttaacatttaagtatctggttgctcaggtaggctcttctgtattcccccagagaatcaatgttggaaagaaactggttttcctaacctaagaaatcacactctaggggtgtcggcatttcctgttaaatgaaccagtttttttggaagataacagctgatcatttggtacaccttgagtaaaagctggttacttactggtgagcagaagtactgcttctgttttttgtagctgtgggttattttgtagctggggattgtggtcagtgaagagaacctcttgtatacaatacgactggcccgattcacaattctattcttccctcccatccaaagaaaaaaactaatcgaacccctggcccacgcacaagttcctcttgccagtgctaagatagtaggacatagcatttcagtttcttgaatggggggcccctttaccccaacctggacagtagccaagaatgcaacacaacctttaaaaggagctgaagggaaagtaaaataattttttaaaaacaaaacaaagcatgttgttactgctcccgggaagagttggacgctgagagaggcttagggctctcactatgggcaggggaagccaaggagaaacgggctccccgtggcagtaccctcttttgaagactttctttccttgctctgatggcgtgacgtggtgctcaaagagacttggcagagtccctgctttaccttttacgagtgcctttggaggtcagggcaaggagaaaggagctgcctgtctgagaacagctgtcctgcctgtagaatcggcggttctgctggggtttcttgctagccaggcagggtgattgaataagaaagtgtgctccagaacaatggctctccaaggctgcttcagtcaacccagggggcccctccaccatctgggtttttgcaaagctcaccagtcctgcaccctggagccagggaaggtacctcttgggtgggagaaactctcttggttgcctcccttagctcttccactgacttggacagggaaaagggtgctccaagttggtttttaggagaaacatccctcccatcttttttaaaagaaacattctagagatctgccccttcagtaaaaaggcactattaaaaaaaaagtaagctgtcagatgtcaccattttatagagaagtgactagtttgcttttgtcaaacatgtttatagcccttaaattttcctacttccccaaaatgatactacttaatataaagagaaaacatgggtatgtttgattatctgttgagcagaggactggtaaacatttttcaagtttactcatctcagtatccatggggcactggttccaggtcccataccaaaacctgaggatgttcaaaatgttatatttgtatataacctacacacatccttccgtatagtttaaatcatctctgcatcacttacttataatacctaatactatgtaaatgctatgtaaatagttgttacattgtattgctcagggaataatggcaaaagtctgtgtgtgttcagtacagacacaaccattcattatttcccccccgaatcttttcaatctgagtttggatgaatacagattctgaacccacggatacagagggctgacttgattgtgcagttagaagtttcagggtcttttctgctcacattgtgtgatctccaccctctattcctggggtggaggacctactgagaatccctagaaagttctacctaccagctgagttgtctgccctgtatatgatttcgttcttgcatgcaacgtatgactggtagacaatgaatactactagaaagagagaaaatgggggctgggtgctgtggctcatgtctataatccctggcatgagccattggttgagaccaggagctcaagaccagctggccaatgtggcaaaaccctgtatctactaaaaatacaaaaattagctgggtatggtggtgcatgtctgtaatcccagctattcaggggctgaggcacgagaattgcttgaattccggaggtggaggttgcagtgagcagagatcgggccactgcactccagcctgggcaacagagcgagactccgtgtcaaaaaaaaaaaaaaagagagaggaaaagggcagtttggcctcagtgaccacagccatcctaaaagctgttgctgattattctaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagtaagtatctgaacttgaatttgatgatgactcaatgctctagaccttgaggttgagaagattccccctccacagtcccgatggctcaacaaagaaatattcttgaaataaattagggtggagcaaaagaaaatggcaagggagcttcttttacaaagtcaaatacattaactttttgtatgatttagaagagtgcatgactcagccatgagtatttttgagctgcttagttattcaacccaaagtagttgagctgccctttcattattgtgttagcatatcttacaaaaatgtgttgaaaacccgatttgttttgtcacaaccagtaaagagagattgtgtgccttctacctcctgatagcaagacttttgtctttcaaatgtaaagatcagggtggatttgtgggcaaattaactgtctccaaaacgacttaatgcagctgtgggttttctcatagaaaccaacagtaagttgatttgaaaatgatggtaaatgaagcagaactagtcgagccaggaaatggggtaaaagagagcgcagtgaaccaggctgtgtcaggagtcagaatttcagggggatgcttccttctcccggttcctcacggaatttgtttattggaaccaacttgtaccaaggtaaactgtcccttaagctcatgggttggaatccaggccccattacttttaccagtcctggtgaccttggccagttagctggggttaagttaatcctgttgtcttttctaattgcagtgaggattaaataagatagtgctttaaaacagcttaactcagagcctggcgcagaatagttgctaagcgcagcagttggctattagtattaaattctccttcctcgggttgaagcagttgtgcttgcctcccgggcgccagcctcagtgtagttggttctgtgctcttgacctgtaaggagctagatggaactcatcgagtcaactgactgtcttcacaggcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaagtctggctataggtttttgtttttgcttttgttttaaagtcttttgggtgaatggaattagggcagagctgatttatggcttgactgtggcttggttaatgccctgagcaggcaagttttgtgtgctgttggggaggaacctgaagtttcaccttttctccctagcgacactgttcagctaccccaggccttatgctgtcatcagtgtctctcaactgcagagggatagaatcatcctccccaccctggaggtgttgggaaatgtctgagggacagtttattgacattaagaggggccaatgttttgggaacaatgtctcatggaaggttactgtattgaggacaggtacactggcatactgtactcagcatactgtatagtggtcaagaatggaagtgaaatgattatgggtgttctttgggcagatgtttctctcttttttttttttttctttttttaagatgaagtctcgctcttggccccaggctggagtgcaatggtgtaatctcggctcactgcaacctccacctcccgggttcaagcgattctcctgcctcagcctcctgagtagctgggattacaggtgcgtaccaccacacctggctaatttttgtattttaagtagagacagggtttcaccatgttggccaggctggtctcgaactcctgacctcaggtgatctgctcgacttggcctcccaaagtgctgggattacaggcgtgagccaccgcgccaggctgggcaggtgtttcttaggaggacttggcattcagtcgaatgcaagcagtggacgtgcagcatgccagtgttttccattcatctaagttctctttggaaatgagatcgtgctcatccacccaagacatcctcttcatttcatctgcctgcaggggaaaccagagattgagtctttgtgctactccaggagcagaggagtctggcaggggttatgtacttgctggatgtttgtgatgcacacgg

SEQ ID NO: 16112 - DNA, 66628 bp, Human
tagttggcaaagccttgggtttttgaccacccgccccaaattgagtccatccctttggcagcaaagctgctagttttcttggctattcctacccacactggcaaaactgcagttctggtgcaacagggtgggagagaagcagcctcaggccagaaggccacagacatctactgtccctgctagctgtttctgaagaatagatgtttctcaaattgttttctgtatttgtttgatttccagtgctctgaaatggttgtttttgccaatttatccaattttatactggttttgtgtgcagagaattgctgactatgccacacagacatagctaaaagtcccttccacagttttttacgtaggaacctgtattagttaggacctttcagagtcatgtaaaagaaattcaactgaattagttaggacttttagaattttaatatgaactggcttaaacaatacaggaaatttgtggttcacaattctggatagtctgtaagatggccttgctcacaatcccgaatagtctataggatagtccatagaatcaaacaggtgaggtttgatactgcagctcaaatcatgccaccaaacacaaggttcttctccatctttcccgcattcatttgacagtactgacttcaaccccaggctctacttgttgctgtccctctaaactcccatccctctagggtttccccttataggaggaaaacggttgccacatttccaggcatcatatacttacaccatgctagaggagcaaggaagctacagtttactggaagcctcagccccagtctttgtgggttcattgtttctgactgggcttgtgaccatctctgctgctagagggaatggttatgttgcctggcttaaatggaaggaataaatgctcaagtggcagccaacaaatacattcaatatccacacatattggctccaaataataaatcaatgaatgagtgggctcacccacttaggctcacatgctcacagcacttaaagagctccacaaaccatgccctccaaatgaaaccacggtctacattctgccagctctttctccctttccatttctcctttcttctctttcacaccctcacctttggctaggccactcgatgttgcaagaaacacgtccatcagcaattgcctcagtagaaaactccctctgctcccctcctgcatccacatagcagcttcaggcaaggcctccataaggcccagcgtggatcagtgcctgccccttggccgaatcagtgctgtcacaggcagagaattgtcactgccatgctcacctgcccaacccagtggtcagagaagactgttctactgcgagaggagccatgagaaggcttttccgaaagtcaaagaccaatggctacctcagaccatcccgtatccactcgtgggaggcccctgaatgaatctaaggccccaggggttgaactttactgagtagggagcgcagagtactagggacaaatttaccgcccgctttgaggaaagctgatgtgggagcagagagcaagatggatagcagcggccaatctaaacgggcaacgaagtgccacagagtgctgcacgtaggaatgcgagtgacaggtagggtcgtctattccaagtccctcctctcccctaataaactgccacatttcagaaaacacgaagactgctgaggccgtttccagccttcgctacgcattagcagagcaactcaacaagcctgggtgaaaggcttctcgaagaaattcagttatctctactgccagccaaacacggactgggcagctttcctcgggggctgctcggtaactgctgagccgggggcgcgctgaagccctgcagaagcccacacccgcttcaggaattccgtggatgttcccgacagaggtttattcccgcctatccctacaggcccacggcgctctttcctccaatcccacacccagtcgaaggcggggcagccgccccacccagcggccagccgggcggcccccagtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtaagccgtccgtccccgaaacccgcaaggccaccgactgcgcaggcgcctgcagagcactggccctcggcgcgttctctcgcgctcttcttcagtctcctcagcgagcctggggacgaagggggcgcggtgcctcctgggtgttgtagtttgcttccttggcgagaggccttcgggctggctggacgccggggccttgggaactacgcctcccagcgcgccccgcgcgagagcccaggtcgcctgcccttgacggcttcagccgtctgagcggagaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtcagtcgcagggagcggtcgcgtgctagggtcgcggcgatacccctggagtgcccgaggaaccctctcccgcgccggcctcgcgcccgcgtctgtcaggcagcgtgtggggctcggtgctcgcagcgctcgggtttgaagttgggggtggggggcgtggctgcccctggcgtgggttcctccccggaaagcttcgccccagttttcgccccccttggccgtgcgtccctcccactggccgacgggcctcccttcgtggcgtcctcgtttgtggtgctctcgggggccgggggtggagagttaggagtccccaggcctcggggaagctcttggggggcgcctggacagaggctaggggacccagccctcacggttggtggatcgtgcccggcatagtggccaggctccagggcttacccaggggaccaggacaggctcctggtgtcgcccaccgctggcactgagcagtgggcgcctttgggtgctgcgatccttccttcaggtttcagtgggaatggacagacagatctgaagttgaaaattcttttcacaactcatgttcaactatgtgtgttgtcagaatgctcttaatgaggtcagtgttctccctcttttttttaaaactgatcgttgtgagagtgaaacaggttttacagaatatttaacacctccgtcttccctgaagtaattctgctgtttcaagttttgggattcagtattacaaagccttcctcttgagcaaggcctagtacaattcttcaaggtccctagcatgttaattcgaggtgttttgaacgtgcatatacaggaagtgcagccgtttggccgttgagttagtgctccatccagccttgttagaaaagctttcgctgaatttttaatttagtggagtggtcatgttctaatgctgcagtactttggggagtattccattatacttggcagttattaacgaaatactgaacttgtgataaggttttgttttggtgctcagcatttctaaatgaataagtgggactgtgaataagaaagatcacctcactttctgtttttagagttattgtggtcatttgataactcctttctgtctttgtgaaaataattactgtaagctggagtggcggtagtaggggtaggaaggaggtcagtagagtggtttccacctctcattcaaagtatctggtagatccaagtggggtaggttagttaacagtagctttttttttttttttttagttttttattttttgagacagagtttcgctcttgttgcccaggttggagtgcaatggcatgatctcagctcaccacagcctctgcctcctgggttcaaacgattctgctgcctcagcctcctgaggggattacaggcatgcgccatcacgcccggctaattttatatttttagtagagacattttctccatgttggtcaggctggtcttgaactcccgacctcaggtgatctgcccgcctaggcctcccaaagcgctgggattacaggcgtgtgccaccgcgccctgccaacagtagtagcttttgagaagtgactctttaaacaaggtatctcgaaacaatgtaatacaacttagtttgctttctcttcaggatattgtttctaattatggatcttatccagactatttctcccctaatttagaataggaaagtggtatcagaaagtgcataataactttaatttgtacagttatatttgcatagttgtttgcttggcaagaagagatcgggcccagcatgtaacccaaaagaatattgtttctgttttgaaagatccctgatagaaacttatgttagtttgtataagagggtacaaggaaaaatgcagattatttagaatacaggaattactatgtagaaagtactgtgaccaggtgaagaggacttaaagatacagaaggcagtgttcctgccttcagggtagttgaaccttatctcttactttaactgtcaacaagtacaagattgttttgattgaagaacatatgcgggtacagtggatgtacaaaggagatagtggtcagtttcttaaagtgaagaaaagagctgaagaagagggaaactgtaaggaaaaactatgtagaaggtgatgaaaatcaggagtgtacaggcatagaaagaatgggcatttaggtagaaggagcagtgtgagaaaaagcatgggagtctaaaattagagagtagcatctgcaaaaatagcaagtataatacagggtggtggcaagacctgaaactggggagataggcagagaccaaattatggatcttgcagaccatcagaataattacaattttattttataagcaaataggagtcattgagaggacaaagaagagacctaagccagctcagcccatttttaaccctctgctataggtcaggcactgtattaggtactgtatattttatgtccttaagcttaaagaaggcttagtcatgactaatgcagaaattggggggctagggcagggatggggaaggaacttttagagggaaaggtgggcagaaacgtaggtgagaaagaacatggaacacttttttttttcccaatacagacaccatcactcagttttattggttttgtcgtattagcctctgaagtaggcaattattggtgtgaacatacattttgaaaaacatctggagtcaagagtgcacgagtgtcaactcagtgcaagtactgttggtaagcattatgtcccgaggatgaaatcggaggaccaacaggcccaggaggcttcacagcgaacaccacatgcctcgcgcccaaaaggacagcagaccgcgcttcagaacggaaccgccttctccatgtaaacttttgacgtaaactgtgtgcttcagggtggcctcttcttctccgagatcctctcctgcgtcccgagtttgggaatggcccggccgtgctcaggcccaggcggtggaggcctcggtgtagtagtgccgtgcttgtcgacgttcccaggagtccgggttcagaagccccctctccggtggattggcagcttcgcggtagctgggctagtcttcctctggaaactcagtaaaaagagtcggcgctgtccgcctgagcgcgggtttcctaccgagctagaggccagcctgcctcaggcgcagaagggtttgccgccggccttggtcagggcgagcagctccctggtggcgcccagagctggggtgtcctggggcgcggcaggcggaaaggcacgcgcgggccaggggtgcagtcagcacagaatatggaagagaatgggaagttgttttctgtagctgtagcattagttgtggtgataagtagcagaagatgaggttgcaggtatcctcaaaagtattgcgtgccattccaaggaccttaccattttttcctgtagataacaatagggtttatgtattttaatgaacagagagacatgataagatttttctttttattttttttttacttttttgagataaggtctcactgtgtcacccaggctgaaatgaagtggcactcaccgcactccgtcatggctcactgcagcctcgacctcccaggctccagcgatcctcccacctcagcctcacgagtagctgggaccacaggtgaacgccaccacacctggctaattttttggtatttttttttttgtagagatggagttttgctgtgttgcccaggctggtcttaaactttgagctcaggcagtccaccctcctcggcctcctaaagtgctgggattacacgtgtaagccaccatgtccggccaagatttttattttagaaagatcattctggaattgtagagtaaggatttcagaagggatggagagaaggtaagaatggatgtagaaagactgtttaggaggtttttgcactaatcgaagtgagaaataagggtccaaactaaggcaatgttagaggggttatggaggaggagggtaatagaaatatttagaaagtagaattcataggattcagcaacaattggatatggggagtgagggaaaaataatagaataagatgacttggattttaacttgggtgattgaagagacaatggtaaaatatactgagatggggaattcaggaagagaagcacatttgaggagaaacagtattttagcttcagaacatattgagtggaagttatctgtgaaacatccaggtggaatcatctgctatggaactgtgaatgtggatttggagtacagtataacaggctatattatgagtggtatctgaattctttgatttagataacaccaaataagaagagtttgttaacataaaatagttctggaaataggctgtggagaacatttaaagccagatagaagaagagctgggaaaggaaattcctaagtgtttggagatgtagagaaatcatgagaaaatgtcatagaagccaaagtgggatctggcaccatcacagctcactacaacctccgcctcctgggctcaagccatcctcctacctcagccactcaagtagctgggactgcagacacataccaccacacctggctaatttttgtatttttggtagggatggggttttgccatgttgcccaggctggtcttgaactcctgggctcaagcgatctgcctgccttggcctctcaagtgctaggattacaggtgtgagccactgcattgggctgggatcatttttaaaggaagttatacttcacaatcaactctcaagaaaaaatagaaattaatttttttttttaaaaaaggaaagcctcaggcacagtggctcacacctgtcctcccagcactttgggaagctgaggtgggaggattgcttgagccaaagagtttgagaccagcctgggaaacatagggagactggtgtctctgcaaaaaaaaagcaattagctggctgtggtggtgcacacctgtggtcccagctactcaggaggctgaggtgggatgatcgcttgatcctgggaggttgcggctgcagtgagctgtgattgtgccactgcattgcagcatgggtgacagagtgggaccctggcctaaacaaaaggaaagccatactttaaatgctttgaaaagttgagcgaaagaagttattaagagtctattgatttggtattgaggaggttattcaatttgataactgtgtgagaacagttttgatagaatggttgggggacgaggtaggtttcattgagttgaggagttgaggttagagagtggaaaagcatatgtagattataataaataaatcaattttagccatgaaggggagaatagaaagaggtggtagcagagggtgataaagggttaacagatttttaacatggcaaagacttgaacctgcttttcttttttaaaacagctttattgaaatataattcacgtatccataaaattcactcctttaaattatacaattcattggtatgtagcatgtagttattcattggtctgtgtgacttaattttttttttttttttttgagacagagtcacactctgtcacccatgctggagtgcagtggtgcagccacagcttattgcagcttgacttcccaggctcagatagatgatcctccgacttcagcctcctgagtagctgagactacgggtgtgtgccactatgcctggctaattttttgtattttttttgtggagacggggttttgccatattgcccaggctggtctcaaactcctgggctcaagtgatccacctctctcggcttcccaaagtgctgggctcaatgagccaccacgcgcagtctcattggtttttagtacagatgcttctctacttttctctacttacgacacagttacatcctgataaacctatagcaattcgaaaatattgtaagtggaaaatgcatttaatgcacctaacatcatagcttagcctcgcctactgtaaacatgctcagaacacttacattagcctacaaaatcctctaacacaaagtttattttataataaagtgtggaatatctcatgtaatttattgcatactgaaagtgaaaaacagaatgattttatggataccatgtaaagttgaaaaatcccaagttgaaacattgtatgttggggacagtctgtatatacagagttgtacagccatcaccacagtcaattttagaacattttcattactcccccaaaaaaacctccccattagcagtagtcactcactatttcccctgccctcattaatctacttctgtatctcttgatatttcagatattctggatatttcatataaatgaaaccatatatatcatcttttgcaactgctttccctcacttaatgttttcagggttcatccatattgtaggatatattagcacttcatattttttattgcaaaacagtactctcttatctggatataccacatttcatttatccatttatcagttgaacatctaagtcgtttctccttcttgactattctgaataatgctggtgtgaatattcatgtacaagtttttgtgcgggcatacgttttcatttcttgtgtatatacctaggagtagaattgctgggtgtgatgttatacaataagaaatatatatttggtcttggtctggttcctagcctagaacttcaaagatccttggaactccctgagtaatagaggtaatagagcatattttggaattcataataagtctctcagtcacatctgaatttatgctaataaagtgattcttggtaggcccctagacaacttcaggatggaagctggttgccagaagaaccaactgtgttgattagagagttggaacttgcagccccacccctggatgggtgagggggtggtggtgaggactgggtattgagatcagttatcagtggccagtgatgtaatcagtcatgcctgtgaaatgggacctccataaaatcttctaaacagtggttttcagagagattctgggttggtgaatgcatccttatgctgggaaggtgttgcttcaacttcatgggacagaaactcctatacttggaacccatctcggcctcacccttgtgccttttgatttggtggtttatttatatcctttataataaactgataggcataagtaaagtgtttccctgagtttcggtgagccattcttgcaaattattgaacatgaggagggggttgtgggaacccctatttatagctatttggtcagaagtacaggtggcaatgtgcagcttgtggctggtaactgaagtgagggtagtcttgtggaactaagcctgtggagtctgacataaactctgggcagttagtgtcagaattgaattatagggcactcagttggtgtctggaaagttggagaactgtattggtatggaaaaacacttccacatgtggtgtcagaagtgttgttagaaaacagctcatgtggtaactcttgttgaacagtttgaggaactgccaaattgtttcccaaagcgactgcaccattttataatccaattctccaatttctctacatctttgccaatacttgccatttgcttttttaaattttagctatcttggggtgaagtggtatcatgttgagggttagattttcatttccctggtggctaagatgttgaacatcttttcatgtgctcattggccatttgtatattctctttgtggaaatatctactgaaatcctttgtccatttttgaattgtattgttggttattgaaagagttctttgtatgtttggttactaaatgtttatcagatatatgatttacaaatacttctgttttctgggttgtcttttcactttcttgataatatacttttgatgcattaaaagtttaaattttacagtataatttatctgtttttttttgtttgtttgttacacaggcttttggtgtcatgtctacattgccaaatccaaggaatgaagatttattccatactttcttctaagagttctgtggttttagttcttatattcagttgttggtccacatttttatatggtgtgagataggggtccacgtttttttgttttgttttgtttttgagacagagtctcactctgtcgctcaggctggaatgcagtggcacaatctcaggttactgcaatctctgcctcccaggttcaagcgattctcatgctttggcctcccgagtagctgggattacaggcgagcgctaccacgcccggccaatttttgtatttttactagagatggggtttcaccacattggccaggctggcctcaaactcctggcctcaagtgatccacccaccttggcctcccaaagtgctgggattacaggcgtgagccactgcgccctgccagagggggtccacttttttgcatgtggtactctagttgtcccatcctcatgtgttgaagagaccattatttcctgattgagtggtcctgatatccttgttgaaaaatcagttgaccacaaatgtctgggttttttcccctggactctttgtttgattctcatggttgatatagctatccttatgccaggtaccatgtgctgttttgattactgtggctttgtagtacattttgaaattgagatgtgtgaattcttcgactttgctgtttccagtatttgttggctcttcagggtcccttgcaattccatatgaaactgaggatccatttctgtaaaaaaggccattggaattttaatagagattgcattgaatttgtaaaacattttgggtagtatttctgttttaaaaatattaagtcctccaatccattaacaataggatgtcttttcacttatttagtttgtctttaatttcttgcacaatatttgtagttatcagtgtcaagtctttcacttccctggttaaatttatttctatttttttttttaggtgctgttgcaaatgaaattgttttttaaatttgtttttcaatttgtttttcacaattgtttttcacaattgcctagtgtttagatatacaacttattttctgtcaccttatatcgtgtgactttgctgaactccttattagttcccatagttttctagtgtattcttttgagttttgtatataagatcatgctgtctgtaaacagagatagttttacctcttcttttcctatatgggtatcttttatttatttatttttcattcctaattgcccaggctagaacttcccatacaatgctaaatgaaagtggcaataacagacttccctgtcttgttccttatcttaggaggaaagcttccagtcttttaccatttagtataatgttaactgtgggtttttctttcttttcttttttttttgagacacggtctcattctgtcacccaggctggagtgcagtggtgcaatcatggctcactgcagccttgacctcccaggctcacgtgatactcccacttcagcctcctgagtagctgggtctacaggcatgagccactatgcctggctaatttttgtatgctttgtagagacagggtctccctatgttgcccaggctggtctggagctcctgggctcaagcttctgcttcagcctctcaaaatgctgggattataggcatgagccaccatgcctggcaactgtgggtttttcattgatacactgtatcagtttaaggatgttccttatgttcccagtttgttgagtactttgttgagtgtttgtcaagtgtgttgcttaattatctacatatttttgaagttttcaacattttgtctgttatcgattttcagtttcatttcattgtgatcagagaacatactttgtatgattttagtcttttaaagtttattgaggcatcttttattgcctaacatatgatctgtcctgagactgttccatgtgcacttgagatggattcgtattacattgtctttgggtggggtgttctatagatgtctgatagatctagttgctttatagtgttgttcaagtcttctttttcattgttgatcttttctctagtctatccattattgaaagtgaagtattgggagtctccgtttatcattgaactgcctcttcgcctctcacttctgtcagtttttgttttgtatcttttggaggctctgttgttatgtgcagtgtatgtttacaattgttgtatcttgttgatggatttacccatttatcattatatgatatttaagagatagtcttcattgtttggtattagcatagactttcttttatttttattttttttgagacagagtcttgctctgttgcccaggctggagtgcagtggcacgatctcggctcactgcaacctctgtctcccaggttcaagcgatcctccagcttcagcccccgtagtagctgggactacaggcatgtaccaccatgcccggctgatttttgtatttttagtagagacagagttttgccgtgttggccaggctggtctccaactcctgaactcaggtgatccacccgcctcagtctcccaaagtgctgggattacagacatgagccaccgcacccggcctaacatagactttctagttcccttttggttactgtttgcatgaaatctctttttctttctttctcttccttccttccttccttccttccttccttccttccttccttccttccttccttcctccctccctccctccctccctccctccctccctcccttccttcctcccttcctcccttcctcgtctcgctctgtcgccaggctggagtgcagtagtagcacgatcttggctcagtgcaatctccgcctcccgggtgcaagcaattttcctgcctcagtctcctgaatagctgggagtacaggctcgcgccaccacgcctggctaatttttgtatttttagtagagacagggtttcaccatgttggccaggatggtctccatctcttgaccttgtaatccacccaccttggcctcccaaagtgctgggattacaggtgtgagctactgttcccagcctggaatatctttttctatctttttactttcagcttatttctgtctttgaatctaaagtgagtctctgtagacaggctacgattgcatcttgttgttttttaaatctgtctgccaataactatcttttaattgaggagtttgatttatttacatattactgataagaaagaacttctgccatattgctatttgtttttgatacatcttttttgttcctcaattcttccattgctgcctccttttgtgttaaatacatacttttcattgtaccattttaattcctttatgtttcatttgttatatattttcgtagtagttgacctgggattacaattaacatcttaatttgtaacaatctagttcagattaatatcaacttaattttaatagtgtagaaaactttactcctatgtagtcctaccccctttatgccgttattgtcacaattacatctttatacattgtatgctcatcaacactgatttacagtgattgctttatgcagttatttaactcagataggagaaagaagaaatacaaacaaaaatacatttatactctttttaatatttacctacatactttttttttttttttttttttgcgacaaggtcttgctgtcttgcccacactggagtgcagtggcatgatcctggctcactgcagccttgaccttctgggctcaagtgatccactttggcctctgaaactgttgggattataggcatgagccatcatgcccgactgtaattacctttaccagtgttctttattcatgtggatttgagtatcgtctagttagtgttttttcaaagcagcatgatggactccctttagcgtattttttttaacaggataggtctactagcagtgagttctcttagtttttcttaatctaggaatatcttttctttttcttttttttttttgagacagagtctcatcgctctgttgcccaggctggagtgcagtggcgtgatctcagctcactgcaacctccacttcatgggcttaagtgatcttcccacttcatccttctgagtagctgggaccacaggtgtgcaccaccacacccagctgattttttttttctttttttgtattttttgtagagatgggattttgccatgttgctgaggctggtctcgaacttctgggctcaagtgatctgcctgcctcagcctcccgtatatctcttatgttctgttttaagggattctgtattctttctttttttttcctgatcctcagactgacctatttcaattaacctatcttcatgttcactgtttctttgttctgcctgcccaaataagctgttgagcccttctagtgaacttttcatctaagttattatacttttcaattctataatttctattagattttttaaaaaattctctttatcaatactctctttttggtgaaacagagttatcttgctttccttcagtttttaagacatggtttcctttagctttagaacatacttaaaatagctgatttaaagttcttatgtagtcagtctagtcagtgtctgggcatccttagggacagtttcttttttctatttttgtgaggcagagtctcactctgtagcccaggctggaatccagtggcgcaatcttggctcactgcaacctccgcctcccgggttcaagcaattttctttcccatcttggccttccaaagtactgggattacaggcgtgagccaccgtgcctggcctggaacagtttctgtgattgctttttttttttttaatggatcattccttcttgtttctttgcatatgtgtaagtttttgatgaaattggacgttttgactccatcgctatatttcctagtttctttacagatggataggcggctggatgagatataaataatatgattgtctttttagttaaaaacatgtaaaatttagtttattttgaaaaagataatacccatggcacataaaggttaaattgtctttccccctttacccttttctcagctgagatctctttgaagggataaaaacttaatatttccttgtatattcttccagagatgttttatatacatgcaagtagtatgtgtgaacatgtaaatactctattgtaaacagtcacgaggaagtaatatgtacaggaagggaatcagtatttgttgacacctattgtgtaacaggcactgagcctgtttctttatatttgagggaagtgtttcaaactgatcgccttgaacgtttatacaattattttatgaagcttttatataaaacgttattgaaaacaaaaatactggcagaagtcatttggaattgcttctagagctggcaccatgtattgaagcatggcagtccctcaacaagtgaaggttaagttagttcagaagcactaaaaattgagaaccaggtattgtgataggttgaaaataaaactttataccattgccgatgtttaaaaatgaggtatacttgtcatttataaaactgttgttgtgtgactagaactttctttgtaagcttttttatatgtattgacttttcacaatctgccattgataggtgccatcagataaatacataataaggaactattattgagaaatgaggatcgagggggagatgagagaagaaagatttttaaggaaaatgcaaaaattgaagtaggacattggcaattttcaatgtttccttccaaagtagaaatatgatttgttttgtttttgtttttttgttttgttttgtttgagctggagtcttgctctgtcgtgcaggctggaatgcagtggtgtgatcgtggctcactgcaacctctgcctcccggattgaagcaattctcctgcctcagcctcccgagtagctggtactacaggcatgcaccaccacacctggctaatttttgtatttttaggagagacagggtttcaccatgttagccaggctggtcttgaactcctgacctcaggcaatctgcctgcctcggcctcccaaagtgctgggattacaggcgtgagccactgtgcctggcttcaaaataggaatatgaatcaagaacttagactttctgcttgagaaaattatgagaaaagaaattgcagatataaagctgaagaaaagcttacttaagtccattttcttaccactactgaggtaacaaacaattgaaaagcagtgggtaaaattctaagtttttcaacaaagcttagcattttaaggaaaaaaaaaactgtattacaacattagagtttgcttcttcagatattcctcaggttacttttcaaattaatgtcttagaagcgttatgattgtataaaatttttttgtagtcaactgaagccataaaagcatcatttccttcctttaggtctaaatgatggaatagttttacatgatgataacgagttatagaatataagttacaagacaggaacaatctgctaatgtgtgtgtgtggtgtgtgtaacaagtttttttaaacaaataatgattgttacttttaacaacttaatttgaacttttattatcatggtttagtaaatagtgcttttactttctgcttttctttaatcaaaataattcactatgtaagtaaagagtttagttactatgtaacattttaattccaaatcttgacttttggcctattttgcctgcgtaagattagtatttttacttctgtctccagattttatttaattccaggaaataatgcagcagctgttgttatttatttatttatttattttttaggcagagtctcactctgtcacccaggctggaatgcagcggcatgatcttggcttactgcaacctcagcctcatgggttcaagtgattctcatgccccagcctcttgagttgctgcaattacaggtgtgcaccatcatgcccagcaattttttctatttttagtagagatggggtttcaccgtgttggctaggctggtctccatcttctggcctcaagtgatcctcccaccccggcctcccaaagtgctgggattacaaatgtgagctgctgttaattcttacgcagtacctttatatcctagacagtaattttattcctattttccatttctttcctctaaaatgttaccttgtgatagggcttggctgtgtccccacccaaatctcaagttgaattgtgtctcccagaattccatgttttgggagtgacccagagggaggtaactgaatcatgggagccagtctttcccatgctattctcctgatagtgaataagtctcttgagatctgatgggtttatcagggatttccactttggcttcttcctcattttctcttgccactaccatgtaaaaagagcctttagcctcccgccataactctgaggcttccccagccatgtggagccataagttcaattaaacctttttttgttcccaacttctggtatgtctttatcagcagcataaaaacgaaccaatacaccttaactgaaatcttcatggggtggtggttcttacttacccaaccaagataattgaccactttataacttttgagcagctctctacatttaaatgtttacagatcacctattaaggaaacttctacttagaattgtcagctgaggattttctctaactatcgtgggtgatattagacctacttgttattctatatcagtagttaataatctaaggtaattttttcctcaatctcatttttaggaaatttttttgaagaaaattataaaaattaatatatatattttcaaaaatttaagtaggacccaaatggagccctttgtccccccaagtcctctggtaccacatcccatacattaacccagatgtcatatcatttcatccaggtatattttagtgtgtatctctaaccacaacacagtgatcacactaacaaaaattaacaattgtttcttaatataaaatattgaattaatattcagatttctctgattttcataactttttttcctaactattttttcacttcttttcttttttgagacagagtttgtctctgtcacccaggctggagtgcagtggtacgatcttggctcactgcagcctctgcctcctgggctcaggcgattctcctgcctcagcctcctgagtagctgggattacaggtgcacgccatcatgcccagctagtttttgtatttttagtagagacgaggttttgctatgttggccaggctggtctcaaactcctgacctcaggtaatctgcctgctttggccttccaaagtggtgggattacaggtgtgagccaccatgaccggcccctaacaattttttcaaatcaaaatccaaataagctctatacatggcaattggttgatgtcttttaagtctttcttttttttcaaggtaatgtgtcatttttttgtagtatttttgtgtttcttaaccttttacaaaaatagactttatttttaaagctgcgtttgtgttagagttcgctcctggtatgctgtacattccgtgtgtttagacaaatgaataatgaacatgtgtccaccactaaagtaccaatacagaatagcttcactgccccaacaatcctctgtgttccacctattcatttcttcctcctccctaaaccctggctactactaatccttctactgtctctatagttttgctttttgcagaatgtcatatggcctttttaattaacgtctttttttttgagacaaggtcttgctttgtcgtgcaggttggggtgaagcgctgggatctcagctcactgctgagcctctacctgctaggctcaggtgatcctcccatctcagcctcccaagtagctgggactacaggtgtgcaccaccacacccagctaattttttcttttttttttttgggtagagatgaggttttgccatgttgcccaggctgttctctgactgctgtgcttaagcagtccgcccaccttggtctccaaaagtgctgggatcgcagttgtcagccactgtgctcaacttcttttacttagtaatatgcatttacatttcctctgtatcttttcatgacttgatagctcatctctttttagcactaaataatattccattatctggatataccacagtttatccattgctgccttttttggggggatttataatatacctgctataaacatctatgtgccggtttttgcatgtacataagttctcaattcatttgggtaaataccaaggagtgcgattgatggatcatataggaagagtatgtttagttttgtaagaaactgccaagctttcttccaaagtggctgtgccatattgcattcctatcagccatggataaaagttcctgttgctctatatccttgccagcatttggtggtggtagcattttgggttttgccataataatggtatgtggtagtatcacattgttttaattggtagttctccaatgatatagcatgctgagcatcttctcatgtgcttattttccatttacatatctttggtgaggtgcctgttcaggtcttttgcccatttaaacaaaatgaattgttttcttactgtttagtttaaagagttttttttttttttttttttttttgagacaaaattcccccaggctggagtgcaatggcactatcttggctcactgcaacctctgcctcccaggttcaagcgattctcctgcctcagcctcccgattagctgggattacaggcgcctgccaccattctcggctaatttttgtgtttttagtagagacgggattttcatgttggccaggctggtctcgaactcctgacttcaggtgatccgcctgccttggcctcccaaagtgctgggattacaggcatgagccaccgcacctggcctaaagagttctgtgtatatttttgggtaatagtactttattggatatattttctataagtattttatttcaatgtggcttgtcttttcaatctttcagtcttaagactcttaatttttatgttcaccctccctctcttttttttttccagagcattaactaaagaaactaaattgtatatcctatagattttgcagcttgatctgtgtgatatgagatatatagatctatctgtttatctatctgtccatatatgttttcatccagaattcctggctcataactcccatagcccctgttatttcttaagtgacttaaacaataagcatatcttttgttaaagtattttgccttttgtctttggttcctgaagaagctttgaaacagcttctgagcaataaaggtgaaagacagtcttttgttataatgttggagtactttagatctcagaagtaggcctcagaagacagatctctctctctctggccttctcctggtctttgttcacttgctcatttttctccccaaggcaggccatagaaactaaaaacatgctctaatcttcccccggctttctgtccacaagctggccataaaggaattctctgacttacattgtctgattttaggtcataagacccccatttcaaaatggatcttgtcccataccatggaggaagcaatgctgcacagagaggccaagaagaatctgaacaaaacaggccttactgggtttccccactcaatctattagtattagattataccctttttgttcagtcgcatttctgcatgtttgtccatacttcaacatgcctatccaatgaagtctccatcaaaaatttaagaagatggggttccgagagctttttgattgcagaacaggtagaagttcctggaggttagtgtagccagagagggcacggaagctctgcactccttcctacatgccttgccctgtgcatctcttcatctataccctttgtgtatcctttataataaactgaacataagtgtaaacctaagtgtattcctaggttctgtgagctgctctaggaaattaatcaaacccaaggcaggggtcatgggaaccatgatttatagctggtcccatcagaagtgttactggaaagatgtcctgatcagaacccaggatagggtttttagacctcacccaagaaggaatttgaggagagtccttaaagtgaaagcattagtttattaagaaagtaaagaaagaaatgaatcgctactccataggcagagcagcagcatgggctgctcgactgaatatacttatagttatttcctgattatgtgctaaagaacggttagattattcatgaattttccagaaaaggaatgggtaattcctgaaactgagggttcatcccctttttcgaccatatagggtaacttcctgatgttgccatggcatttgtaaactgtcatgatgctggtgggagtgtcttttagcgtgctaatgcattacagttagcctatagtgagcagtgaggatgagcagaggtcactttcataaccatcttagtttcggtgggatctggccggcttcttaaccacatcctgttttatcagcaaggtctttgtgacccatatcttgtgttgacctccaatctcatcctgtgattaaggatgcctaacctcctgagaatgcagcccagttaatctcagccttattttacccagcccctattcaagatggagttgctctggttcaaatatctctgacggaagcacaggtaaaacagcctagggcttgcaattggcgtcagaagttggaggcgggcagccttggggactgagccgtcaacctgtggaatctgatgctacggatggtgtcagaattaaattggagaacacccagctggtgtccactgcaaagttgattgcttgcttggtggagtaaacccctatatatcatggtataagagcagagaaaaaactgattttctacataatcagattgttttgtttgtttatttttcagggatagtgtgtgcatccatcaaggagctcttctctttctatctcttgctctctttttttggtgttattagcagccgttgatgatcattgccagtatccatttttatttatctataaagtggtgtaaacaaaaaataaaattctaagccccccaactgactgatggacccccctctaggttaagggagtttcaaactaaacctgaaaaactagttcaggccatgaagggaatgggaggttgggcatgcatcattataccttcctccccttggaattcagacataactgaccagcattaacattaaaacagagatcttaagactgacaaaacagactttgtagcaataagataccaaattccaatctgactctagtataacatcacatgacagatggcaggccctgaaagaaatcaaggtatttcacctcaaaatatatttattggacatattttgaaatagccctgcaaagctgtctcttgtggggaaaatctgcattttctagagaatccccttccctttccagatctttttcctgatctagaagcaaattaactagagtctggcatctttttatgtctgataagagctctgaaaccggctacctggaggtttcatctgcatgataaaaatcttggtctccacaaccccttatctgaactcagatgctcctttctattgagtctagatctttagataataacaactctttcaaccagttgccaatcagataatctctgaatccacctgtgacctggtagccctggcttcaagttgtgctttatttccagccgaaccaggatacactttacatgtattgattgatgtctgcctttaacttctgtccccctgaaatacataaaatcaagctgtaaaacaaccaccttgggcacatttctcaggacctcctggggctatgtcatgagtcagtgtcagaggtgtttgaaccagaacatctctgtcttgaataggggctaggtaaaatgaggctgagacctactgggttacattcccaggaggttaggcattctatgtcacaggatgagataggaggtcggcacaagatacaggttataaaaactggtcgtggtaaagaagtcggccatatcacaccaaaaccaagatggcaacggaagtaacccctggtcatcctggctactcatatatgctaattatgatacattagcatgctaaaagacactcccaccagtgctatgacagtttacaaatgccatgccaatgtcaggaagttaccccatatggtctaaaagggggaggaatcctcagttctgggaaatggccacctctttcctggaaaactcataaataatccacccttatttagcatataatcaagaaataagtatccttagtacagcagtccaggctgctgctctgcctgtggagtagccattctttattcctttactttcttttttttgagactgagtttcgctcttgttgcccaggctggagtgcaatggcgcgatcttggctcactgcaacctcagtctcccgggttcaagcgattctcctgcctcagcctcccaagtagctgagaccacaggcatgcgccaccacgcctggctaattttgtatttttagtagagacggggtctccatgttggtcagcctggtctcgaactcccgacctcaggtgatctgcctgcctcagcctcccaaagtgctgggattacaggcatgagccaccgcacctggcctattccttttctttcttaataaacttgctttcattttgcactatggactcaccctgaattcatttttgtgcgagatccaagaaccttctcttgggatctggtttgggacccctttcgagtagcagtggtcctcacatctggctcagaataaatctcttaaagtattttatagagtttaactccttgttgatattcataatattctttttttttttttttgagacagagtctgtcgcgcaggctggaatacagtggtatgatctcatttcactgcagtcttgaccttctgggctcaagtgatctgcccacctcagcctcccgagtagctgggatcacaggttcacaccaccatgtccggttaattttttgcatttttgatcgagacagggcttcgccatgttgcccagactggtcccgaactcctgggctcaagcagtctgcctgctttgacctcccaaagtgttgggattacaggcgtgagccactgcgctccgatattctttcatttcttctttacttacttgccgtaagattttgataaagataaacttggcagcattaatacgtcacttaggaaatttaggataaatgctcgatttctccccaactttattaatcagctattcaaaaactgaggtgttcctctatatccttcaaaggtgaccaatgaatttttattttttagtataattgtgcactcatggatttaaatataattgatgcattttagcttattgcagttgtttaattttatcgatactcatattgtcccatctttggccagtgggagtttattcaacttgacttctgagtccttttaattccaagcatcattcatgacttactactttcttttgtgactgatgtttctgccttatcttgtacatattctgctcttagacctgaaatctacttaacaggaacacttaaaagttccctttattatgttgttaggttcacacagcttaatatgtatttacatctcaacaactaaaaagggaaaaacagtttttctgtactctctcacagcacttttgacaccagaagtgtgtagggatttcccatatcaaacaatgatccaattcttggcaggcactaggtgttctacaacttaacctaatgctggcagtgcactaacctgaagttaatgcagaccccacaggttaagggctcagtcttacaagactgtcccccactttagatatcaatcacaagtagtggggtccccaggttacccacaaccctatcccatttggctccaaattggacattcccaagaccccctcttcaggtttgagaacttgcatgaatggctcgtagaaccatgtaaacactttacttactattactggtttattacaaagcattttttaattttttaatttttaagattttttaaaataaatagagacgcggttttgctgtgttgcccaggctggcctcaaaactcctggcctcaagcaatccgcccatacgggattacaggcgtgagctagcgtgcccgtatttcttattatatcacagtatcacaagaagttaatagccgtttgaaaaaataatacacgtaagttgaaagaggaaataatatttttatttcactcctacataactaaaattactaatggtttgtgtgtgcctgtaggacagtgtacagcttgtaataccttgcagtcagattggacatcactaccctcatttcttgttccatgttgatttttacatggcacttttctttttttgtcacatgaccccagaaaactcagcttcacaagatatattgtcaagaggaatgcagtgctatctaatgttgaaactgaactacttttagctagtattttgtgctgtttctgaaagatgtccagtattgctgtttccctcaaatttaagatgtcccgaaactcccctctgagtttgcttgcggtgcccctgggtgcttcagtgcactctttgggaatcttgactaaatactattatccaggtcttattataatcaatgtgtgatttttatttttattaaataaatgtgttggtccccccatcacctcagttgagttctaatttaagatttacttgaggccaggcatggtggctcatgcctataatcccagcaatttgggaggctgaggtgggcggatcacctgaggtcaggagtttgagaccagcctggccaacatggtgaaaccccatctctactaaaaatacaaccattagccaggtatggtggtgggcacctgtaatcccagctactcgggaggctgaggcaggagaatcgcttgaacccgggaggcggagattgccctgagctgataccacgccactgctctccagcctgctgacatagtgagactccgtctcaaaaaataataataataaaggcaagagtccaaagtggatttttccttctgatacttaatatatgtatagttatgtgtcacataatgtttcagtcagggatagactgcatatacagaggtggttgcctaagattataataccataactgtacttttttctgtgtggaggtatgtttatataccaaggtgttacagttgctgacagtattcagtacagtaacatgctgtacaggtttgtagcctaggagtaataggccataccatatagcctaggtgtatagtaggctctaccatccgggtgaaaataatttgttaattttcctactttcttgtcattaatcgtttttaaaaacttttttttttttttttttagacagggtcttgtgctgttgcccaggctggtgccatcataactcactatggcctcgacctcctgggctcaagtaattcttctgcctcagccctcccgagtagctgggactatagacacatgccaccacactcagctaatttttttttttttttgaaatggagtctcgctctgtcaccaggctggattgcagtggcgtgatctcatctcactgcaacctctgcctcccaggttcaagtgattctcctgcctcagcctcccaggtgtctgggactgcaggcgcccaccaccacgcccggctaatttttgtatttttagtagagatggggtttcaccatgttggccaagatggtctcgatctcttgacctagtgatctgcccgtctcggccttccaaagtgatgggattaccaccatgcctggcccacgtttggctaattttttattttctgtagagacagggtcttatgatgttgccaaggctgatcttgaattcctgggctcaagcagttcttccaccttggcctcccaaagtgttaggattataggcactagccactccacccggtcgattaatcttttaatagttgtcgtcagcatgaaaagggcattcatacattcatattcattataatgaatttgagaatttcacattttctaaactgattataccggcatatcttgtctgaagcatgtgagtagggcagaagctaaaataaagattaagtctcacggtatagaagaagggtacagaaaataacccaaataaagagtaaaatcttgattagagtacaagcctaaacaaagttaatagatatgaaaggattaattatacagctactaaattggataataattgctctgtggaatgtacatgagaaattatttttgagcctgtatatgtgagtagtttgcatttaatgggtcccggtcataaacctcaaacatattatcatgagaagaatttcactgttgatatgaaatcttttaaactttatctgctcagtctgaaggattatttctgtcccatttcagcttataaatgtaaaaaaagagaatgtgctcctcatatctaatgagctgctggtagaccacacttcacacatgttaactgttgatggagagattgaacctgtccagctttacacactgggagaggaccctaggaagctggagaggacctaggaagctggtgtctgatttcctctggacttcaccctatgtgcttcttcctttgctttttttgttttgtattctttctctatggtagatcttagctgtgagtacaaactatatgctgagttatgtgaatccttctagcaaatcaccagtcctggggggtacagcccccaacacagtaataaatgacttaaaaaggaaaacactattccctgcctcatccttgcacctctctcagtcttaggtttttttttttcttttaggtgtttcttttgctatttgtttccttttttctaataataaactgctatttcttgagataccagtttttgacgttgtctattaactaggtattacgatagatgagggtttaggtttcttatacccttgccctagttccctgtgttcagtcctccaatatgaccatttcacagtgtgtaagtcagtattcatgttatcattatgataactagataaatattgtataatactgaacaggggactacagattctttttcccatctaacttttctttctcctagagttgatagttgtttcttattttcatttgctttgtttactgttttgtttgtttgtttgttttcagatagggtcttgctctgttgcccaggatggagcatagtggtgaggtcatggctcactgcagcctcgatctcctggattcaagcagtcctcccacctcagcctcccaagttgctgggaccacaggcaggtgccaccatgcccagctaattaaattttttgtagagataggggtctcgctatgttgctcaggctggtctcaaactcctgggctcaagcaatccgttctcttcagcctcccaaagtgctgggattagcagtgtgagccaccgtcccagcctatatgaaaaatttatccccaaagctccagtggctctttaacatgtcttattgttgctttccacgtggtcagatgtatctaatttccatcattccttggagctcttcttcctcatgcttcactgtggattagttggtcacagatttgcttttatggggacttccctttgctgcactctagggttgaatctcaatcaagtcttcctactgtttgtttactgccttgtttttgtaggaattattgagaaagtatattattgggattgtaaattattgggaaagtaaatttcttgagactattagtctgaaaatgaccttatttgttgcgggaagtcagggaccccgaacagagggaccacctggagccatggcagaggaacataaattgtgaagatttcatggacatttgttagttcccaaataatacttttataatttcttatgcctgtcttactttaatctcttaatcctgttatctttgtaagctgaggatgtatgtcacctcaggaccactgtgataattgtgttaactgtacaaattgattgtaaaatgtgtgtttgaacaatatgaaatcagtgcaccttgaaaaagaacagagtaggccagacacggtggctcacgcctgtaatcccagcactttggaaggccgaggcaggcggatcacgaggtcaggagattgagaccatcctggccaacatggtgaaaccccgtctctactaaaaaaaaatacaaaaaactagccaggcgtggtggcgggcgcctgtagtcccagctactcaggaggctgaggcaggagaatggcatgaaccctgggggacggagcttgcagtgagctgagatcgcgccactgcactccagcctgggtgacagagcgagactctgtctcagaaaacaaccaaacaaaccaaaaaaaacagagtaacagtgctttttagggaacaagggaagacaaccataaggtctgactgcctgtggggttgggcaaaaggagccatatttttcttcttgcagagagcctataaatggacgtgcaagtagggaagatatcactaaattcatttcctagcaaggaatattgacattaatactctgggaaaggaattcattcctggggggaggtctataaacagctgctctgggaatgtctgtcctatgtggttgagataaggactgacatacgccctggtctcctgcagtacactcaggcttactaggattgggaaactccatcctggtaaatttttggttagaccggttctctgctctcgaaccctgttttctgttaagatgtttatcaagacaatatgtgcaccactgaacacagacccttatcaggagttctgattttgcccttgtcctgtttcctcagaagcatgtgatctttgttctgccttttgccctttgaagcatgtgatctttgtgacctactccctgtttgtacactccctccccttttgaaatccttaataaaaacttgctggtttggaggcttaggtgggtatcacgatcctactgatatgtgatgtcacccctggcggcccagctgtaaaattcctctctttgtactctttctctttatttcacggccagccaacacttatggaaaatagaaagaacctacgttgaaatattgggggcgggttcccccgatacttaagttaactatacacttgaatgattgttggaactaattttctttcagcgtttgaagatactttaatgtctttaagcttccagtgtttctgttggcatattggtcctgatcctgtgaatataagctgcttccccagctccctcacccacaggacactttttggtatcatctttttacccccagtgctctgaaatttcatgagatgcattgtcacagttctcttcatttatcatgaggggtgctcagtggtcctctcaaaggacactcttgtacttaaattctgggacaaatttatttccttattgtgggaagaacaagaatgtattgtgcctgcaaacagtgcttacaaaatataacatttccaaataatcttttaatactggttagtgttcagtgtataaggtattgataagtcaatatttggattcccttatacaattctagattagagaattttaatttacagattattttttaaaactataaaagtgaggaaaggttgcttttagtgaacttaaggctgatatttattgataaagaatgtttacaaaatattgaatctgtttaactcgtaaactagttaagcaagttattgtttttctggaataggcctttttatgtttagatagtatcaagtttaataaactagtaggtttattcttgaaagctaatttcaggagacattaatttacttaatttctttcttctctatttatattgctttgtcctcttgcatgcgtgactgattcttactgtgtgtgctgattaatattggcataggagcagaaaatactactttaagaacaatgtataacctagtccttcagagaagtgaatgtttttaaacaattgtttagttaagtttgagtctagttttgtgaactttttgtctgtttcatctcagttgtaactgtcataactgtacttcttacttgaaatattcattttcaaatgtacgattgtttttggttctaaagtaaaattctggatatgtggtttttgctttatacttttaatactttttgctattgcagaagtaatttttttaatcttcagttctctctagagagatattgttcttttacacaggaaccagccacatgctttcattttggaatgattggaaatagtgatattgggtgtgaatgtaagctgattccccagctccctcacccacgggacacttttggtgtcatctttttatcccctgtgctctgaaatttcatgaggtcaggtccatatttgaaaaggaaagtcctttttcttttttgtttgttttttgagacagggtctctctctttcagccaggctggagtgcagtggcaccatcttggcttgctgcaacctccgcctcccgggttcaactgattcttgtgcctcggccttccaagaagctgggattacaggcatgcatcaccacgcctggctaatttttgtgtttttagtagggaagtggtttcaccatgtcgtccaggctggtcttgaactcctggcctcaagcagtccacctgcctttgctttccaaagcactaggattacaggcgtgagccactgtgtctggccaacatccatattttttaatggcttatgatcacatctctgtaaggcattcatggccctttattttccttctcagagtttttattgaaatataatttatatttagtgaaatgtacactttgataagtcttaacaaatgtatacatacttatagcccgcatgcctgttacgatgtagataggaacatggccatcaacacagaatgttctctcttactacttcatattcaacccctgcctcttctccacaccctagtaaccacagttctaaattcttttgacacctaggtgactacctgttctagaacttactataaatacagtcatatattatgtactctattgtgttcttatgctattttatgaaattatgttttgttgtatatatggattatttgtttcttattaaaatgctgaatagtattcccttatatgaatccaatcatctgtttgttggcaatgtgggtgcttctagtttctagttttagctattacaaataaagttactctgatgataagtggggttttttttgtgaatatttgttttcatttctcttgggtaaataaggagtggaattgctaggtcatatagaaggatatgcttaagtgaagatactgccagttttccaggtctcaatgtgtgagacttctgggtgctccatatccttgccagtgttagggattgttgttctttttaaattttagccattctagatgatgtctattgatagctcattttaattttaatttgcatttatttgatttttttccttgggcttactaaccatcagtatgtcaaaatgaaataaaatatagagatgaatctctaagtttaaaacattttatttgggaagcaagaattgcaattcagggcatactcacacagacctgatggtctttgctgtgtcccaagaacaaagagaaggttaggggttttatttttaaaaagagaaatgttatatattgctctgtgagaaagttcatcgcactagtaaggtttgggggactgacagtctctgagtggtgagtgaccagatgggtaaagccagtcttagagtggcagcaggttgtttcggaagtgattagataaaactagtttcaggttacagcaggcagtttcagcggccaggctggcagaaaattacattcttggagcaatggtgtgtgcccagagtgctttttcctcttggcttcttgactcagttttatttgggtatgacaagtgacccaattcatatgatcaattttcatactatattttcctttgtaaactgtttgttcaactctgcccatttttttatgggttttttatctttttattattctaaataaaatcctttgtcagatacacacacacaacacacacacacacacacacacacaaatgtagtcttcaagtctttggcttgactgttcattttctctttttttctttctctttccctacaagacaaggcctcccgctgtcacccaggctgaagtgcactgtggtcatggctcactgcagcttacctcctgggctcaagtgatcctcttgccttggcctcccaaagtgctggcatgagtgactgtggttggcctgtttattttcttaatagtgtcttttgatgagcagaagtccaatttgtcagtttttaattttatagttagtgctttctggtaatgtctgggaagtttttaccctctcaaagccctcaaaaatatgtttttagaagttgtatagtttttagctattaagttttaggtctgtaatttatgatgaattatattttgtacatgatatgacatggagagtggagcttcaatttttttcatatgcttatctagcactatttgttgaaaaagattgtcccctcattgtattcctctggaacctttgttgaaaatcaattaactatacacgtgtgcatttctttttggaatttctatttgttcctccaatctattatctgttcttactgcaacaccttactgtcctgattactgtagctgtttttcttctgtttttgtctatgcttgttggtgtttctgggtttcccagcttctatcattccaagtctatggtgtgagatagaagaaaactctgagaactcaccaccatattcctcctatcctgaggtactgaaccggtctgcctccttctgtctacctttcagagtctttttttgtttcttcttcttcttcttctttttttcttttcaatctgatctgggaattttagttgtacgtaccaggaagaatagggataaataatctttactcaaattttcaataatttacaccaggtatcctcttgcctcagaaataagaatttctgatttttgttgtttgttttcttgcctttgaatatttatacttaaattttattatggaccatttgaaacctctctcttctgcccttttcttcagtgaagtttaggcttgctatagctccccagtggtcaaacaatgtgtcctaatgcaaacatgttgttcttcctttcttactaaaccgtcatgcactcagactctcactccttcatgtctgcctttagtggctccacttatcttcagctctagatgaattaacttgtcttagtctgtttagacttctataacaaaataccataacatgggtagcttataaacaacagaaatttattgcttttcattgcagactggaatgtccaagatcaagatgctgacagatttagtgtctgctgagggcccactttctggttcatagacctggccttcttgctgtgttctcatgtggtgggtggaggtggtgaattcataagaggaggagggagtgtcctcataagaggacactaatcccattaatgagaactccaccctcacgacctagtcacctcccaaaggccccccctcctaataccatcaccttggggattaagtttcaatatatgaattttgaggggacacattcagtccatagcacaagtcaataaatatttctttagagtagcttttgtcagataatctattaaatactttatgaacaaaactgtctaattgtctttatcagtctagtatggaaacaaaaataattgtgtaccaggagaacatggaaatgtagtatagtataacttacaaatgttgtaggggtgaatgatcaaaagccacctggcattttgctgctggtattcctgcccttactcctctcttagccccagttttgtcactttctggctttggaattggtaatgactcccacaccaggtctgaactcaacatgacatttagtgtctgagcccaccttatcttttaatgtcttttccattacttcttagcaagaactgcccaggtcaggctggtcttcaccccattctcataataagtcccaaatgttcctgtgtgtctttaaccacactgttcctcctggcataaatgtatttattccctttctttgtgtgtatacgtgaagggtggttcagtgaaaaaaaagtgttttgagtcaaacagatcccagttttatctcttacttgctatgtgatttagggaaagttatttaagctctctgagccttactttctctgtttataaacatggaaaaatactgcttttctcacagggttagctaaattaatgtatgtgaacgttccagaagccacaggaactcaaataaattgttgattccctttatttcctgaattagaacttaaggcttagggcaagattcatttcttctaatatttgtctcatcagcagtaaatatgttgagaacagaaaagataccaattagtttattaaataaacatttgactacttactgtgtgccataggtagtgttaaattttggagctcaccattagcaaggtgaacacatgcatatgtaattgaaatacagtatggtaagtgctgtgaagaggtatgttcaggatgttctaggacacagaaaaggagtatttgtggcttatactggatggggtgggtcaccagggaggattcttggagaagtgttgctagtgcttgatttttttaaacagctttattgaggtagaactcatataagatccactcactcgaagtgtataatttaatgatttttagccagtttatgggtttctgcaaccatcaccataatccaaatttagaatgtttccatcatctacaaaatcatgcccaattgtaggcctagtgttaaaggatgagtatgaattagccacgcaaaaatattgagaggaaggctggattcctgggagagaatgagcaaagacagagaagcatacaataacatggtatccgtgtgggtgatatgtctataagcaattttttttttctggagtgtaaacctgtgcgcctgccccacaagttgtgttttagcttccatggacttgagctcagtttcctcatctctaatgtatagttcctgttaccttgttgaactctaggtccttttaaactctcaactcttagattgtcaaaacttcaattaataggaaaagggaatgcactttaaaaaactatagccaaggccgggcctggtggctcacgcctgtaatcctagcactttgggaggccaaggcgggtggatcacaaggtcaggagatccagaccatcctggctaacatggtgaaatcctgtctttactaaaaatacaaaaaaaaaaaaaaaatagcctggtgtggtggcagacgcctatagtcccagctagtcgggaggctgaggcagaagaatggcttgaacccaggagacggagcttgcagtgagccgagatcgcgccactgcacttcagcctgggcgacagagtgagtctcaaaaaaaaaaaaaaaaaaaaaaaaaacaacgatagccaaggccgggcatggtggctcacacctgtaagcccagcactttgggaggccaaggctggtggatcacccgaggtcaggagtttgagaccagtctggccaacatggtgaaacaccatctctactaaaaatacaaaaattagccaggtgtggtggtgggtgcctgtaatcccagctactcgggaggctgaggtgggagaatcacatgaacccaggaggcagaggtttagtaaccaagagcacgccactgcactcctgcctgggcaacaagaacgagactccatctcaaaaaaacaaaaacaaaaaaccaaatgatagccgaaagtcagggcccattaagaaaaacagaattatactgatgcttattgatccttcagtgaaaacttttttgtttttaatattttttttttctggttatgtaagcaatagtgcatattgggtagaaaatttataaaatgcagaaaaacaaaaaaagtttagatcagtcataatcttaaatccagagataattgttattaatatgctgttattttatgcatatatttatatatttaaattgatatgctgtaaataaaattgctttttcctcacatcattaaatattgtcaacatgatttttaatgttacataatttttacaggatcaaaaaacagcttgttcttttttttttttttttaatttgagacagggtctcactctggcacccaggctggagtgcagtggtgcgatctcagctcactgtaacctccatctcctgaactcaagtgatcctcccacctcagcctcccaagtggctaggactataggcgtgtatcactacacccagctaatttttttttattatactttaagttctagggtacatgtgcataacgtgcaggtttgttacatatgtatacatgtgccatgttggtgtgctgcatccattaactcatcatttacattaggtatactcctaatgctatccctcccccctccccccaccccaccacaggtcccagtgtgtggtgttccccatcctgtgtccaagtgttctcattgttcggttcccacctatgagtgagaacatgcatgcgcccagctaattttttgtattgtttttttagagacaaagtttcgccgtgttgcccaggctggtctcaaactcctaggcttgagtgatccacccaccctggccttccagagcgctgggattaaaggcatgagccaccgtgccaggccccttttcatttttttaagtgttagaataaagtctacccttctgacgcttccaagagttaacagtaattaaccgtttcttacatgttttcagaaactgtgtgtgtgtgtgtgactttatagcctatttggataaaccataatttaatcagtattctattgatagcattttagattatcttgttttttgtttttacagtactgcagtgaatattttcttgcatatatctttgcatttttgtgaaagtatatctgaagaataatttcctaaaagcagaattctggatcaaagagaatagatttaaaattttaatagctacgataagattgcttttcaaaaaggatcatgttatacttctaccattagtaggtgttctcgtgagtcttgtttcctctatccttaccatcataatggatcttatatgtgccattttgtactttgccactcttacattagaaaagtgatagctcattgtttaaaaaattataattgaagttgaacattgtttccactcattttttagccacttttctgtgaactgcctgttcacatcctttgtctggttctcttaatttgttgctattttcattaatttgttaataactctttgctttttaaagaaattacctctcccaatttgcaacttttttttttccacatttgcttgtcctttgactttatttatggtctcagaattgtcacttatggcttgtggattttttaaattgtaaagttaacatttaaagtgagtgcaaagagaggccgggcacgatggctcacacctgtaatccgagcactttgggaggccgaggcgggtgactcacctgaggccaggagttcgagaccagcctaaccaatatggtgaaaccctgtctctactgaaaatacaaaaaattagccgggtgtggtggcaggcacctgtaatcccagctactcaggaggctgaggcgggagaatcacttgaacctgggaggcggaggttgcagtgagccgagattgcgccattgcattccagcctgggcaacaagagcgaaattccatctctcaaaaaaaataaaaaaaataaatgagcgcaaagagaaaaagtgattctgatagtatttcaaatgaatatcataatgacattaaagaggaataagaattaatccaagtaactttcaaacgcagtactttgactgtgtacctaccatcctaaagaagggagaaaatgcaaacaaattttgaactcctcttacatttgtcctttgtagcatctgttgtagtaaaactattttgcatgtattttaggattgattaaatgagggttccttcatttcttttagcataactgcagtacaaaaatatagttattatcaatacatgagctgcatataaaattgcatgcatcgtagaatcagtggtctgtaattatatgaatcattaaatatatcattttaattataaaatttaattatgatgtgaactgttcatatgtagttataaagtcgtctttgtaacttatttatagttgtttagtcataaagcaaaatagtaagattttatgttggggagcagtcaaaatgaagcactttagaatgatgagtggttttttttttttaaggaattccatattctactttgagaactctacctctgattttcatttgatttattttttgaatactcgaagatcccagtgctttcaaccctgagaactgaaatgtgtgatgcatggaatatatctcgagacaataaaatgaaagagttttttacaagggggtttgtggagaaaatatttttgatttgtaaatgctgtggtgtttttgttccttggtgttaggtgactctgctaatgttttttctcttggtgcaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggagtaagtgccattttttcctatgcctagatatttttattttattttattttactttattttattattattttttgggacagagtcttgctctgttgcccaggttggagtgcagtagcacaatctcagctcactgcaacctccgcctcgaggttcaagcaattctcatgtcttagtctcccgaatagctgggactacaggcgtgcgccaccatgcccagctaatttttgtgtttttagtagagacagggttttgccgtgttggccaggctggtcttgaactcctgaccttaagtgatctacccacctcggcctcccacagtgctgggattacaggcgtgagccactatgcctgtcctagatatattttaaataaacttccactctaattacatgtaccagctgtcttctggaaacatgtgaaggcagagattcttgtttgacttttctgttctttatttttcagggtctcagtttttgtatattagagttgtattttgggatcttaatctcacaaataaaaatactgagtttccagaaatggaaaagttttctagcggatatttcctgaagtaataactcaaaatgatgtctagaaagatattaagctggccacagtggcttacgcctataatcccagcactttgggaggctgagatgggaggattgcttgaagtcagaagttcaagagcctgagaaacaaaaatttaaaccattagctgagcatggtgatgtgtgcctgtagtcacagccgcttaggagcctaggagattgaggctgcagtgagctatgcttgcaccactgtagtccagcctgggtgacagagtgagactctgtcctctcctccgctgacgccccacccaaaaaaaggtagatactggaattttccccttaaggcatcttacttttcttgggtaggtcgtgttcgctatttgggatacacttttttggaaccttcaataaagtagctatttatcttaagcaaataccatgatacattccatttgaggtcctattcagtagggaggatgaatcatttgagcgtggctttttagtatgttaaaagcaaataaagtgagttatgttaagtattccttattttgaacttcatgacattttaaattgatttgtttttgaagaattacacagagtacacaaattgtatacaacttgatgagtgggtatgcctgtgtaaccactacaaggatctggaaatagagcattatcaattttcttttgtgcctctttaaagggaatcacctacccctcccataagtaaacttcttttattgttgattgatgctgcctgattttaaacttacgcatacttctatttgtgtctagcttcttttacccaatattatatgttaaaagtaaaacttttagacaaactaaatttaatgggttttttttcttttgtgtttttattttgagacagagtcttgctctgttgctcaggctgtagtgcaatagtgtgatcacgggtcactgcaacctctgcctcccaggttcaagtgattctcctgcctcagcctcccaagtagctgggattacaggcacccgccaccatgcctggctaatttttgtatttttagtagagacagggtttcaccatgttggtgaggctggtctcaaactcttgacctcaagtgatctgcccacctcagcctcccaaagtgctgggattacaggtgtgagccaccctgccttgccagtttaacagagtttaattgagcaaagaacgattagggaatccagtagcccctaaaccagaatagatttagagcgactctggggctgccacatggtcacgtaatatttatggacggaaaatgtaaagtgacacacagaaaacagaagtgaggtacataaacagctggattggttatagcatggcattagccttatttgagcagtttgaacagttgcccccctgtgattggccaaaactctgtaattggtacaagagtagattacagtctgtgtacacatccagttaggttacagttccctatgttcggagaaacctttaggccaaacttaaaatacatgaggaggcagctttaacctaacatgtttgttagattgattcatgttattccatgtggcagtaatttgttcatctttgcactagatattgtttcattgcattatatgttagagtttattaatctcttctacttttgttgcttgtttgggtggttttcagtttttgactgttatgaatagtgcttctgtggtgtacatgtttttgtatttctgttatgtttatgcctgggagtggaattgctcatttgtaggccatgtgtatttcagcttcagtagatccctgcaaaacagtcttccagaatgcttgtaccagtttaccttctcaccagcaatgtatgaatattccacttgctaaagcatcatggtattttgtccttaagattcttgccattctggttggtgtggggtacatggtattttagttagagggtaacttaggaaatagctgttatcttttatataatagcttgcaaggtagctagctaaggaaaagaattaggagagttacagatattaaaaaaaacaacaacaaaaccaaactatgacaactctgacatggttggtaaagcaattgggcacatttgtcagtgtgtgaaaaaccagaggtttctgatgcagggaagtgggcccagtggatttggccaccatctaaagatgagggaatttctcagttcaatcctctacttaaaagagtctgcagttcctgctgcagtctccataaagaacttagcagctggtgacaggagagtgaagtgtcataggagaataactgaaacacataaacagtagtgcagttcgtcattctctgagattgcctaaagttataggctaggcagcacttagctggaaaagctagggtaggtaaagtgaacacaggttgagtatccctattccgaaaatccaaaatgctacaaaatctgaatctttttgagcactggcatgacacttggaggaaatgctcattggagcattttggatttcagattttttgggttagagatgttgaactggtataatgcaaatatccagaaaaatctgaaatttgaaacacttctggtctcaagtatttcagataagggatactcaacccgtagtatgttagaggacacgactcacgtgatgaaaggatgctcggtctactttagaaaaggattcattccattagccctctatgtagagcctttcaggtgtatctctaatgtttggtttgcctgaattccacttacacacatatgtaatataaaccctgtttcccctcctaatattgtaaggatggtaactgctatctatttgtccccctcttgtggtcaagagatgtcactgcaacatctctttttgagaagaaacccatttctttgctgggagtgcccaggaggaattggccaagaagtgaaaagctagattagctggtgccaggtggcaccgttttttggttctgtttttagaaagcatatggacagtttgacattaaacaaacatataacttatactgtctctgtttctttggcagctgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggtactgggaatgtgcacttcacttgatggtttttaataataacttcagtttcatttttcgaaggaagaaaaattattgtgaggaaaatttggcctggatcctaagccttattcatttccttgatcctaccagttgcacaaaaatccacccctctccccagcctttctttggtgttctggcatttgtttttttaatatttccttccattaggaggatttcacgttagttgttcatagcttgcagcagccaggactaaaacaaagtgaagtatactggcagcattgcttaacagggctgcattcagaccctgcttttttttttcttttgtttgtttgtttttttgagacagagtctcgctctgttgcccaggctggagtgcagtggcgtgatctcggcttactgcaacctctgcctcctgggttcaagcgattcccctgcctcaggctcctgagtagctgggattacaggcgcctgccgccacacccagctaatttttgtatttttagtagaggcagggtttcaccatgttggtcaggctggtctcgaacccctgacctcagatgatctgccctcctcggcctcccaaagtgctgggattacaggagtgagccaccactcccaggcgcctgcttttttttttttttttttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcgcggttcttagagttagtgcagtacccggtcaatacatggagtggtccaagcaagcttctgttccatctccctgctccagaaatcctagaacagatactacacccaactttagccaaaagaccaagaagcagtaaatgtttaggccccacatgtgaatgctttggtcagctacatgcaactattacgtatattagcaaaatggattttctatttatctttattccatatgtatacaaattaaatttcatacttggaaagaatgtgttttgattgggtatctaaatcaagcaatatgtatattatttaaaagtaaaaagatttcttagaaagcggtatgacttttataccaggataggatgaaagccctgacctgtagcagcatctgtgttccaaattattacattcccattattcagtgtcttggtacctcatcagtttctgtttagagatttgttttataaagttaattgttggctgaggcaggaggatcacttgaacccaggagtttgaggctgcagtgagccatgatcgtaccactgcactccagccagggcgagattgagaccttgtctcaaaaataataataataatacttgttggtcacaagtactttcatgatgagttgttaagtcatacacatgtggaatatatagagagatagacttagttttttcatttagttggttcatacgcaattctagaaggtagatttgatacttaagttttgctgagaaagggcagatatttttgataattgggaaaaccgttacataatccactagattacatgccattatttaagagtatttttggtaaaatgttacttttttatagaaaattaaataaattaggcattgaatttgagtttataactccttagtattatataaatatatttaaacaaatatttgatttttatgaataattggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataatagtgttatttttgtgttttgttattgattttattttatcaatactggataagttacagatttatcataatgccattaaaagattttcacaaaggataaggaatgccaaagtccagatgtaaggaaccactgtgaagtgctgttcagcttagactgcatttacccacagaaactatcagcgttaatttgtagcttgtttcacataattggctgaaagtgttaagtattaaaaacagcaaaaaactactttgtgttcttctgagcaatcgccactaaattacgtcacttaatgcagattgtactaaagacttaaaatcttatgtaatgtttgcaaatcatttgctttagtttccttttgttcaataagcaaaacgattttagaaacccatactttattttttttgttccagctctgttcagattaaggttatacttaaaataatccaaactttaaaatagaaattagatggggatgatttaatggagaataattttcaaagtgtttgtttgggtagctaattcaccctttgcaattacagtacaatatttacacataaaaaagtaatttacccacaactttttggaacatacttaggtacaccaagccacatttttttgtggtcagtcttgtgacttgttagaaaaagcagctggctgcctgtgtagagccagacttacacttggattgtagtttaatttttgtctttttacctttttttttatttttttgagacagagtttcacttttcacccaggctggaatacagtagtgtgacctcggctcactgcaacctccacctcctgggttcaagcgattctcctgcctcagcctcctgagtagctgggagtacaggcacccgccacaatgcccagctaatttttgtatttttagtagagacagggtttcaccatgttggccaggctggtcttgaactccctacctcaggtgatccacctacctcggcctcccaaagtactgggattacaggtgtgcgccactgtgtaatgtttttacattaaaaacaaattcctgaattaatgggcatatttgcttaatatatccatggttgctttgacttctgactgttgagcttttcaattatcatttaacttttggttaaattcacttttgaagttagttttttgggtttgttttttgttttttgtttttagatggagtcttgctctgtcacccaagctgaagtgcagtggtgtgatctcggctcactgcaacctctgcctcccaggttcaagtgattctcctgcctcagcctcccaagtagctgggattacaggcgcacaccaccacgcctggctaatttttgtatttttagtagagacaggtttttgccatgttagccaggctggtgttggactcctgacctcaaataatcctcctgccttggcctcccaaagtgctgggattacaggtgtgatccatggtgcctggcctgtttttaattattttttttattttttgagacagtgtcttactctgttgcccaggctggagtccagtggtgcaattatggctcactgcagactcaacctcccaggatcaagtgatcctcccaactcagcctcccaaagaacttggaccacaggcgcacgccaccatgcccagctaatttttgtattttttgtagagataggttttgaccatgttgtccagctagtctcgaattcctgggctcaagctatctgcccgcctcagccttccaaagtgctgggattatgggtgtgagccactgcgcccagccaagtgtagtcttacatgttagtgtttacagaggaactgtacgacctttgtgcagataaatatttcataacaagaggttcgttattggtcaggttgctgttctcatctccttagcaagggtggggataatggtaaagaaaacttgtgtgtttgattttcttttctcagtatcttctctcttctgaatttgaatgttttaaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcaggtacatggtcttctctacacatataccctctggtactgacattggggaactggggtaattttctattgctgagtcacatgtaaagcagtgaacttgagaagataggtaatggattagcttgaatacgggtcttttcctttcataatttggacagtgtcaatgtataagataacatacttgccctttagcttgtagtgatgtaatttgaatgcggtacagtctttgatgtgggtttataaacaagacctgatgacaaggatccttcattaggggaggaggagcccatggcatctacagttacagagttcgtgtgtagaattttagagatcccagttatttaatcaatagcattattgcttcgttagatcacagacacacatcaaactcaggcacaaagggacctgtcattaattgtttggtcaaagatttagcctgaggatttcattcataaggatggatcctagagagacatgttataggctctgaatctgaaaaggaacttcagggaattgggtagtgtgttaattggtatctttttacgacatacatacttggctttcctttattgctgctcagttggtgctgtcatagagtatatgttttcttttaattgcagttaatgatattttactcaggccaataaaaagggagatgataggttatatttattatcttaagccctctttttggccagtattctgagtcaccataaatcactgtcactgttattagagagtgttttcatttactaaagagcgtttcagtcaggcgcggtggctcacacctttaatgcgagcactttaggaggctgtggcaggaggatagcgagaggccaggagttcagcctaggcaacatagcaagaccctgtctctacataaaaattaaaaattagctgggtgtggtagcatgtatgtgtagtcccagttacttcggaggctgaggtaggaggattgcttgagcccagcagtgagctatgatcatgccactgtactcctctctgggtgacagagcaagattttatctctaaaaaataaagattcttctgttactcattgattacgctttgaaagcaaaatgtttctcagattttagtttgatcattaggatttcaggatctggtaaatattacattgatacttaatattactataatataatagagatggttgtatcatagaagagtcaagtgtgttgtaagagtaagttttaggtaggaaataatttcttgtagtagcttttcagccaacctaatgccctggcctcctagcatatgaacatccatacttaaatgctggctgtgtccaggtatttgtttctggagtgagggctttcaacctcaacccagctttactactgtggtgctcccacttccctcatggtcctcattcattccattgcgtctgttaaaatatgtcaaagtaagttgaaaataaagaatataagatgttttagccgggcatggtggctcacgcctgtaatcgcagcactttgggaggctgaggtgggtagatcatttgaggtcagcagttcgagaccagcctggccaacatggtgaaactccgtctctactgaaaatacaaaaaaatcagccaggtatggtggcacacgcctgtaatcccagcttaccggggaggctgaggcaggaaaatcgcttgaacccgtgaggtggaggttgcagtgagctgagattgtgccactgcactctagcctgggctacagagcgaggctccatctcaaaaaagcaccaccaccgccaccaacaacaaaaaacacacaaaaaataagatgtttaaatcagttaatactgtgatagaaaaaataaacaaatggatggcatcaacttctctatccttttcttgactttttttcccttcagatctttctggtgcttgaatacatgatttaactcatattttaccattttcttcttaaattggctattaactagcaaagactgtgttgtcattactgggtagaattttctttatgtgtccaggattaaaggatatattatgtaatagacacaaataagtgaaatagaatgatagttttaatggttttcttgtaaatctttttttcttagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggtgtgtgcaccctgcctgccacagcctgcctctgcattggctgttgtggagtccagtggtgatgggctcttgtttcctgaacactttctgtgtgtctggagctatgttaggcacactgaagtcagaaattcccatctggtactgtttcatgccaaataagtcagaataccatggtggaaagagcatagtttttggaatcaaaacacctggctttaaattcttgctctgatctagttaactgattttaggcaaattcttaaccaccttaagcactggtgttcttgctttaaaatggatcctcttataggattgatgtgaagattaccccaaatgagataatatatgaaacatgccaggcacgttgtaaatagtctaaagatgtttgccttttcttgacaaggttgctgtcatcagccatattttatagataagaatattaaaattcagggaagttaagtaacttaccctgtgtgacatgattactaattacagacccaagatttgagcccaaatcctgggattttttactgtgctattttgatggaagtaacaatgccgtgtgtgtgtgtgtgtgtgtgtgtgtaattcaagactaaataagaaagttaattacatttgattatttatttgcatgcaatttatcaaacccctgcttgcttttcttcccttgtatctgccctgagctcccaatgcttactagttaatgatgatgacattggagatggggatgtggattaagtattattgaaccaatacaaattagtgaataattaataggcaaaacaataagaatgatttttcaatcatatcttcaaaaaaataattagtgccattattttactctaatgaaataaaggataattgaaaaatagttgattcttcatctttagaaattgcacgtgttgttagtttaagataagaggatatgaaatgcaactaggtgtgtggcatttgctttctaggagtttcttttgaattgtttacatcgagatctgcagggtgggataaaggatttgtctaaagaagaaagattatgggaagtacaaagaattttgacagccctcaaaagaaaactgagagaagctaaaagacaggtgagttattattttgatacctaatgtttataatagaatgtgtttgagtcttttatgtactttatgtactctttttttttctttctttcttttttcttttgatgttgaccagggtggtctcaaactcttggcctcaagtaatcctcccacctcggcctcccccagagtgctgggattacagacatgagccaccacccccagcccaagttctttctgttaagaatattataatgtcacttgaagtgaacttctctggtgggacatttattcactaaaatgtttctagtcctatattattgatattgcagcctggtgtcagtcacatgtttcagtgcaatctagaaagtttttttttttttttttttttttgagacaggatcttgctctgtcacccaggctggagtgcagtggcacgataatggctcactgtagcctcgacctcctgggctcaagggatcctcctacctcagcctcctgagtagctgggactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctagaaagttttgttttaattaaaaatgattttactaaaaaatttgtcatttcctgcttggttatacctgtaaacagggctttctatggatgaaaaacaggctggatggtgacacacctttggggactgctggggaatttaaggcatttagaattagtcagctctttggaaatgtagtgatgagggtcacctggaaggccttgaagatcaggagagattctatttatgtaataataataagagtggcctgcaatacctgatgagtttagggtatgccagtcagacttttgagttccctcttgtttagtgtgtgttgcttggttctgggactgtgagtgtaccagccacagcaatggtaaaatcccagatctctggatcaccttaaaatccacattgcagatcaactgcagcatctaaacagcacatccaaggaacattagttagcccttgcctgaattggggaacatgatagtaggtctctgttgtggttgtgttaaagagacaaagacaacctgaatacttctgtttctttgaggttagagatttgtattaatgtggaggatagctttgtcacacggggcacattcatgggacttttacacgtgcgctccaggatatgtaatgtagcagaagccctctgcgtatttttcttccttctttttcctagctcactaggttatctatctcttgcttcctttacgtgttttttgtttttggtgttggtgttgctgttaaaattttcccttcatgtctcagcctagaatcaggtattagagatggaccactcaggcttcaggggcaaattgtaattgttaatcatatggcattgccagtcagcctttaaatgaagagtcccctgactgacctaggacagggctgatggaggtttggcttttgtttctcttgcttctacatcttgcctaaataaaggaatcatggtatagcagccagaaccaatataagaagggatggattaactttgctttaccgattttcccgatgctatgttttcacgccagctcattaattcacaaaatgcacagaagattctacaaaagtctaatgtatttttatgtattagcaatgcacaattggatattgaacctaaaaaaaaaagagacctaagtaaatggagagataaatcatggatgtggtacacaagattcaatattgttaagatgttagattttcacaaatttcaactttgaggaataaatgacttttaaagacagaagtaatgtaacttatcatattaacagactaaaaataagaaaaacccacaacatcgtatcagtagatgcagaagaagatttagtagaattcaatacttattcatgataaaattcccagcagataactttctcagcctgataaaggacatctacaaagaatctacaattatcatacttaatagtgaaagactaaatgcttaccctaagattggtgtacactgcagggatttctgctgttaccacctctattcagcattgtactggatgttctagccagtgcaataaagcaagaaaaaagacacacatattggagagaaataagtttttattcttggataacatgattatctgctgagaccagcttggtcggggagaccctaacccagtggcactagaggaattaaaagacacacatacagaaatatagaggtgtagagtgggaaatcaggggtctcacagccttcagagctgagagccacacacagaaatatagaggtgtggagtctcagccttcagagctgagagcctcttattgatagcaagccagtgataagcattgttcccatagattatagattaactaaaagtattccttatgggaaataaagggatgggccgaagtaaagggatgtgttctggctagttatctgcagcaggagcatgtccttaaggcacagatcgctcttgctattgtttgtggcttaggaacgcctttaagcagttttccaccctgggtgggccacatgttccttgctctcattccggtaaacccacaacctgccagcgtgggcatcatggccatcacgaacatgtcacagtgctgcagagattttgtttatggccagattctggggggcctattcccaacaattatctacatataaaatcctaaggaatctacaaaaaaagagctaatcagtgagtttagcaaggttgtaggatacaagaccagatatacaaatgtctagtgtatttctttatattagcaatgcacaattggatattgaacctaaaaaaaaaaataaaaagagagagacctaaataaatggagagagaaatcatgcatgtggaacagaagattcaataattgttaagatgttagattttcccagattggtctgtgggtccaaccccaatcaaaatccagacagatggtatttgtgaaaatgaataagctcttctaaaatttatgtggaaatacaaatgacctagaataggtaaacagttttgaaaaagaacatagccggaagattggaggactcatactacccgatttcaagacttactacaaagctgcagttcatcaagatggtatgtactggatagggataacatacagaagagaaagttcagaagttgacctacacatatatgggcaattactttttttttttttttttgagacggagtctcgccctgttgcccaggctggagtgcagtggcgcaatctcagctcactgcaagctccgcccgctgggttcacaccattctcctgcctcagcctcccgagtagctgggaatacaggcgtccgccactacgcccggctaattttttgtatatttagtagagacggggtttcaccgtgttagccaggatggtctcgatctcctgacctcatgatccacctgcctcggcctcccaaagtgctgggattacaggcgtgagccactgcgcccggcgggcaattactttttaatgaagatactaaaataattcagtggggaagggatattcttttcaacaaacagcgctggaacagatgcaaagaaaaaaactttatctgtacaacatatgcaaaaaatagcttgaaatgaatcataaactaagactaaaaaagcttccagaagaaaaaaaaaacaggaaaatatcttactgtccttggcttaggcagtaatttcctaaataggatacaaaacctattataaactataaaagaaaaatttgataaattgaatttcatcaaaaatttaaaaatatgctcttcaacagatattaagaaaataaatatccaagccagaagctgcgacagaatatttgcaaaagcttgtatctgataaaggacttgattttttttttaaagtttacagtttaataagaaaacaaccaatttttaaaaggcaaaaatttgaacaaatactttaccaaagatcatatatagatgacaagcacatgcaaagactctcaccatcattagtcattaaggaaatccagattaaaagtactctgagataacagtatacatcaactagaataggttgctcttggtaatgcaaaatggtgtagccattttgaaaaacagcttggcagtttcttattaagctaaacatgcggttacttaccatagcacccaggcttcccactcctaggtatttctctaagagaagaaagcatttgccctcacaaagcatgtgcgaaatgttcctaacagctctagttgtaatagcttacaactagaaggaaccccaatgtccatcagttggtaaatggataaacaaattggggtacatttattccatggcatgttgctcagcaactactgatacagacagacaagtagatgaatcttaaaagcattgtgctaagtggaagaagccagataatcacactacttactgattgattcagttatgaaactcaaggaaaggaaaaactgcagcgatggagaccaggacgggttgctagatgccggcagatggtggaggagcccaagggcactttgtgtggcaatggaaacgttctagagcatgatggtggtgctggttacttgactttatgtttgtgaacactaaattctgtgctcaagatttacactcctgaccacaccctccctaagtattacaataggtaatttctgtggaagggtaccagaaatggcaagtacattcaccagaattgagtatttttcacagtgcaggcacagactcagatctccatgttatattccaagcccagttaccaaatgcccatccagctagatggttcatctgactgttattgtttcaattctaggaaatgagaaggaaacgtgtagattggtggtggtgtgatttgttgaatatgtgttacatatgggctgactagttcttttttatttgtcttatttgacaggagtgtgaaaccaagattgcacaagagatagccagtctttcaaaagaggatgtttccaaagaagagatgaatgaaaatgaagaagttataaatattctccttgctcaggtaacctaaaatctttttctctcttttgcaagactcttttttgtttttgtttttgagacaaagtctcgctcttgtcccccaggctggagtgcgtcgaagcgatctcggctcactgcaacctgcaacctccgcctcccaggctcaagcgattctcctgcctcggccccctgaatagctgggattgcaggcacctgccaccacacccagctaatttttgtgtttttaatagagacggggtttcaccatgttggccaggctggtctagaactcctgacctcaggtgatccgcctgcctcagcctcccaaagtgctgggattaacaggcgtgagccaccgcgcccagcctgcaaggctcttaatggtcatttaaaaatagtaacttgagaagctctactacagatgtgaatattttaaccaaaattataaagtgattttgagggcctgtgtctgttttatttgtcccttcctttatgttgtgtttgttaaaatgttcagttatggcgaaagaaactaccttatattcagtaatgactctttactgggcattgttctagacgtttaatctcatttagtgtgcacacaggtccgaattataggtcttttccctaatttacagattagtggtacttgttccatattaatgagatcagacttttaaaaatattttaaaaaccgttgtacctgacattacaaagtctggaatccttgaaatgtaagaaacagattttatctaatagttgttgctaataacaccttttagatattttgattttattctttacaggtgaaagtcaattgttggaggcaaattgtcttattagtccttcattgatttaacagatatccctttcgtgcctactgtattccaggcatagagctgaagatgagctcatttctttctgaagttctcaagtcagcctcactttgttctggaaattgccagagtttaaccagaaaggaatgaagttctaggctctgaccacagtgtgtctagggttccagaaactcgtgtggtttccctgaagcccaataggtttcagtccttctgtgtcacctctgaaacatgcgttgttttgcctctcaggagcacatagttttccttgaggagaggatgagtcccagattatatctttgtttcagggtttttcagtctggtgtttgttggaatgtcagctttagtaggtatgcagaggtataggaaagacatctgtgttcaaaaatatttgagcagtactgtgtccttcatctcctggagagacgttctcagcgctgttggtgtttgtgggtagttcattttggcatgtgaccatggtaaataactaccttctcagtacctgctcatttggaaagaacgtccgcacccagctcctcatccccacagccaccttctgttactctcttaagctttgtctgccttgcttcttttctctaggtcagaggggctctctagatcttgggcagatagggattttttccccattcttttaataagactgatgatcttaccaatcttagaaatgcatattgtggtaaagcagaatattgactatttaaatacctttgggccaggcatggtggctcacgtctgtaatcccagcactttgggaggctgaggcgggcggatcacctgaggtcaggagtttgagaccagcctggccaacatagtgaaaccctgtctctactaaaaatacaaaaattagccaggcgtgatggcaggcgcctgtaatcccagctactcagcggctgaggcaggagaatcacttgcacccaggaggcagaagttggagtgagcgagattgtgccactgcactccagcctgggtgacagagtgagactctgtctcaaaaaaaaaaaaaacaaccctgaggactttaaagaggacggtggcttatggaaaggtgaaaaaatttctgtaatgatctttccttcccactgatctgccttaaaggtgatgctgacaccagccagacatctcttggatccttcttttcctagtgaccccatcaaaggtcaccatggccctgtatatgcctactttcctgagagatggggaggcattaagagtgggaagccgaagccagtttcatccctcaagtcctggcttttccctgtgggggcctcacaggggcctttgcagtaggaggatatggggttcctgtgtggcattttgttattgagaaaaatctagtcattcccccaaaataactttaccttttctcaaagaagccttttcttgaccctaatgaaataggatgtttttggttgtgcagtacgtaactcgtgttcagcactcaatggggctcaagaattcagggcaacatgggagaccctaaacaagtgacatttcctggactaaaactctcagagctgttcaccagtgttcattatttcaggagaatgagatcctgactgaacaggaggagctcctggccatggagcagtttctgcgccggcagattgcctcagaaaaagaagagattgaacgcctcagagctgagattgctgaaattcagaggtaaaggaaagccgagggttttgaagcttctgagcatgtttctttaaatataaccataattgttttagctctcagactttcctacaaaagaattaggcatgtgaaattcatcatctttaagtttcttatttatcaggtcctaagaatggtgttatattgagtagagtcctgaaaacgtggtaaatataaaaggaggtcacagacaagcacatccagtagcgtcttcctttgtctctcatcttgcagtcgccagcagcacggccgaagtgagactgaggagtactcctccgagagcgagagcgagagtgaggatgaggaggagctgcagatcattctggaagacttacagagacagaacgaagagctggaagtgagttttggggggaaatagccaaaatgcatactaacttttagaaagttgtagagaccacatatttcccctcagaattgtccttctttttcttggtcaccagctgggaggctgagtagagaggaatttagggggacatctcaccgagagtctgtgggacttgagctaagtgctggccaagcagatggcacctgtgtgtcttcctcaggctgtgaactggagttctgtgactttagtgtgacatgtagacctttctccacccgatgtaaaggcaagcctcacctgactgtgtcagcttgagcagctttgaatgacctagtctctgttcccagagaaggtgaacagaaaaatcagcgctagtgatggaagaacagtctcccgagtctccctgtgggtgaagcaagagacggagtttctcttggcctcagcccgagaagcagcaggtgagagggaatcggcgctaagaaactaggagaggctgcacagtgaagagaaggcagcagagataaaggtctagatcacagtttcccttcttaccccaaataaaatattgtgtccagatattttgcctaaggattgagtgagagaagataccctcttcacagaaaggaatctaaggatagagggacagctctgcatccctcatttgggttcgctcagtggctggtgcgaaccagaactacaccctgcatagaaaagcagaattccacacacagccaccctgcacagagtcctctctgccgagcctgcgggcagagctcagaggcaaccacgaaggttcaaggcagagacccttgctgcggcaggaatgtgctgtgggaggaagccctgcaggtgctgagaccagggttgctggagctcctgttcagaaaggcctcacattggcacctgatgttcttttcttaacattttaagatcgtattaaaactctgagtaggaaaacagaatccagaagtattgtacttggggtgtaggctgaattgctgtaataaagagaataacatagtggtttaaacaagatggtgtctcttgtgtggcaggcggtccagcccatcatcctccacaccacttttttccatgtagggtccaatgtggctgctctgtcttgccactcttagcaggactaagttagcagggaagggatcaaggcatgcccagtcgccaagggcagggtgcatgcgtggcactcggtgcttgcgcttacacctatgcccccttcgcagagcctagtccatgccacacccacgcaggggaggctggcacctgccacagagtggaggccacggcagcagggccgctgctattcctcaggacctaaactttgccgagtacatccagatgatttagaattgatagtaattttctgtagtttgattgagtaggacatttcagaattaccgtaatactattcacaaaagacaaaggatattcacctttgaaacaaatctagttttttatctgatctctaactcccctttctaattgctgctaaaattacttttattttctccttgtttaagggctgttgagaagccagttcaaagttataagttgtctattttaaacactaggatactgaattattaaaataacggttttctgttggcacatggatgtgtttctctctagtaaccaggagcagggtttccagcctcacattctcaggagtcacgtggctcactgtgcactgtgcattcctgctgtgtttgtcttctgtttcacaacccattgacttaaacaaaaccagattcctctgtaggatgcccttgctaaccgcgctctgctcctgagaaatcgtcctctgacttccttaagtgataactgccctttctgtcattccccaagataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaatcgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagacaaacagctgacttctctgttttgtgtagttaaatctataatgttaaatttatatagctaaattctccttgatggaaagtctcaaacgccctgatggggtacatttagcattggggatctggagatactgaggtgtgagacctgaggtcacctcccaagatgggctctagtgctgtgtgatcttttttttttttcactgcagctgtttctgtgaagagcacattgcttgttatgtattaggatatcttaagaacaaacacaccttctgcgtccagccaggctgagcaagatgcagcctgggctttctggagctctcgatggggacccgtgcccaattccatgtgttcagcctcagccctggcccatggttctcatgagggatagaaggaaaagccggagtcaattagcaggcagaggcttcagcataagatcccacagcttttagggaaggtgggcagtgccccctggaatgttctagactagatcccaggagacccaggagacgtgatagcaagcctgggcagaggagggggcagaaagcccttaaatgccacatgtaggggctcttttgcagagcaggaagagtactgctgcccgtcacatgccgggtcctccgaacctgcaaagtgatggatgctcattctctgcattctggtgactttgctgttactagacaagcatgattcaacaggtgttcagttcagccccagcagatctcggacatccgacctctgctcccaccgcctagctcaagtgtcaagtgctgtgaccggacatcgtgctgagctgttcccgggtctcgtgctagaaactggcttctagacaaacagtgcgggtactggaaggaacgtggactttaggcaggaaaggctttttttatttgtttgtttttggagacagagtctcactctgttgcccaggttggagtgcagtggtgtgatctcagctcactgcaacctctgcctcccagttcaagcaattctcctgcctcagcctcccaagtagctgggactacaggtgcacaccactaccatgcctggctaattttttgtattttagtagagacggggttttaccgtattgctcaggctggtcttgaactcctgagctcaggcaatccacccacctcggcctcccaaagtgctgggattataggcttgagccaccgcacccagtgtaggcaggaaagtctgggttttcttcataaccttcaaaagcagtcttgttgaacttcagttttttcattggcaaaatggtggagataatcttgatttccaaaggctgcttagataaataatggctagtaagtacctggcatagggcttttggcgtcatactccaattcattttccctacaggacatgatccgtgacttagtcatcatgttattaacattaaactttatagtgcagagatgagtcggggaagaaagaacgtagcattctttaagatgcaggtttcatttctcagcctcaaggctcagctacagaataag

SEQ ID NO: 16113 - DNA, 72278 bp, Human
  misc_feature (1)...(72278): n = A,T,C or G
accacggacaacacacagctctgccatccacgagctgcattgtaagtgaagctgggttaaaggtatgtagaataatgattgctattatttgtttaaatattatttcttagaagaaggggacagagtgcagtttgtaaacactggtttaaaaactcctttcttttagaaaggagagaaagtgaaatgtaaaaaacacatatttgtgctgaaccatgaatgataccgtcactgaaatatctaaaaaccatattgcttaaaggcacttcttgcaatgtgtaattcagctaagatgataatcaaatgcatagctcttgaatacagaaaaatgatacagatcctcctcctttgctgcccttcccacagaatactgagataaaacttactgaggcctagctaccaaaggcagaattagttgttccatatcctaggctagcatttggtacatagtccctattttatcatgattactgagaactgttaagtctaactcaactgtgtagatcaagacagttttgtcttagtgcatccagcggctgaagcacagttggcacgctgtagattttgtgttgttgcggtgagaccaccagttagaataaagagctgatttgggccgggtttggtggctcacacctgtaatcctggtgctttgggagaccaaggccagaggattgcttgaggccaggagttcaagacccacctgggcaacacagtagaaccacgtccctaaaaaattttaaaaataaattggccaggtggagtggcctgtgcctttagttccagttacttgggaggctgagatgggaggatctcttgaggccaggagttcgaggttacagtgagtcatgattgtgccactgcactccagcctgggctacgtaaggcaagactggctctaaaaaaaatttgctttttaatgaaaaaaaaaaaaagagctgatttggctctttcttcccccatttacccagaattgctaaagtggtagatactgacaaggtatcttagcagggcagaagtctcatggtttgagtcagttgggaccaattgctgttgatgtgaatttctaactcctttgtcattctgagtgtgtcagctgaattcacataagggcattcaccaagggaggaagagaaaggcctttagttttaattattttatagttgagaaaattagacacatactcggggttacggggtctattctgatttttattactcctagaaatttcatacagattataatctgtctatcttgttagtaatatctgactgaattttttggaatagctatgtgtagaacccattttattacacagatttaggaatctcagaggatctgattccttagtctcttaaatcttcagtggcattaaatgccaacacattgtccttggtcaagactacaacgtagaaaggaacaagctaattaactacttagaattccctctcctaagagaccacatcgccaaagtggcaccatgacacagcttggtgttttgttggtcactttaggagaacaccattttggaggccttgggtggagctggagatagagccatggaggtagaatcgtgtcggaaaacctgggtttagccccattttgtacttgggcgtttgagctaatcgcttaagtcacgtaaaacaacaagactaataaagtctgggatacagactttaacacctcaagtgctgccaaaagtatttagaagacaaagcgaatcataggcacccttcaccgagcacctcctagacatcaagaaccatgctaggttccctacattcttcatttaatgccaataaccccacgaggcagttatcaccttcattctacaaatgggccccactcctaccaattaactggctgaatcaggatctgaccccgggcctgccaacgctcccgctggtggattgcccgccttgtcagctcgagttggcaggacgtgggagtaaaaacccggcgccccagccttcaccgtgctgcacgaggaagctggctaggcaggcatgactttgtcagtcaaccatcccgcagccgggccctgggctttgttagcagccacttggcgagggccccgggcgggtggggaggcggcgcttcctccaagaggaggtgggaccccggccccgacgacctcggagccgcccccggccccggatcgccgacgacgtacgtgcaggcctggggatggggcgctggctgcgagcggcgcgcccgccgagatggctgcggctggcagggcggtgggcgaggccggtgacccaataaagcggccgggccgcgggaggccccgcccggccgggttccggcactcgccgcagggtcccggccggcggcaggttgcgcgcccccgtccgcagcgctcggcgtgagggcggctcgggaggagggtgtgagcgcgcgtcgccgggccgggacccggcaagcagcgggaaaggcgggaggcgggagcgccggtcgcccgggagccgcgcggaggggcaggcggggcggggcggggcgcggctgggggcccgggcggccgggagccgcgccgcccgcggcaggcccgggccctcggcccgccccgcgcgcgcgcccccgccagcccggccctcctcctccccgccgcccctcccgcgcgcgtccaccggctccccggctcgcgccgctccatgtagccccggctccccgggcggccgcggaggagggggcgaccacaagatggcgggtacgtggccccctgttctccgggcggcggcggctcctcgagcccacccgccctccgccgcagccctgagtggctgccgggccggggccggcgtggggtcccggcgcgggaaggcgcccccggggcgggggggaggcgggcggggggggggcgtcgcgccgggccccggggcgctgaccgggcctttcttctctcccctcggcgcagacctctcgctgcttcaggaggacctgcaggaggacgcagacggatgtgagtggcccggcctcgcggtggcctggcagtccgcggggagcggccggggagggcgggcggcggcgaggcctgggccgggccctggctggctgaggggacggtgggcgagggcggccccaggcgggctggggtggcgatcgggggggaaaatctcgcgtccgtgaggaaacggcgcgcccaggttccgctgggggagggagacgcccggagtaacgcccaagttcgctttccgcccttcgctctcttctcccggcgcccccgaatcgcctgcgggctcagcagtggcgcggctgttttggaaggagaagcggtggggcaggatttgaagtggggtttgggtgtgtttctgcccctggtgtccccttcccccgtcactctaggaaggaagaggctcgcgcgggaggtgtgtttccttagagtcgctcttccaggagcgcccgggggtcagcctgggccccggctagccgtctgggctccccgacccggttttggattgtttgaggatgacatacctgtcattttactttggctggtagcagttttcagatgctcccgatttgattagtggattacgagaaggttagaaggtgtggcctccgcaggaattactaggtttggagagcatatttctttaatgcggatgttcagaaatcacccagccctccttcagtgttaacagtgcagctttcctttgaggtactgaagtttttaaagagttgacgcttttatttttaaaaagacaaagtttctgacatttcctgatggcgacggaattgatatttagaaaggaatttttcgtcttatatgtacttttctaagcctcagaaaataatttgggtcacgatagaaaagacaaaagagttaagcaggtttgtattgaaagaagtgacaaattgcagttaacttaaaatagtttctattcttgctaatcttccaaaatagcgacccatcaaaaaatcaataggttttgagatgcattttaaaaatgcagagtgtgcaaaatatataagcgaagatcatgggatacataagggaccaagaaattgttctgagttgagatgataaccatagtaggattgtggtctgtttagtggaaagcctaccggatgctgagattgactgtctagtacctgtataagtaatttcagagatggctgcagtttgaaattactcttttaaatactctgtagttaatccttagcattgtctaatgtggttcccttactcagagtaaacttaatttttagattcctggttgttttgagtaaagtaagggggatttactatttagatggattatctgaaacgagtaatttatctttaaagtaaatgaaccacatccaaacttttgctaagtctgtgtttttagtgaggtggctcaaaacagctctcttaaagggagcagtactcatgtagtgaagggcagctttaacattttatttaatgtttaccttaagccacttatctgcctaatagtaagtttgagatattatttaaggcatctgttgatttcagatctcttgccaggttaggattggagaaatggccctgattatgttacctcgaggagggctttttatatttatgttcgacttcgtaaatagaagattcatttattcagcaagtatttatgactggagcaaaaacttctcactcctgaaggatgaaatgcagtctcagtttcttccttagcccccaagaagcacagtgtagaggggaaggcatacctgtgaaaaattcaaccatgagtttcaacactctgccaggtactggggatggagctttgagaaagatgggcacaacccatgccctctagtggtttacaagcagttttgaatctaggtgtacagtacagtattacagttaccactggagccaggctgctctgtttgtcttagcagtgtctttttgggcagacttgggcaactcacttaacctccctatgcctcagttttgtcatttgtaagtaggcataagaaatattacctacttcatagagttgttcaaggctgtacatgagttagtgcctctgaagcacttggaacaattcctggtaaacagcgatgattatgattatgtttgctgttatgagaaaagagcaagggaagcttaaaagaagagcagagaaggaaacactgatgttgaaccttacagaatgaaggtacttaaagatgctgccaatgctcgcaactaaattttttttttttttgagatggagtttcactcttgttgcccaggctggagtgcaaaatggcgcgatctcggctcaccgcaacctctgcctcccgggttcaagtgattctcctgcctcagcctcccaagtaactgggattacaggcgtgtgccaccacgcctggctaattttgtacttttagtagagacggggtttctccatgttgatcaggctggtctcgaactcccgacctcaggtgatccacctgccttggcctcccaaagtgctgggattacaggcgtgagccactgcgcccggctgcaactaactttttaaagattctgtttcctgtgcattttaatttaggataaaacagacattgaaggcacaatagttatttgcatattcataatttggttgaaggctttgttagagtaattgcttatttttctcagttactaaagtttttacaggtgatacctttacccagaatattcaggaacaaaggacttttggacatatggccagttgaaggaccacttcccatctcttgtgaagggagaaagaatgagggggaacactgggccatggtgcctccttagagagcaagatggttggtaaaggactgagacagctgtcacatcctggagaagctggagaaggtagaggacccaaaggtagaggaacggagcttgggctgcccttataacacggttgttatctcgtgagcctgagtttctctgtctatggtaaaactccagagtatggagcccaacctccagagtagttgtaaacaagtcctactacttcagccaagctaggtgtaagttggcccttgggatgggaagaaattgttttctggtcaagctctagaatcttggttgaccttcctaaatgcagaacctggactatgagggaagagacagtaagttctgttgtgcagatgatctaggaaaggacctagctggagtctaggacttgaaagaggggcattgccagacattgctaagagtctcaggtctttcgatttgatttgttttaatcccgtctctgtacagaggcacagagtcggggaaaaggttggtcaaagactgacttgactgataacctttggaggaaaaaaaatcctaatgagggaaaaatggatggtatttgtgtgtgtgtgtgtgtgtgtgtgtgtggtacacataatttcattgaaggagtttcattagaacttaaacttttatcaagtaacttataaaggtaagtaaatgaaatcattatcaggtactcttaaatttaggagaataggctgggtgcagtggctcatgcctgtaatcccagcactttgggaggccgaggtgggcggatcacgaggtcaggagatcgagaccatcctggccaacatggtgaaatgtctactgaaatacaaaaaaaaattaactgggcgtggtggcgtgcacctgtagtcgcagctgctcaggaggctgaggcaggggagttgcttgaacccaggaggtagaggttgcagtgagccaagattgtgctactgcactccagcctggcgacagagcaagactccgtctcaaaaaaaaaaagtttaggagaataatgcaataaaaaccatatgtatttaagtttaaaagtgaaactttcagtactgtatcatgaaatactttgaatttcaaattgaaagcaaaccagtgactccatttgaacataggttatctcagcagatttcagagttgggtaaaccctttttaactttttatatttaattatgttccttaaataatgggagacaatacaaaattgtagatgtttagaaaaaattatttcagatttctgttttagtttccaaagatgcaattttgattcacatttaagttggtagattcctaaaatgaaatgagactaagatacggttaagatttgatgagccaatgcttgtaaaaataatttcattgaaggagtttcattagaacttaagcttttatcaaagtaatatgttgaagaatgttatttttaaagaatggctatgtaacgcttagtttacagtgcctttcatacacaggttattcttcacagcagtcctgtgatgtgtaggctatggtattctaatactaataagtaagttgactaatgcccaaagggactaaagaaacaaaactcctaagtttagacggaattttaagctaggccttctgattctaaatatcatattttgaatattttcttaaatggcccagtttaaaatattgatcaacccaaacttgtacaggcaatttctttgaactcgttcttaaagtacccttgaaaattaatctgggatgctgcatgtggtttagtttacacctggagaatgatagagaggatggagcttgggtataagacagcttatttagtcgttaacttttatctcagctgtaactaagtatgacgttgaaaagtttttgaagctatgttattgagtatgccatacaacagacttttttcatatttaagttttggaatccttttacattatgctgtttttcgggtttaagggcggtgttgaagtagagtgaaggatgggtccagaactaactgagggtaaccgcctagaccgcactctgtgcagaatcttcaggccttcctaccatgtttcaaaaccagttctgataagcttagagtccttgcttccggtgggaggtgaggagcaaaatattggggctgtatctggtagtggccagggaatcattcagaaacctttggaaggtgcccttgaacgtgaatcatatttaggagtattgttaaatagggatttgggagggtgagtcgtgagacctggtagcctgttttgactgctgccaacaagcctggatggagagatctttatttagagataatatcattgatatcttagaaaagagtgcttttaaaatggtttcagtggtacccacatgtgtgttggatcaattaatgatacctctgctaacaacttcccacataaaattgaaagagagagagagagagacagagagaaaaacccctttgtaaatatgcttgggcctgtagctacacgatccactgccctcccccctccaaaaaataaaaaaccaagacacctaaatgcatactttttgtttgttcctgcctgtgaaagataaatagacctcaggaggtaaagttcagaagtctgctgccacatttgtttgatctctggtttattatttctggtccttttctctcagtctcctcaaaacaatgaatgtatgtttattaaactattgttaccttgctcctatgtttgtattacatcttttttttatattttggagtaaaagaatttgaaagttcctaaatttgaattagagttgtgttgttgtttttaaattggagctgagaataaacctaacttagtgttttgggcagaagtctggatggcacacctatggaattttggctgaggaggtattccctctaatttctataagagggtctggaacttgctctgcttttagcacagatctttgagctggtgacatcatcaatgctgcttcctccacattcatttcttaactctcctaacttttaagtcatcttagcttcttatctccctagactaaggagcaaacttaacttactttctggccttattgatatgaatgtggttggtatttgagcatctatcatgcagtcattctggaagatacctcagtatagttttgtgtaggggaaagaacactgggcttggtaagcctttagacctgagttaatattctggccctgccatttattctctttataatctgagcaagttaactttttctcagctttctacctttaaaatgttgatggatttttggatcatctgcagtttttttgctgttacaaataaagctgctatgaacattcacacacaagtctgtgtgaatatatatgttctttctcttgggtatacatctagaagtagaatggctgtttaactttttaagaaactgccagcccggtgcggtggcttatgcctgtaatcccagcactttgggagaacgaggcgggtggatcacccgagatcaggagttcaagaccagcctggccaacatggtgaaaccccgtctctattaaaaatacaaagaattagctgggcgtggtggtgcatgcctgtaatcctagctactcgggaggctgaggcaggagaatcacttgaacctgggaggcagaggttgcagtgagccgagattgcatcattgcactccagcctgggcaacgagcgaaactccatccaaaaaaaaaaaaaaaaaaagaaagaaagaaaaactgccaaactgttttccaaagtggttatatcattttccattcccaccaaaagtgtatgagagttccaggtcctcatcatcattgtcaacacttagtgtgagcagtcttaattttagccactcttattaaatgtataatagtattaatttgtggcttgaatttgcattaatggctaattatgttactctttttatgtgctcatttgccatctaacttatctcctttggtgaagtgccttttcacatcttttgctcatcttttcattgggacattttcttattaaattttgagagttcgttatatattacagatacttaagacatatacaaaggcagatggaccatcatgtctctactactcggttttgactttcatttatccatgtttctgtttttgtttttttttttttgagacagggtctggctctgttgcccaggctggagtgtaatggcactatcttggctcactgcaacgtctgcttcccggactcaagtaatcctcccacctcagcttaccaagtagctgggaccacaggcctgcaccaccacgcctggctaatttttttgtatttttggtagagatggggttttgccatgttgtctaggctggccttgagctcctgagctcaagcaatccacctgtcttggcctcccaaagtgctggaattacaggtgtgagccactgcacccagcctgatgtagatcacttttatatttaaatctatgaaattcatttttgatagaaataactcatttattcaatacttcatttatttaagattggtggcaatttggacctgagttagttcaaattttgtatttggattacctgtgggaaaaaaggttactaccaaagtaattgcgttaagagtgcaaagaaaatttttactcactgaagggaacaaatatctataatatttgggagatccacaagtgtatgtcagagcaagtgctttgttatactacctttctgttaaatactgtttgtatacataatcttggtaactaacttgaaactagataaacatgccactactgtattatataaatagaaatacattatacatatggtgtatatatataaatataaatacatatatgaatatacatatagtatacttcagcaaattattcttgccttaaattcagttgtgctataggacaattttgcatttctaaggatttagtaagcttttagtattgatatttgaaggaagggtttctgataaacattatttatattattgcaaagtacaaaattaaagtttgacatacctgttgctggagactataaagattatgttgtatggtccctgtaaaaggccaaatattaaatagtttaggttttgtggaccatatgatctttgttgcagctactcagatctgctgttgtaaggtaaaagcagccatgacaatacagaaatgaatgaaagtaagtgtcatccaataaaattttatttacgaaaacagaaggtgggccagtttggctcgctggctgtagttggccaaccccttcactgtgctataaaatccaaggtctgtaacatttttattcttgactcatcacacagtgttcagcaatacatctcatcagtgcttaatgtagaataagtattgaatgaatcttgatgtttcacaccaagctaaataagaccgtaaacctaatttggggtcaaataatgaaattatttttaattaaacttgttattttgaaaactttcagacctatacaaaagctgcacagatattgtaatgaattcccaactcttcacctgaattaagctgttaacattttgccagtttgctcgttacttctctatacagttatgtacacacacacaatgtaatgtaattttttggtgtacctttgaaaataggttgtggtcattgggacctttagcctgtgtctcctaagaacaagggcacttttacaatcatagtaatgaaatttgggaaatttaacattgctacaatcctgttatatagtatgtagtacatattgaaatatccccagtaatgtccttatggcaactgtcttttgctgtaaggacattacttacaaacttactagtttggaacaatttctcagcctttagcattcatgaaattgacatttttgaagagtccatttggttttatctgtttcctcatgatttgattcaggttattctttccttttttttttttttttttttttttttttgacaggactgctacataagtgatagtgtagttttctcagtgcttcagattaaggagcacctgatagcagtgtccattactggtagtgtggaggtgatgtctatcaaattgctccactgtaaagattctgtttttcctattgtaattagtaaggaaatagtttgacaatggggaaataccctgtttccaaacatttacccatttagtgttagaatgtgttgatgattcttgcctgaattaattgcatttactagctgacattctgctttatagaagagcctgatcttcctccctattcatttgttggtatatttatttgttaaaatataattttaaagccccaaatctttataaggtaactcattctgtggtgtatctcattgtctttcgttttctaaaatgtaaagatgggaaacaaaatgtggccgatttattgtggcctgagcagtatctagggaaaaactgaagggaaggatagactatgagcttttttatgttttacgttacattattagagattatgtagagaatagaagggtgttttgatcaaatttgataaaagtttgtacgaattaaaaagttctctttggtgtgatacttctcaaggtattaatatgctaatgtgcttgtgaatatcttagagaaggataaagtatagtaaactcttgacttatcaattatccctatggactacattttcattaacaaatattaatgaatgtgcctccatgagaagcattggactctgttttttagataatgaaaagtttagcaagacaatctttagggaatttatatatgttggggagggagaggagaagggaaggtaggagaatatgaaaaaaaggaaaaatactttgcaattattggtggagtaaaagcaagggcacccaagacggcagggaattaaaaggaagaactcttaattagaaaatagaaaatgcctcctgggtgttgttagtaataggtaaatttaagctgagatgaggttagagaggacagaaatggaacagatgaaaccacataagacagaaaagtagtggggcatgttgcagcaaattgactccacatgggctgtgtacagaggaggaaactaggttggggccagatcctggacacccttgaattacagcatgagaaagaaagttgtaccttaattcagactgcctgggaggcttatcagggggtggaatggtagggattgggagggagggcgtgcaagggcatctattgaacagagtgggaagattgaagtggtgctgatatataaactggattcgaatgaggggaggctgggagtagatggatccaggcaattatgttaataacagtctaggaccgtggtctttaaactttattactgcatacctactaaaataattttgaaaactctgtatcatgtattttaaagttgacattcaaaattttctccataaaatttccatatttgcaaaggatatatttctaatgtattataaatatcagtgttttaaacatagagttgtatcactttttaaaatggactaaatactatagcacttggatacccactattcattttttaagactcacaaatattcaggcaagaccgtgagagacaaataaaacaaaaaaattgtgaataaattctttaaattgagactcttgcatttttttctttatctcttttcattttccacacagaaatttaccttgatgtattttcatattttcatgcttgagagttgattgcccagtcacatttctttgcaccaaaaataggtaaagagaaatttaaattttatgtcaggcaaggtggctcacacctgtaatcccagcactttgggaggttgaggcaggaggatcccttgagcctaggagtttgagaccagccctggcaacatagaccagcagctctacaaaaaataaagaaaattacctgggcatggtgggtggcacatgcacttgtagtcccaactagggaggctgagttgggaggactgtgtgatcctgggaggtcaaggctgcagtgatccatgatcacatgagactctctctcaaaaattaaaaaataaaaagaaattaaaaatttgaatttcccgttaatataaaacttaaagttttattgagtttccattattaatacttggttgatcaaccagaatatattacagattgaaaaaacctagtaaataacattttatcaaaaaggcatctcttaatgaaatggatgggaattttacaaaataattatgtattcatggataaatataatctattgcttagaatgagataatacttaacatcatttctacttttcattttaagagctataagtgctgagaaactttgttgcataaataagtcaatgggaatggtagatagtgtatgtgctgtcctatttatattaagactactaattggttgaatgaaaactattaaaaacacatggtttccctacttactggttgaatgaaatgagtgaaaacaaaaacagttggaaaccacacacagatattctgtatctagaaacaaactgaaatgcaaagtgggagggaacatttgcttatttgcctaacactgttgcagacatttgcagacattatcactgtgtcttaaaagtcttaaccattattttatagatgaatataataagtgacaaaatgggatttgaatccagatctctcttaccttaaaaatcttctgttcttttcacacggttttgctatgactatgtacaattttatggtgggcccaactttttttttgagacagtgtctcagtacgtcgcccaggttggagtgcagtggcgcgatttcagctcgctgcaacttccttctcctggtttgaagcgattctcctgttttagcccagctaatttttgtatttttagaagagatgggatttcaccatgttggccaggatggtgtcaaacttctgacctcagatgatcagcccaccttggcctcccaaagtgctgggattaaaggtgtgagtcactgcgcatggctaaaggaaaggtgcaagttttttttttttttttgagacagagtcttgctctgtcgcccaggctggagtgcagtggcgcaatctcggctcactgcaagctccgcctcccgggttcatgccattctcctgcctcagcctcccaagtagctgggactacaggcgcccgccaccacgcccggctaattttttttttttttttttttttttttttagtagagatggggtttcaccatgttaaccaggatggtctcaatctcctgacctcatgatccgcctgccttggcctcccaaagtgttgggattacaggcgtgagccaccgcgcctggccacaacttttaaactattacattttaggcactttttcttaaatttaaaaaagcgaaaaattggaatttctcttctgctactttggatttctgtgttagattcagggaactgcaagtagtatagagagaggatacttctggagctatgacagttgttttgtgctgttacataatctcacgtctatacaaaaagtcattcagttctataggtaacaaggattaatgtcattgttttgttgtttctttcccttgtcatcttccttcctgatgttctctttatttgtattgtaacatatttgattcctttcataatttggaactagaaggttatattgagcctagtttatgtttagcagcagttttcaaagggtcttagagataagatgaactaaagctttaagtgtagggccttagtttatatcctaggttttctcttcctattaagaattccattcttttggccaggcacggtggctcacgccggtaatcccagcactttgggaggccagggcgggcggatcacttgagaccaggagttcaagaccaacctgggcaacatggtgaaaccccgtctcttctaaaaatacaaaaattagccaggtgttgtggcgcctgcctgtaattccagctgctcaagaggctgaggcataagaattgcttgaacctgggaggcggaggttgcagtgagctgagatcactttttaaaaaaattatttatttattttggagacagagtctcactctgtcacccaggctggagtgcagcagtgccatcttggctcactgcaacctctacttcccaggttcaagtgattcttgtgattcagcctcccaagtagctggaatttcaggcacgtaccaccatgcctgactaatttctttgtatttttagtagagaaggggttttaccatgttggccaggctggtctcgaactcctaacctctaagtgatctacctgcctcagcctcccacagtgctgggattacaggcatgagccaccgttcccggccagtatatgctttttttttttcccccaaaaaaaaaacaacagtaacaataacaacctggtttgaacactgtattgcatgctttttggtcatttaaaaaattcagataacattaaaaggtgatgtatggtttttttacttcatcagtgaaagaggctggattttaaaagccatggaacagtatagggctattgctgctattacagtgttcaagaatctgtaaactttagttatgcagagctacataagaattcaagagtcttgaagtactaatgtctccatttctagtaatactccttgtctttgatctattttgtctcataataatatagccactccagctttttttcttttttctttttttgagacattctcactctgtcacccaggctggagtgcagtggagctatatcagcttactgaaatgtctgcctcccgtactcaagtgatccccccacctcaggctcccaagtagcagggatcacaggtgtgcaccaccacccccagctaatatttttgtatcttttatagagatggggtttcaccatgttgcccaggctggtctcatctcaaactcctgagctccagcaatccacctacctcagcctcccaaagtgctgggattattggcgtgagccaccacacccggcctccagctttcttatgcttactattttgtgttatatctttttaaaaaactattttcaacctaatggttgaaattttgtctttaaaaatgtatctctggtagtcagactatatttctgatagtctgataatctttgccttttaaatgaaatattttagtccatttatatttaatgtaattattgatctagttgcatttaggtctgtgattctgctatttattttctgtttgacttatggttttttcctctgttactcctttccagactttattttgggttagctgaatattttttagtactcaattttagtttctccattatctttctagctataccttctagtgtgtttcagagattactcctaggattgtaatttttttttttttttttttttgggaaatagaagtgaacatttgtcaccagtgtctgtaccagagtggaacactccctttgtatggaagtgattatcaatcatgatagagtgatagcaaaacatttgaagcagaatatgattttgttaccttctaggagtaggcttcttaagtatggttgtataacagtctgcatttaaattagtggggttattcatttaaaaataaatgctcctgagccttactccagactaacataatcagtatctgagtgtgggatctaggtatctgcattttaggtaagtgccacaagcttgtcttgaacataattatgtttgacagtcacagctgtaggagttttttcccactgccctttgctttttatgggccagaatcaattttattgtttatctttaagattaacaagtatgagactgatgaaacagtttggtcatagtcatagaattctacagcctttataaaggtgcttcaaggttatgctagcttaacagtcttataaaggagaaaactgaggccagatgagagtggctgagtggcttttacagctctgatttataattaataaggtattttgctatgaattgtagacagaataagctgcagtgtataattatgttcatggttaggtgttgtttgtaatccaatttgacagtctctgcctttagttgggctatttagaccatttgcagttaatgtagttactgatatggttgtgtttaaatctctttatcttgttgtttctcatttgttgtcccatctcttccttgttccctttattctctttttctgccttcttttagattacttaggtggtgtactggcttagtagttatatgtctttggtgtatgtgtgtttctttttaaataatgattgctttagagtttataattaatatgcatttttacctttccacagtctaacttcaagtaatatgtatctcttcacacacagcgtaagagctttataacagtatactttacccttttcctgcctttgtgctattatagtcatacattatacttctacatatgttgtgaaccccacaatatatatttatccatttatttcttagtacgtatttttatttaagcagttatcttaaagatttgaaaaataagaaattttttatttatcccatattaaccttttttttttctttctttctttttctggagacagggtcttgctttgtcttccagactggggtgcagtggtgccatctcaggtcactgcagctttgacctcccaggttcaagcagtcttcctgcctcagccccttaagtagctgggactgcaggtgcacgccaccatgcccagctaatttttgtatttttttttagaggcaaggttttactatattgcccaggctgatcttgaactcctgagctcaagtgatccatccgcctcggcctctcaaagtgataagattacaggcgtgagccactgtgcctggccccatgttaattgtttctgatgtcctttattcttttgtatagatccagattctcatctggtgtaattttccttttgctggaatggtttgctttattatttcctatagtgcatgtctgctgttgatgatgtcagtttttgtgtggctgaaaaaaatctttatttcagcttcatatttgaaagatgtcttgtttcttaggtatggagttgtaggtatttttctttatgtacttgaaagatgttaatgtcttctggcttgtattttagatggaaaagtctcctatcattcttttgtttttctctatgtaacatgagtttttctccggctgcctgaaagtttttatcactagctttaagcaatttgattatattgtgccttggtatacttttcttcatgtttcttgctcatgggtttcattgaaccccttgaatctgtctgtagattgatagtttttaccaaatttgggaaaattttgtccattatttcttcaaatatattttatatctcccattcttctttggggactccatttgcacatatatttggatgcttggagttttcctacaattgattgatgcttaattctcttcctcccccatattttttctgtttcatttaggatatttttcttaccctttttcttcaaggtaacacattttttcctctataatgtttaatctgctcttgatcccatcccgtgtatttttcatatctttttttcatctctaaaagatcaatttaggtctttcgtatcatcttccatctctgttcttaacatgctctttttttctgccttcttaaatgtatggaatatagttaaaataactttcaatgttcttatctgctaattctatattttttgtcctgggtctgtttctgttgtagaattttttgcctcatggtttgtattttcctgccttttgtgtgcctagtaattttttattggatgctagacattgtagagtttaccttgttgagtgctagctatttttatattcatttacatactcgagttttgttctgtgacacagtttcttggagatagtttgtttcttttgaagcctgttaagctttgttaggcaaaaccaggagaattatttgccacttcttaggcgttttgcctcatttattttagaatttttaaaatttttgttgttggagacataaactagtccttgtcctttgtgataatcgaggattcgttcacttgatcgtttcaggtaattatttttcccagaataccgactagtttcctcacacacataaactgtttcaatactcacctaaagactcaaagggactttctgcagctttctaaagttctttctctgtgaaggtccctcctctctgatactctccctctgccaattctagctgccttggcctccctgaattctcaactctgtctcctcaactccaggagtctgctgggattatatttggaccctcctagtgctctggaaattatttccaggaagttagctggaggaatatagggctcatttcatttgtcctctctttctcagagatcactgtccagtactgtcttttgtccagtgtctgaaaccatggcttcgtatgttttatcttttttttaagagatgggggtctcactgtgtttctcaggggctagagtgcagtggctattcacaaatgcagttatagaagagtacaccctcgacctcccgtgctcaaacagtcctcctgcttcagcctcctaagtagctgggactacagacactatcagcatgcctggctctgtcattttatttatttatttaccatttaaggtgtgagggttaagttggttcctgttaatccatcctttgtcaaaagtggaagatcatgtttaagtgttctttaagtacagaagttatttttattttaacaaaaggaactgttgtgttctctttttgataatgttctgttgggagtaaaaatgttatctgtttaaagtagtcagttctgtaagatgggcccatggtatatacacatttactttaaaaacaagcattttaaaatgccctaacagcaataacagttcatcaggaaatgatgaatcttttctgtctctcatatagcaacatttgggaggagtttcttaggtggttttctttttctctcttaagagctaaaggagcaacgacaaaatctcattgtgagtgatgaacagatttatttgtttcaaaaatacttaaatgcttactttgtgcctggaaatatcctggagatgaagcagtgtatgggataaaaatttctgtcctcatggagccaataacttactctagagagacagactataagtaaaacaactaatatgtaccagatgttgacaggcactattgagaaagtaaatcaagtaatgcaggggatagaataggaagtgccaggaaataataataaaaatttcttggaaagctcttagggctttgggaaaggccctgatttacctctggatcgcatcctttccaaccccatggtgtttccatcagtaatattttcttattgctaaaacttcaatttatatttatttgttgactgtttactttcattatataaccatgtgcaactctgtcttcttttaaacattaggaacagaacaaaataaataatctttattttgcttgaatgccctggctagtaatctaatccagtttactatatcacagccacagttctggaaagtatattttgtattcattgtcttcactttattatattttcctttacctcttcagtcaggtttggcttctcggctttcatgcaatggaaaattgcccttgtcacacagcatggcacaaaagtaccaaattcagtgggcacctttcagttcttccttgactcctttggtagtagatgctgtttaatcatactttcactcattgcttggttcctttgaaataattaccttttggttagtttttagccattctttcttggtcttctcttccttctcctgcagcttgaatgggtgtctggccttttagtttgtattaatacatacttttattacaatgatcattttaaagtagattgttttctgtagaatattagctctttgaagtcagaaacattagtattttcattgttgtttctccagcatctaccctagtacttggcacaaatgtatttaataaatatttgtttaatgaatgtaaatatattaatgtttttagctttcttctattaagtgaagttagataccagtttcattagctttatcttccacattgcaggactaactatattggtgcttgactttttgtgtgcctattcacaagttgttagtgtcttgattgaacatgttctcaagactggtcactttcctgcatactgagtttctgtagcctctgacctttgtgcttttagagccaagtagaactttgtgcttatagagccaagtagaacatatctgtaggaaaaggagaggaggtatcttttagttatttgtggcttctggattgattctgagagtctcttgtgattttttttttgtaccattccagaaacagatttgtactgcttcagacaggcaaggggtacattttagtttcaaagtgttataaggagtatttctgatgtctctgatagttggtgtggatgactacagctcagagtctgatgtgattattataccttcagccctggactttgtctcacaagatgaaatgttgacgcccctggggagattggacaagtatgctgcaagtgagaacatatttaacaggtatgtgcatattctttttgttaaagtggaagtggaagggtggttttattaacttcagtagggaaaatgaaagtatccactttaaaggaggtattattaacaggcacaatctgagtcaccaagttttattcataatcatagcatgagcagttttgtacttgtttattctttgatcctagtaagcatacaacatgctttctttgcaaaaaaaaaaattaccattaattaccattgcttttctgccactggacataattttggtattcatataaattgcttattgggaagtacattattccttcaacacatgatgttgtatacctgctgtatgacgggtgatgctcaagatcattgggtcacacagcagtgaccaagagccagcactcttcctactgcattgtgtttgtccagccatgatcccagaccacctatatcacacttttctgggaaatcaaaaagtcttggttcagattttttgggtatagctatgcaaaactcatactactaaaaatatgtaagggtaacattttgtataatgaatgagtgtgttttttcattgtgataattgaaggacaactgaaatgaatttttggtgactttttaccaaatcagttagataaagattaaaaaaaaatgttgtaaatattcagtctcatcttgttaaaataaaatcaatactgccgtttgccacttaggaaattatagacctaatatatgttttaataatgtaataagaaaaaattttcttaaaaaatatacagattttgtcttttaaaattctagatatcggccaggtgcagtgactcatgcctgtaatcccagcactttgggaggccaaggcaggtggattgcttgagcccgggagtttgagaccagcctgggcaacatggtgaaacagcatctctactaaagatatttaaaaattagccaggtgtggtggtgcatgcctgtagtctcagctactcaggaggctgaggtgggaggattacctgagccagggaagtcaatgctgcagttagccgtgatcacaccattacactccggcctgggcaacaggaatgaggccctgtctcaaaaaattaaaattctggatattagctattgatgccattgaacatacataattttgttttttttgtgtagacaaatggtggcccggagtttgctcgataccttgagggaagtctgcgatgatgaaagagattgtattgctgttttggaaagaattagcagattggccgatgattcaggtatatgtggagaaagtgaatttactctattctagaaaggcttctttgatcaaatttgtgtttctaaaaactaatgaacaagttaatgtgatatgagatagctttaaaatatttcctaagtaattatcaaacccatcagtgacaacaaaagtaaaatttgttactgagacctggacattttacagtgggctcatttagtttaattttagaaatttctcatcaaaacaaatctaaaaacattgttttgcatcatgtatagtaatattttaggattaataaaaatatatagaataattttgaatacattaaaagagatggaggaggctgtaaattattttaggcaactatagaaagcttgctttctgtgtggtttctcacttgcaaaaaaatgttgattaaccatttgtaaaactaaagctggtttatctccaaagtgaagataagaaagtctgcttaagaaagaggtaaacttgatttaaggcttagaaaatggtgatgttaaagtttttataaatatatcttttgttgtagtaaaatatacttaaaacttaacacataaaactattttaaggtaatattaaacatatttttatacttgattttagaaaccatccaaaaatcttaaaactttttcccttaaatctattatctttattaaagtatattttctacctctgacagactttttggcatctcagcaagccctattttttaatttttagacaagctcatcttttgatgaacagttcattttaatgggaatgtgttaaatgtttacataagccttaaatgtttctaatattcttacagggtgggcagaacatttgtaggcttaactgagcaataatctacctttgtgtacataattgcttatgtatgtgcttgttctagaatggttttaggaggggtctcatcaagcataatttttacttatttttttaatttgatttaagttaaataacaatttaacataaattcatggcactgttatagcctattatggttatgttctttagtagagacagatactctttaaggatagatttgtgttttcctttacctgtttaccagctccagagttttttttttttttgtaagtgtgtgtgtgtgtattttaaaatatgttctcacattggtaaattcatagtaaatgtctctattgacataattccattcattcagtatacatcaaacagtacatactctataccaggttctagattaaatgctagagcagttattaaggtgaacaaggatttgtgtcatcaagttaacagtttagtgaatgcagccaacatataaacaataaattataatgggaaggatcggggcaggcttcagaaagttagtgacatttaagttggatttgatagatgaggtatagagagggaaaagggcatacccaggaggggaaaagatagagaaaggagttcaagatggtggcccctttggtcaacaatgaggccaacctgacaatgagactaacctgctgagtttccaggttagaaaaattaggctgttaagtaagttaggtgagggctagattgtaaaggtttataataaaccatgctgatgactttacctttttgtgatttagaacagtgtagtgtagcagtatgaactgatatggtgaaaaagatgggtgacaagaagacttgattggaagactataccaattaattgggtgtttttgtttttgagacagagtctcgctctgttgcccaagctagagcagagtggcgtgatatccactcactgcaaccacccctgcctcccaggttcaagcaattctcctgcctcagcctctcgaataactgggattacaggcatgtgccactacacccagttaatttttgtatttttagtagagaaggggtttcaccatgttggccaggctggtctggaacttctggcctcaagtgatccacctgcctcaagctcccaaagtgctgagattacaggcatgagccaccgtgaccagccagttaattgttataaggatgaattgttggatagaaattgaagtactaggagggattccaaggctaacctctggatagagtgaggaagagagaggatttgaccctgaggtttctaatttttaggactgggcttattgtgatagctgggtaagataaagactattgaataataacatagctctgaagtgaatgaaatatgtatccttagtttagacaaataagcagctgagaacctttcggtcttctgccttacctttcattagcttttatcttgatttttttattccccaaaatttaccatctgcttttattttcccccggaatggatggatgtatagtggtatctcattgtggttgtaatttgcatttcctcagtaaccagtgaagttcatacctggttatacacttactggctatttgggtatctttttttttttttggagatggagtctcactctgtcacccaggctggagtgtggtggcatgaccttggctcactacaaccttcttctcctgggttcaagtgattcttctgcctcagcctctcgagtggtgggattacaggcatgcaccaccatgcctgcctaatttttgtatttttagtagagatgggatttctccgtgttggccaggctggtcttgaacttctgacctcaagtgatccacctgactcagcctcccaaagtgctggtattacagacatgagccaccatgcctggcttcttcttttttgaaatgtctaagtctcttccccctttaaaaaattggtagtcattttcttacagatttacaggaattcattctgcatatgagccgtatgtcatttatgtgtattaaagatatctttttcactctgtggcttctctttgcactccgtgatgcttcttgcagaagagaagtgtttttcctttatgggtcatgccgtttgtgtcttctttgagattttttccaatctcaaagtcataaatatcttttcctgtattctctaacacagagaagccttattgttttttgccttgacattcagatctgtattccacctggaatttattcatgtgcgtgatacaaagtggaggacaagtttcatttttttttttaatgtgagtagccagttgacacaactgggaagaccatctttcccagttcaccttttaataaatcggttgtctgtacatgcatgcgtctgtttctgggctttattcccctgccccgccccattagtctatttgcctaagcggggctttgaagaaagaaaagttgctgatttcatttttaactgaaaccataacttgtgtcctccttttgcttcaaaaatataagcaattgtcagtgttaacttagaaaattcagcatccatgagaaaagcagaggcctgtatgtttacttttttaaaaattaggtttttcttcaaaacagaaacactctattttgttcatatctggccaacttcacatggtacaacagtataatagaaattccagatattggtttgttgataagattctgagctttgtaaaatacagtattatctacttaaaggtatgttaatttctctgttgatatctgaaatcctagtagacacattcatacatatttactttaatgtagctttattaatgcataataataatgggtatcagagttctagttaggtccgatacaatgacttgttactgataatccatcatgtctgtctgtatttcagtcacttgcatgtcttctatgaattgcctacttgtatccttattttctttcttattatttatttgaacagtgtgttcacttcctaatactctgttatacatgaatttgctcccaggctgttttcccttttaactgagtattggtatctgttatctataataaagtttttttgtttgtttgtttttgagacagagtcttgctctgttgcccagggtggagtgcagtggcgcgatcttggctcactgcaacctccacctcccgtgttcaagtgattctactgtctcagcctctggagtagctgggattacaggcatgcaccaccacacctggctcatttttgtatttttagtagagacagggttcaccatgttggccaggctggtctggaactcctgacctcaagtgatctgcccgccttggcctctcaaagtgctgggattacaggcacacccagcctataataaagtttttataatgtataattagttggtcttacggttgatttttggattttgtcttcccacctcaagattgaacatttaatattatcttttagtacttttgatctttatgatgtgcagtaggaacttttgttccgtgctaactagctgattttcctactgttgcttcttagacatttcatctttttgaagcccagaaatttgaaatgccatatttctcacatttaaatttgccatatgcacttgggtcttttcaggtgtttaaaaaatatttgtcatctttaattttcatttacccatttttagtcttagttaagtctaattatatatctttcatttattgactaagttgagattaggaactagtttttatgacttgtcctagtaggttcttaaatagtggaatttatggataatactatgtatgtgtcagagtattgatgtaaatatcagataggatatttaacccctagcacagtgtggcacagtgtaggtgatgaataaatttatttattgttaagaaatggttagatactcagtgcatactgtgaacaacagaagcttggattgaagataaggtcctcctttcactcatgggattgatctgtgtatgattctgaaaaggaatgcagaattaaaggatgttgtctcaagtcctttatattttgaagatgaaagtccatagccttcctaagtaccctcaagaacagataaaggttttgttgctgcaggagaacatgtttgctcacattgccgttatttcaatagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtaagagtaccatttatatgttcttaaaagaaatttacgtagtgtaatatatggagaatagccgagcctaagtgttctctttggaatgttttactgtttttcaaaaatgaatatttatcttagacaagatgtgtttagagtctgacaaatctagtagatccctttaatgccattatggacaatgcctagtaactgcactctcacttggtaacctcctagcggtcccttaaaaggtttgttactttgtgaggcatcttttaccaggatggctctgtccacttcctctgttacagcacaatctacgaagttctgtagtctttgtaatagttgaagaaaataaacacaaatatttatttgcggagttttgccagttatgggtccctttgagatgagaaatctttgtttataaaaatcaagtgatagaattttgtcatgttgcatatgtactttctttgtgttgttatttttctcctaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctgtaagtcaaatgccatttttccacttatgcaaaatgtggctgataagaggtgcttattaaaagtcaggccggggttaggcacggtggctcatgcctgtaattccagcactttgggaggccgaggtgggtggatcacttgaggtcaggagttggagaccagcctgggcaatatggtgacacctggctctgccaaaaaaatacaaaaattagccaggcatggtggtgtgcgcctgtagtccctgttacttgggaggctgaggcaggagaatcacttgaacctgggaggaggtggaggttgtagtgagccaagatcaggccactgcacttcagcctgggcgacagagcaagactccgcctcaaggaaaaaaaaaaaaattaggctgggctgggtgcagtggctcatgcctgtaatcccagcactttgggaggccaaggtgggaggatcacttgagaccaggggtttgagatcagcctggccaacatggcaaaaccccatctctactaaaaatacaaaaaaaattagccaggtgtggtggcacatgcttgtaatcccagctactctggaggctgaggcacgagaatcatttgaacctgggagacagaggttacagtgagccgaggtcattccactgcattccagccaggttgacagaacaagactctgtcttaaaaaaacaaaacaaaaaaaaaaaaagaaagaaagaaagaaagaaaaggctgctttctgttaaagttgccacaaatcattaaatttgaaatacaatcagggctagaaagggacataaaggcttacaaaggaaagtgtaccttctgcacacaatacgaaaaaatacataattgtaaattattatgtcaaagtggaaaactgaaatggttattttatcagtgcagttaaaattttaaaaaccctggactgaacgaagaaacacttgaaccccttcagtaggtattgaacacttttctaggcactgtgtaagcacagtggaaataaaataatactttgctcctgctctgacaggtatggtctttgtgggaaggatggtcaggcaagtacatttcccaggatatatgacatcagtgatggttatcagaagaatatacagattgttaagtcattacgcatatcataaagtcaaatgtaataggaagtttctgggtttttttttgacatggtttgcaaatattctgattacttgaaggccatgatagggcatgaattagtatagagtagtatctgttgtgattcacatctggttcctgagttcggatagtagtaattctcatggtaaattagaaaagtgataaattcgtctggaaatttattcatatctatttggatagtaagagttcactccttaagcctaaaataatatggttgcgtctttgttgatattttttaataatcacactatatttagtgcttctggatcatcagtaatgggatgaattagatgatctctctagtctctttcccttgaagaatttcttgaatctattatttttagatactcagttaccagttaataataaatttactttttcagtaatgtttttactgaagtgaaccttacatgacataaaatcattttagtgttagtggcatttaatatgttcacaaagttgtataaccaccacttcttcctagttccaaaacatcattatttcttttttcactttaggatttttgcaatgaaggaaatcagttttgggcttggcctaatttttggtttatattgagccgtttaacttgctgtattataattctcgatgcaatgtaaaattagtaaaacattacaataaaaaatttaaaaactatatccagtgctagtaggagtcttatgattctcttacagttgtgtttgttttttggtcatgttttatattccatggctcccatattttctctatcttaatagatagagaaataataattatttcttaataaaaattaatttcttaataaaaataattcatttttaaataaatttagttatgctacatcagtgatatacagcataactttggattgttaactagagcatggagatgcttattcaaaaaacaaaactggttttgggatttaggagatgtaggcgttatctctagttctgatgatggtgggattttcatggggatagtgttgaatctgtagatcaatttggagacaattgccagtttcacagtctatgaacatggtagatctatttatttaggtctttgatttatatctttaatcttttgtagttttcagcagaaagttcttgtgtgtattttgttcgatttcatattttttaaaagtacttctgtgagtgatactgttcttaaatgtttccagttcattgttcattgctaatttgtagaaatacaatagatttttatattctaatttatagcctacaaccttcctaaacatacttattctggtggcttctttgtagattccttctgattttctgtgtagacaaccatgtcgtatttgaatagagagaattttctttctttgcaatctgtatctcttttacttctttattttgtcctgtttgtacagtctagcaattgatacaattgataaatgacaacaggctatcccatttctttctgtattaactgtgggaacaatgtatctaaatagagggccagttttcaaataaagttaatcctcactttgcctcctattgtgttaactgaaacatgcctatatcagaactgtgttcatgctttccctggaactgaagctttgcaaaaccaggacatggttctgatatgtatgagctttagttcacagggtgctttgcaaggcgaggactgaattttttcttagcaatacagatatgctaaatctagatctttcctggggatagttttccctttgaacagtcaccaattttttaaattgggaaaatgtaggtttttgtttgtttgtttgttttgcttttaaaattaccaggcaaaatgatgaagtagtagtaagatggaaactgtggacaaaaatgaaattgttaggattttctgtgggtttactgggcatgcagtatttattggttgtttttattgattgtggttaatatctgtctttgtttcctacttagataaataagatgaaattaataattggctatgaatgttttctgtcatgtatatagtataatgatgccatatcatattttatgtttcctcaaattatatacttttattatttaatttaactgaaagaggcttacttgatattttcagtgtgtgtttgttcttacttattttagataatgtgcaaaatggctcccatggttgggaaggatattacagagcgtcttatcctccctaggttttgtgagatgtgctgcgattgcagaatgtttcacgttcgaaaggtatttttttgtcgttttttttctgctgtttaagaacatagttctagtggttaatgtactgatacatgatatttaaaagattatcttagaagaaccttatgtgtaatattttgaaatgtcaatgatgcttttgttgtcaggtctgtgctgccaattttggagatatttgcagtgtagttggccagcaagctactgaagaaatgttggtaagtattgcagatataaaggagtaaacagtgtgtgttacaaagtagtacataaagtttgaaatgcacacatttactccaaagttttattaacacaattccatgaatataaaccagaaagataattttgaatttaggagtttaaatatctgtaatctgggcatttgaattatctttttgatatttattaaaaatatggatatgtttcagaaccattgatctgttttcacctcttccatttctgttaagcaaatcaattcttacttattcaattgaacctttaattttattgcaaccctcaagaatgttgatgacatattaaatctatagcaagttagttttaaatagtacacaagatgcctatacttgatgtataagtcaccatatctaaagagtttctgaagccatctcttatgcaaaataattaagttcaggggcaagctcttgtaaaacatttaagctatgattgttgggagtgcttttgcatagccagaaatattgcataagacaatccagtatgcttttgcatagccagaaatccgacggaccaaattatcagcactttttattaatttatcagtgatctttcatgttgggtagggttttgattatcacttttgtaaaataatacatttctgtccgttttaaagcaaacataattttgactcataagaaataacttaaaatttaagatatattattatatgttatatatttataatttaagatacattattttttatacttttaggaatagacagtaaattagatgtgatttattgaaaattgttgagtataaatactaatagatcctactttttaagacaatccaacatttaaaacactgaggctgggcgtggtggctcacacctgtaatcctagcactttgggaggccaaggcaggtggatcacctgaggtcaggagttcgagaccagcctggccaacatggtgaaccctcatttctactaaaaatacaaaaattagctgggcgtggtggcacacgtctgtaatcccagctacttgggaggctgaggcaggagaattgctggaacccaggaggtggagtttgcagtgagccaagattgcaccacctcactccagcctgggcaaaagagtgagactctgtctcaaaacaaacaaacaaacaaaagaagcgtgaaagcagaaaatgaaagcgaagtaactgatgaaatctgctatctttatccaactaacaagactctttccttttcacatagctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggtagggttttgattatcacttttgtaaaataatacatttgtgtccgttttaaagcaaacataattttgacctcataagaaataacttataatttaagatatattattttttatacttttaggaatagacagtagaaagactactatattaacagtttgtgtgtttttttgtaacaggacaaaaatttctttacacatttaagtcctgttgatttttatttaattggcatgatgtattatgttaatttttagatgttaaaccacttgcatctttggaataagtcccacttggtcatagttgtataattctttttatatgtcgctggattcagtttgtcagtattttgttgagggtttttgtgtccatatcatgagagataatagtctgtagttttcttatggtgcctttgtctggtttgttgtcagagtaataatggcctcataaaatgagttaggaaatgttccctcctctactgtttttggggagagtttttgaagaattgttattgattatctcttaaatgtttggttgagttcagtggtgaagccgtctgggcctgggcttttctttgtagatagttgtaaaattcctaattctgtctcttcacttgttataggtctgttgtgtgtttttttcttgagtcagttttcatagtttgtatctttctaggaatttgtacatttcatctaagttacttaatttgttggtatatgattatacataggattcctttataatcttttaatttctgtaatgtcagtagtaatgcctcttctttcatttcctatttgagtaatttgagtcttgtctctgtttcttggccagtctgctaaaggtttgtcagcttcgttgatctttttacagaaccaacttttggtttcattggttttctctatttttctattattcattaatttccattttaatctttattctcccttctgcttgcttttagtttattttgcttctttttccagtgtctttaggcagaaggttaggttgtggattagaggtcttccttccttctttgaattatcatctggggtaaatggctttcaacccgaaaaactttatttagtatttcttgttaatgtggttctgcgaacaacaaattctgttttcatttatctgtgaatgtccttatttcaccttcaattttgaaagacagctttacttaatgtgagattgagtgtgttatgccactgcctcagacctcttctgtttctactgtgaagtcagcggttaatcatattggggttcccttgtaagtgatgtgtcatttttcgcttgttgctttctagatttttctccttgcctttgactttcagaatttttactgtgatgtgtccgtatgtgcacctcttttagtttatactacttggagttgagttgattgaacttcctagttatgtaagttacgtttttcaatacgtttgaaaagttttgagccaatgtttcttcaaatatttttccttctctcttctctccctctaatattcccattatgtatatgttaaatgtgcttaatgatggcccacatttctttgaggcccttttcatttttcctcaattttttccccctctctattctttggcttgcataatctctattgatctatcttcaatagaacaattatttgttctgccagttcagatctactgttgagctcatgtactgactttattttagtcattgcacttttcagctgtagaattccatctggttcttttttgtaatttctctttattgatgttatactctagttgatgcagcaccgtccccataactcccattacttctgtaatcatcatttcctttggttctgtgaacatgtttataatagctactttgaagtctttttttaagtctgaaatctgattgctctcacaatcagtttctgttgcctgtctcttttatccccctaatgtatggatttttttttttttgcctgccttgtaatgttttgttgagagttgaacattttagataatatgtgtagtttgatactggttgtcctcgctcccccatgggggcttgttactgttatttgcttgtttagtgactggctggaatgcttgagtgaagactatttccccactccaggaggtacagctttgggtctgcccacagccaccctggtatgacaggggcttagtgggtatggaagggcagcagcctgaggttcccttggcttctttctcctggtgaggaatcaccaccctgtgaggtagaccagtgccttttggggccccagccttttcagtgtgccacacccaaaggagggtggaagaaaggagcctcacccctcagctgctctcactcaggactggacctcagcatcaggtagctggagcgatgcagcctgtgcccgggagctgcgggagagcagaccccagtgtgcttggctacagcacactgctgtctccacctcacctcactggaggcgttacaaggagggaatggtcagctgggcgcggtggctcgcacctgtaatcccagcactttgggaggccgagacgggtggatcacgaggtcaggagatcaagaccatcctggctaacacggtgaaaccccgtctctactaacaaatacaaaaaattagccgggtgtggtggcgggcgcctgtagtcccagctactcaggaggctgaggcaggagaatggcgtgaacctgggaggcggagcttgcagtgagccgagatcgcgccattgcactccagcctgggcaatagagcgagactctgtctcaaaaaaaaaaaaaaaattagactctcagcttttttatgatgtatactacattttgtcagttttctttaattgttatcccttcaattgctgcttgctcctagggccatttccaggggctttgaattattgttttataattttcacttacttcactgagaagtgggtcagctgagctcctcacaccgtcatggcagagatcaatctcaggacctttgcatattcattcccaaaacaaaattgacatagagggcaagactcttaagccttgatattatattaatgtttttgttatatcctgtatcggcttgttagaaaagattaacatagcttactcaattttctttgtgaagctatgtatttggtcgttgttttggattggtaacatgcattagttcctgttaatttgagaatatggatatgtcagtcattttagagatatacagctgttccttggtatccatggaggattggttccaggaccccttgtggataccaaaatctgaggatactcagaagtctctgatacaaaatggcatagtatttgcatataacctatgcacatcctcctgtacactgtaaatcgtctctagattacttacatctaatacagcataaatgctatgtaagtaattgttactctattatttagggaataatgacaaggaaaaaagtctgtacttgttcaatacagacacaaccatcatgggtctaacaatgttttcaatgtgtagttggttgaatccacagaacctgtggatacagagggcaggctatatatgctgcacctgtctgagaaaaatgtgtatcttatgcctattttacacacacacacacacacacacacacacacgtgtaaatcctatgcctatttaggtgcaaaaaaaagacaagatagtcttttgtccgaacaatgttaagccatttggggaaggttataatctactgtattgtcccttctcaaaagttaaaattgaattaaaagttaattttatttctgaaattcgttaatatttattctttgagtgacttgtgggttttttagtggtttccagaacctttgtttaaagtcattagttgtttatttcttaaagtcattgaaactagtaaaaataatagcttaaaatcactttattttgaggaatagctcaaagtagaaatatttttatagtgttggaaaattactcaattacaggcagtgggatgtgttggagagttaaaattggacttcagtcctgatttcattgtaactatagggtaacactgaagaagtcattttatttggatttcagtttctgtttttgtgaaatcaaggaggtagattaatagtaggatttaattaacttattagacactgtgatctctctcctccacattaaacttttttcattctaatctaacaacaagctaaactaatgatttagataaattaagttttctatgtcctttattgggaacaagctcagagatttaacagtattcagagaagattaaattcgtgcatacagcgttaaaagtgaccttttatccttttatggaagtaatgtttccataatgtttcgtaagtaagtgacttacgaaggggagaaaaacccttagtttacacacatacaagctattcttttccctctcatgcatataattctagcctttttaaaaaatcaattgagtcattttttatgtatgcttctccaagagtaggtaaatactaataatagatatctctacatttatttgcttttgtaaaaatcatgcttactatataattattatcttaaacttgaaaaaggtattattatgctttttttttttttttaaagaaaagaaatgctagccaggagcagtgactcacacctataatcctaacactttgggaggaggaggtgggaggattgcttgaggctaggagttcaagaccagtctgggcaacatagcaaggacttgtctctgcaaaaaaaatagaaaaattaactggatgtggtggcacatgcctatagtccccaactattcatgaggctgaggttggaagatcacttaagccaaggattttgaggctgcagtgagccatggtagcaccactgttttccagcctccacagcagagcaagagctgtctcaaaaggaaaaggaatgctaaacttcagggaaattggtgtgtggcaaagtcaaggttttagtaacataccagtttcccattgttgttgcctttgtccgattgtgtccatccttccataaaacctctcattttcaaatgttttaaaaattcctgattttaaaaataatacagaaatacgacatgaagtggaattctataacttctttatcacccctcctacatgagacagtcatcaagaacaatagtatatgcttcaagatctttgtgacatactttaagttaacattatgtttctggtacgtctgtcttgcttccttctagtgaacaaattaaagtctttcctacctgaaaacattaaatgtatttatcacattttgttggctttattgatttttatgttctttgtggcactcttggttttccttattctttttgttcttgagaacacagcaggaccttctttagttttgttctatgcaaatgtttcatagtatctcatacttagattatcatggttcaaacattcaagagaggataaaaacaattgaaagtaaaaaagagcaaataggggtttgtttggggttttttttttagacagtcttgctctgtcacccaggctggagtacagtggtgtgatcacggctcactacagacttagcctcatgggttcacgcgcttcttccacctcaggccctgccgagtagctgggaccacaggcatgcgccaccacgccctgctaactttggtattttttgtagagactggatttcgccatgttgcccaggctggtctcaaactgctggactcaagcgatctgcccagctcagcctcccagagtgctgggattacaggcatgagccactgcgcccagccagagaaaatagcttgtaagaatttttcagtcctagctaaagttctgaatctgggcttcctttagaaaagcttcattattatcctaaacatacttcggcatttgaaagtagattattaaatatacataatgtgtgcgtatataattctttttcaaaatgattcctttattattgtcctttttatcttcctaggttcgccaagcagcttttcagtctctgggacctttcatatctacttttgctaatccatctagctcaggccagtattttaaagaagaaagcaaaagttcagaagagatgtcagtagaaaacaaaaataggtataattttgaaaccattttctaattttaaaaccttgttttctaattttactgcttttaaacattatttccactattctgcaacaaatgttattttttgatagtttgctatttctcttgaatataaaaattggtgaatatttttatagagctttactttaagcgcatttgtttgttaagtatctctttggttggttacatattgaatgagtagatgcatgtaacacaattagctagatgcctcgcacataggaaactctaaatggtagattatgacttttaaaaaatgtttatttagtacattatttatctagtcaatcattcattgatatctacaatatacagggtaattgttacacactgtgtagtatttgggtttttttaaatttgtttttaaggagtaaaacttaatttaggaatatgttttattgtccttttctgtcaaataatttagttgcgcatcttggattctttgtcaatggtgattgtaatctgtcagttaaaggagaaagccagtatattagccagtatatcagttttaagtatatcagtctcataaggaaaccaaagttttaaataaagcttaaagagtcggctgtgatttttatttttaaatgtttttgcattgaaaattttctattaaatttaaattttaaaaatttattataatatatatttaggggaaaaactaattcaagcctaacttactagtatgcgggaaatgtacacaaacttttacagttatgcacttgaagtaattttagtacaaatatttgaaacagtccctgctataatgcttgagttaccatagtgtcttttccctcccttgtcatgatgctaatggacattttcttctgtaggtcttgatactgtgctatttgctttcttggtgttttgatttggcagttcttctttcttctctgctgccttgttttacctttttgcccgttctcctactgtcctgctgaatagccaaacaaacctgaggtactgttttttgtaaaggaagaaaatcactcaaacctgtcttcctagcaagcaaagtctgtcagtttttttgaaaacaggtgctgccaggactttgacaaaagtgatgatggtgggtggggaatgttatctatttttcatttttgaaatcagcatacttaaaaaattacctgtttatactgaagactgttacataacttctgttttaaaatctgaaatgggtctagtaagaaactataaatttgcagagaactgtataggacgagctggtaaactttcttctgtttcacaactactcactcggcctttgcagtgtataagcagccgtagacattacataaatggacaagcttggctgtgttccagtaaaacttcactgacctcaacagtgtgcctatcaaggccatgtttgccgcctaccggtgtgtagcattactgcaatagctatttaaaggtagttcaattccttgattcttcttccattgtaatgaggtatgtcttaatgtccaggcaatactacttgtattgctgatcttcagtaatattagagcttattaaattatgttaatgatatggtaggggaaagagagcattcctggctaaggaaggagttatgttaaatattgtaaaagcttttgcatagtttgacaaactataaagaagtagtcctatatattattaaatctcagaaccattagtttgtttgccctcccttaaatagcacagtggcatttgttttaagctgtcttaaactgttgtggtattaagattgattgattgattatgcaaaagttaactgagcacctcctatgaaccagaaactgtaaatggaaagatagaacttcgttcctgtcctcaaagttctctcagtttcttagattcaggtttttcaaacaaatgtcttacaaagtaagcaagtttttggcaacatatttccaccactgtttattgtatagtgtttcatctgaccctagaaacatttactatcactttattactctttgaagcatttattgattccaaacatctgacttacacatcagatctttcactcaccctggatcaggctgttaatgcttctttgaaagtgctgataaagcctacttctcagaagcagagttgaaatactcaaatctgcattttaaaagtatgtaaaataagcattcgttatcacattgttctctgaatgcaccatgttctcttaattctccctgtttttgtacttgctgctctctgggaagcttcttgttccatccataccctcgtttaacaaagtgctgtcttagatgcactgagttgtccaggaagtacagagcttttgtcttcatcatcagtagcgctgtaatgagagcactattttaatcctatccttttggctacatattggcatctatcatccagtagcctcccggccatgcagtgtggcgtccagctcctccctttgtctccgctgggcctggcccgttggtgcacatattaatcctgaatgaattattctagggaaatatggatttgacctcaaaaatctgaagtaactaaaccacttttgctggatttttccagtttagcttaatgctaactatatgaaaaaaaattattagcacaaatttggaaatatttcatgaatgctaaaacttcattgagttaattcacagtacttggaaggtatcctggagcgtgtttgcttttatctcaggatacaatacctctttagccagatgttctacaagtcattttctccttgaaatacctgtaattaattttctaggcccatagtctctactaaggaactctgaagatattaattataaacttatgtaggcacaaaaagacacttaagattcctccttaagtaggtagtttctggactgtcctctggtgctcttgatacctacgtctcttaggagacaggataattcccattatacagagtcacaaagggcctcaattttcaaaaaaaaatttgtcttgtacaatagcatttcaaagtctgacaattaggaatatcagaattttagcattgaacagcttgattttgtattgactattatactttaccaggaaaaattagaatttagagaatttatactttcgacatttttgaagccatgcatgctgtagttctgtccacaatttaatactgtactagggaaactttgtcttctagtttccttttaaaaaaatcattctaagagttttaagtttggacaaactaacaagtttacatttatcagacaaacagttatttgaccagtcattctccgttcatttttgcagctgagaatattaaaatttaattttaacaccaaggtgagctagtgatcaaggaacttcaaggccctgtaattccatcactttaggaggctgaggcaggaggatcgcttcagcccaggagtttgaggctgcagtgagctatgatcataccactttacaccagcctgggctacagagcgagaccctgtctcttaaaaaaacaataaacaaaacagaagttcattgtatttattagatagtacatacgaggtcttacaagttttacccatttgctcttctcttccccctttctgaacaatatcttattataattttaaaattttagtttgaatgatttcagaaattttgcaaggatatcacaaagaacttcatatatccatgtagattttccaaatactgttttaccatatttgctttattctttttttctgaactctttgagaataagttttagacatgatattctttttacctttttaaaatactatgtatttctttaaaacacagatgttaatatataactgtagtccagttaccaaaattaggaaattaacattgatacaatactgttagctaatctagcctttattgaattttaccaattggcccactaatgttctttataacaaaagggaaaaatacatattttttaatatggacaaaatgggaaatacataattcataaacatgtagaagacacatttattttgcataacagcactagcttcaggagctcctttggagtgggaaaacatcttacaggttatctaggccaactcctcatttttatgaataaggaataagtgaggaatcctagaagtccttaaaaggttcagaattttatattaacgtagtgccagtgcgagagtaagaacgttaaagtctgatttcttcacacttgtaaacaattgtattatatatgcatactgtatattttgtagttataagaagaaaaataccagaatttaaaatgcagtcacaatgtgttatgttttcagatgacttacgtatgtttttgttcatcagtattttaaaaaataatcacctgtttgtgaaaataatggttttgaaaacagcattatgatgagagggaacttcgtaatttcatgagaatgtagatggtgactgtttaagtgggagctcacataggcattaacatcaccctccttttgcacagtccttttaagtctcctgttaaacatcttttattgtgtgtatttaaaggcacacagatgctttttcctgtattcatcttacaaatttacctacatattcagccatccttatttccctttcatgtttcttgggaagcaagtctcttcactgtttaatctgttttgctgtgtttttgaagcccatattctttcctcttctcagaaagacattgctttatcagttatttcatcaatctctgtgtctccagttctttcatctcttctaacctattttcctcagcctaaaaatatgctcatcattcttttatacaggaaaaatgccttcactctttgttattctatgcagttgtgttattctttattaatacttgttgcctccgcatatgtcagccccacacatctttctgagttgatgacctccacctctgtctcagtctttacctctttctcatagataatcaccacctagaacccaacgtggatagctaactcaacctctttcaacctgaacctgttagctttcttgtgaaactgtttttgttacctgcagcatgcaataagtggaaaagtcctgttgatttttgctgctgtttgaatgtgttcttctgtagtcctggagacactgcctccatcagaacatcatcacttcttacctgcatgtctgtaattcctgcctcctatcttacctctcaactcattttctacacttcctccagaatggtctttctaaaacaacagatctattaacaatttccttactacatgatttcctgtagtccaggatgaactccggaggtctgctggtctggaatacagtggttcatgtgatatctttcatccttgtcatccatcatttcctcattgctgattcctgaatgcgtcacaccttttctgccactccggcctttgcatgtcctgtttctcctttagatgcttttttcttccccttagccccataaacatgtattggttcttctaagcacaactcatgtcatttccttgaaggccttttaatcttcactcccatctcctcctgtgttcagtgtgcttgcatctgtgcttaccaccctgtctagcagcaatttgctgatatatcttcattttttctgtttgcctctaattgtaatctcaagatcaagagctgcatctcattcacatttgaatcctcaatactgatttcatttcctggctcttagtaggtgctcaataaatgcctgttaaatttaattgaatcaaataataacacttacagtcgtacttcagataatagatggcagtaatcagtggactttaatgaatttgtaccatctgtccttatcaattaaattatgtcctcattttaggaaaaccttggggagtagagatgaatattttagaagaaacagaagtaatatttacactcaagcagattttaatatattttgtgagatagcaaataagtatctttcctactactatcttaaaattgtttttattttattttccttgtgtaatgtaagcaaataggctttaggtctcagctttgcaatatgtcgttggagtagagaggtaatacaaataaccctaaaaataaaataatttaaatgttgttatgtaacttaaaatgattgtaggaatttctgtttccactacttttctttagttatttattattgaaattagcatggtgttatagaatcccaggattcttaaatgttaccttctctaactaatatatattgcttgactatctagacttatacttaacaggtatttacatctttgaacacagaacagctgatggagaaagaagcattataaataatatacataaactcagtttgtacagataatccgtaatttttaatgtttaacttgtctaaatgctatatgtaatatctttcatcagtttttttaaagtaattatcctttcatattgtttttttcccaccaaataaaacaataaaaggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaaggtatggaagtcaatcaagttatttattctgaaattgattaaaaatattagtgtctatcttaaaaaaatttcatttcagaaaaaattgtcatttaataatgtattatggactgggcacagtgactcatacctataataccagcactttgagaggttgagacaggaggatcacttgagaccaggaggttgagaccagtctgggcaacatagtaagaccccatctctacaaaaaaataaaaaattagccgggcatggtggcacatgcttgtagtcctagcaacttgggaaactgaggtgggagatcgtttgagcttaggaggttgaggctgcactgagctgtaattgtgcctaagttcaaatggtgtcaaaggatcatgcagcagcttgctctgatagttctccagcctgggcaacagagtaagaccctgtctattaaaaaaagaaaaaggtagtataaccatcattatcatgtatttctaaattctcttgataaatacaattaatctgattttcaggaaattttttatttaaaataggctcatcgttgcattccttactgtaatttatacagatttgttgattgacaaatcactctctttgaaagtttcagtcattcaaacagtgctttacagttttaaagtttgggctctgccttaactattttgcacagagactcattacctttttataagatagcagtacacgcagtcattcttttatggaaagactatagaatgtttgtcgcactactgcactgcagcctgggcgacagcaagactctgtctcgggcgtgggggaggaaaagactatagaatgttcacagcaagcatagtcaacttttgataaatgtttaacgtctttacagcttccagctttctgtttaaattttattatttaccaacttaagtttattaagtttatccaacttcaatgactccggttttcttcttttttttttttttttttctgagacggagtctcgctttgttgcccaggctggagttcagtggtgctcgatcttggctcacaacaacctctggttcaagcaattctcctgcctcagcttcccgagtagctgggattacaggcatgtgccactgcacccagctactttttttttttttttgagacagtctcactctgtcaccaggctggagtgtagtagtgccatctcagctcactgcaaccactgcctcctgggttcaagcgattctttggcctcaacctctcaagtagctgggactacaggcgtgcgccaccatgcccagctaatttttgtatttttagtagagacaggtttcaccatattggccaggctgatcttgaactcctgacctcaggtgatccgcctgccttggcctcccaccatgctgggattacaggtgtgaaccactgcgctcagcttattttatttttcttaaactatatttttatgaacaaaagattaccagttgtccttaagccggttctgggagctctcattgtattatagtacctgctagttctctgacatagactagtcacttaaatattaattgaaatattgaaagaactgctctaagtttttctttcagcaaataaatgcaaagaaatatgcatagattgctttctaaaaagacttacatgtacatacatacaagtttcttgatgtgactttgtgtttcagaagatatctaatactctttgtactgtaaatttactagctgcaattgagagacttcaatacaaataacagcataccttggagatactgctggttcagttccaaaccactgcaaaagagcaaatattgcaatagagtcacacaaatttgtggttttccagtgcataaaaccacaggtgcagtggcttgcacctgtaatctcagctacctgggaggctgaggcagaaggatagcttaaggccaagagtttgagaccagtttgggcaacatagcaagacccccatctctaaaaagattttgaatagtagctgggcatgattgcacactcctgtagtcccagccactctaaaggctgaggtgggagaattgagcctaggagtttaaggtttcagtagctatgattgcactactacactccagcctgggtgagagagtaagacccagtctcagaattttataaaagttgtgtttatactatactgtagtaagcatgtgatagcattttgtctaaaaaaaaatgcacataccttcattgaaaaaatactaaaaaatgctgatgatcatctgagctttacacaagttgtagtctcattgctggtggagggtcttgcttcaatgttggtggatgctgactggtcagggcagtggttgctgaaggctggggtggctgtggcaatttctgaaaataaaacagcgtggaagcttgctgtgtcagttgactcttcctttcatgaaagatgtatccatagctagcaatggtgtttgttggcatattacctgcaggagacatctttaaaaattagagtcagtcttctcaaacaccaccactgctttatcaataggtttatgtaatattctagatcttttgttgtcatttcaacaatgttcacagcatcatcactaggaggagattccatcttgagaaaccactttctttgctcatcctaagaggcatttgttcaagtttggtcaggagagccggatatagtgaccatgtgcctgtaatcccaactgaggacaggaggattgcttgagaccaggagttcaaggctgtagtggttatgattgtgcctacatataaccactatactccagcctggacaacataacaagaccccatctctaaaattaaaacaacagaaaacgtttgattatgagattgtagcatttcactcacgttttcaagctccactcctaattttagttctcctgctatttttaccctacctacagttacttcctccactgaagtcttgaatccttcagtcatttatgagggttgaaattaccttcttccatactccctttaatgtggatattttgacctcctcccatgaatcgtgaatgctcctaatggcatctagagtggtgaatcctttccagaaggttttcagtttactttgtccagatccatcagagaaatcactatttatggcagctataactttacagaatgtattcctgaaataataagacttgaaagttgaaattaccccttgatccttgggctgcagaatgggtattgtgttagcaggtatgaaaacaacattgtctcctcatacgcctctatcagagctcttgggtgaccaggtgtattgtcagtgagcagtaataatttgaaaggaatatttttctaagccataggtctcaacagtgggcttaaagtactcggcaaaccttgctgtaaatagatctgctctcatccaggctttacttttccagtgacagagcacaggcagagtagatttagcctaattcttaagggccccaggatttttgagtaaatgagcattggttttaacggttgtgtggtgtgtgtgtgtgtgtgtgtgtgtgtgtcacagcgcctcactccgtcacccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccttggccttcggagctttgaagccaggcattgacttctctttagctaggaaagttatagatggcatcttcttccaatagaagactgttttatctgtgttgaaaatctgggccgggcgaggtggctcacgcctgtaatcccagaactttgggaggccgaggtgggtggatcatctgaggtcaggagtttgagaccagcctggccaacatggtgaaaccctgtctctactaataatacaaaaattaactgggcatgatggtccatgcctgtaattctagctgctagggaggctggggcaggagaattgctagaacccgggatgcaggggttgcagtgagccaagattgcaccactgtattccagcctgggtgacagagcaagactccatctcaaaaaaaaaaaattttgttgtttggtgtagctaccttagtggcttaagtaatcttagctagatcttctgaataacttgctgcagctttacctaagcactggctgcttcaccttgcacttctatgttatggagatggctccattccttaaacctcatgaaccaacctctgctagctttcagcttttcttctcagattcctaacctctctcagcctttacagaattgaagccagttagggccttgctctgagttagacttcggcttaagagaacgttgtggctggtttgatttctgtccagaccactcaaactttctgcatatcagcaataatgttgttgttccttcttctttgtgtgttcactggagtagcactttgaatgtccttcaagaacttttccatctgcatttataacttggctaactggcacaagtgtcctagcttttgggctttcttggcttttgagatgccttccccactaagcttaatcatttctagctttggatttaaagtgagagacatgttattcttcctttcacttgaactcttaggggctactgttgggttattgattggcccaattttaatattgttgagtctcagggaatagggagacaggagagagatgggtaaagaaagtcggtagagctgtaagaacacacacatttatcatttaagtttgccgtcttgtatggctagttagcagctcccaaaacaattacaatagtaatatcaaagatcactgatcacagatcaccatagcggatatagcaataatgaaaaagattgaactagtacaagaattaccaacatacaatacagaggcacagcgtaaacacatgctgttggaaaaatagcaccaatagacttgctaaatgtaagcttgccacagacctttagtttagaaaaagtacagttatcacgcccagcatggtggtgtgtgcctgtagtcccagccactcaggaggctgaggcagaaggattgcttgagcccaggggttcagtgcttcagtgagctatgatcatgccttgtgaatagctttctgcaagtaactccaacttgggcaaaatagtgggacctcacctctttaaagaaaaaaaaaaaagccaaagtgtagtatctacaaagtgcaataaaacaaagtatgcctgcactttccagggaacagaatggatgggggatgatacccacacacacacacacacacacacacacacacacacaccatgcactttatatgggacaaaacattttaacctttctttcttgtacagtctattttgagtactgttttggtttggcttgggagtgatcccaaaagggagtggctgaagtgattaaaagggttggtgaaaattgcagccgaaattctgaagataatgaaaatattccactacaactttttgtgagtgaatatgttcaattttcttaagttagcaagtaatgacctaatagactagaacctcatcctgtatgttgcttgtgtgtctgttgtcaggcacttaatatacttagatgagaaattttataaatgctgcagcataatagattatcttaaaatagttactgattgttttgtttaaaatgtttgaatttaaaatgttcacattttgaacatccaagtggattgttacttggaataaatgctaagcaatattttttgctaaatttctgatttatttggggagcaggaagaatgccttatcttaattttgaatcacctttgtaagtaaggtgcaacccaaaacataggcaatgctagttgccagatttttgaaccactgcctggtaagttgtccttttggtttgctgcaagcaagacagtgctcatttgggattattgtgtttgggagaagatgcaattctcattttcaaaaagaattagagaaaaataagcagtaataagatatgagatgtttaaatgtaactgtgacaagaatctttgtaattgccattgttttatgttggcagggtttgtgtgactgctcttctgctaaaatagcttagtaagtaagacttgccagtttgattcatgcactaccaaaacatagttaacgtttactgaaattgactccttttaataagccggaggcagctccagcaactagatagcatttctcttttcatactaacgcagaataatgtacagtagcagataaacatttttaatctcatgaaagcatattagttttctactttttctcttgaaggactaatgatttaccacagtagaaatttttttccagctttttgattgcagtgtcaaaaaagtatatatttcattgataacgtacagtgcaaatggagaacagccttgtaagaatattgcaattgtgtttctcactttgtccatttccttattttgcctgtagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgaggtaacaaactcagtaaagtgtttaccaaatgagagtagtttgaatcagaagtctttcattggggaatagttgtagctaatcacttttagtttgtatgttctgtttgttgctgattttttagctcttcgttttgcataaagtaattgttttcatcacatcctgtcctcgtgacattagtgtcatatgaaatgcctggaaaagtaaatcccacttctgtctatatgaccatttagtagactcaatgttaatgtagctcactgcagtgaaatagtcttactggaaacaaagccctttatcaagaataattaactcttcccttttctttttggagaggtgctttgtttctgatcggaccatttcactgcagcaagcaacacagtattctgagcagaagatcgggacttgaggccatgttgcggagggccagtgacattatctggactctggagtgtgagggtgggtactgatcctagcatcatcttcactgtgtacttgtagctgttctctatgatccttccctaatttcctgctgcatctccatcaagccagcattatttggtatcagtgctgcttagccattgtttatacaaatggggagaaggaatgcaccaccgattgccagaatcgcatggtcacagatcatagtggcttgaatgagaagctcaggaaagagtacctgcacacactggggatggcaggagggttcttagagctttagtgcatttctgttttgatttctgttggatggcatgtggtatagttagaaatctgtataataccactgctttggattgaagccctgactatttattggagatttgaatagtattaatatatctgcattttagaaggtgtttatgttgttgttgttgttactgtttttggctgttaacatatatataatttgtgaaattagatattaacagccaagaatagaaatagaagaaaaactgcatatgacactccatggtctctaaaacaatggaccaaaagaatcctctcagtactatttcataaataagctaatttgagctgtttggaccatttcaaaattactttcaaatattgtttttaattactctaatttttctggaattggttttcgtacacttgacaacctattcagcaagttagatttaaagtagggtaggttcttaggtatgtttataagcttttaaaaacatgaggaatttatatgtttattacttttggcagtcttgaaaggtaagtaacttagtaagatagcttaaatgaagatgtacagacaggacagctctttaagtagttattttttcctaacagaatatggactccactcttcactatattcacagcgattcagacttgagcaacaatagcagttttagccctgatgaggaaaggagaactaaagtacaagtaagtgaccaaaaaatgtgttcttttgtgggtgtgttcctaattcctcttttagagcccatttctgacctaatttgccccttctttatgatgagtgttctaaaaattgactagtgtgtcatattttccataaggaaatcgaagtagtagagagaggaacatggaagcacaaatcttcccttttctacctctgtgatcccattcttcattcagagtgaccacgatcacacaccttattatcttccttcatgtattttcatgggcacataaacatacacatgtgcctctttttatcattgaagacagctgtggtcatcccatcctacctaggtatttcctcttgttcacattgccaataattataaaatacagctcgatttcagagatgaaaatatgaaaaaatacgaaaattttaaagtgccatcagtaacaagctgcagggaaactgtgctcacggaatcattgaaatgtggtagctgtgccttgccttgctcttttcttttctcttctaacaatctgacctggtgacctctcctgtgagcacaccaggactccttcaccttcacagcagcacagcacagtgtccatgccacacccgtggtctccatcgtaagaaggcactgtgggagatgctactcgttgtagtttcactttgatgctataagcagtgctgcattcaccatgactgtctgtacgtgttgtttgcttctatgactttattattattattattattattattattattattattattattagagatggagtctcactctgtcacccaggctagagtgcagtggcaccatctcagcttactgcagcctccgcctcctgggttcaagcagttctcctgcctcagcctcccaagtagctgggactacagttgcgagccaccatgcccagctaattttttgtgtttttagtagagacagtgtttcgccgtgttggccaggctggtcatgaactcctgacctcaagtgatccgcccacctcagcctcccaaaatgctgtgattacaggcatgagctaccgtgcccagccttaggattatattattattgttagaagtagatttcccagatcaaatggtatatttattttgttattgttgttagagatggggtctccgctctgtcacccaggctggagtgcagtggcgagatcacagctcactgcagcctcgaactcctgggctcaagcattcgatccttctgcctcagccccccaagtagctgggactacagatgtgcaccgccacatctagccaatttttactttatttactaaaaatgaaatcagtattcaaaacaatagtgttttgaaacatgcttttccccacttacagacattttcagtatttcaaatctcattttaatgagtttatttccattttcattttgtgtatatggataattcgtttatgtagctcaaaattcaagatacttaaaaggcattcagtgatgttcccttctcagttttttcttctccactcatccattttgcttcctgagatacaaccagttttacctttcttttatatccttccacagctatattatacacacctaagcaagattgcaaatatgttcttcttttcctcacatatatactaataattagacatgtgcacttcaattttctagaaataattgcttaaattttcatctaaagaagacaagtttttatttttgttttgagacagagtctcactctgtcgcccaggctggagtacagtggtgctatcccagctcactgcagcttccacctccctgggctcaagtgatcatcccacctcagcctcccgagtatctggaactacaggtgtgagccaccatacctggctgattttttaattttttgtagagacggggtttcaccatgttgcccaggctgggctcaagtgatccaccctccttggcttctcaaagtgctgggactacaggtgtgagccactgtgcctggctggtttttgtttttttaatgaacatgttgcaaatcacgcagagcacctgttattctgcatttgctgggttataacaaacattgtcatctctgcctacatttaaaaggctctggtgttattttaatatgtcttttcaatttagtaattaattctaattttcctttgagctgagatgttattcattgttctcctagagttgcttttatttgttcatatatgtttcccttagcatgtttttcgtatctcttagttattagatacctgaacatttgacattggtttttctcaactatttgagatgctatgttaaaatctatatatttaaaaataattttgcccaatttatgtctaaactgctcaaaatgcatctcagctgctcagtcactgtggtttctctttctccattaggatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcaggtgagtaaagcagttaaagaattagcagaacgtgcatgtggaaggcacagtgctttgctttttgtaacctaaagaatttctgttcatgttctagcatgttcttagtgttataggaaattatgtatggaagagcttaagagtaataacagagcatgttctttttgcagtgtcagagtcccacaatttggcttcttcatttttatctaaagcattagaaattgttatcacattcaacatgcctacattcctaacttaaaatgtattattatctagagtttatatgtaaattaattgttccgaatataggatttaatttttcacctagaaatagtattataaatgcttatttgatttgcacagtagatctgaaaatatttgttgaaaccgtagtagaactccagtattactagcacatgtgaagttctgggccctgcatgccttgagcattgcagtacagacaggagaagttccgtggttcttgctctctcctcatccccacacaccacccccaacccctttcaacagaacacacaaggtaaacccttgcttcacgtcattttgtctggacatctgtgacttttgtgtgacctcttcccaggcttgatgacctgacctcccctgccagggctgatttctgtataaacaaagtttgcccctctttgaacacacctgttccttcagtgaagttgatctctcagttatttaaaaaaaaaaaaaaaaagcagtctgattaggctaatttgtactgaaatgtgatgacttttccttaaacttcttagtaattgtatttttcaaggaatcagtgctgttgactcagcaagttataagttggaagtaatcttgataggtcaagttcctcctttgacctatgaggttaggaaagctgggcccaggagaagtgaatttatccttaaccaggacccagaagaagtgaatttatctgtgttcatatactttttaagtgctgcatctggtcatggaaccacaaaggcccaatttccatagagtgctttgtcctgtgtattcgtgttttcagtctttattctacagaactgtagggttcccgtgggatgtatctttcggggcacctgggtgactctgatggctcagaatctggatgggcagtttcttctctctgctgcccccctcttccatcagaacatctctgccttcatctgtcttatatgttgaacttgggcgtaaaattttatttcaagagtggattctggggggaagggaaaggaaatacaatgtttgctctaaactgtttctctttaggtaaaattttaagttactatgtaaaaattttatgattaaggcaccatggagaaaaggatgtttttaacttaaaattattataaatgcaacacatttctgttgagggtttcttttccaaggctgtatgctgatttccctagtcttatatttcttaaattgccaattccttaaaaacaaattttattgttctgttttgtttttcttaatccaaggtttggctgtacaggaatctgaaggggaacagtaaaccggggagggtgctagagatcctttggtccatgtgcagcctcagtacgtcggcatgttctagcatgtgcttagtgctacaggaaattatgtatggaagagcttaggagtaataacaaagccatgtgcagcctcagtacgtcggcatgttctagcatgtgcttagtgctacaggaaattatgtatggaagagcttaggagtaataacagagcatgttcttcttgcactgtcagagccagggtccaatgttcagagagctacaaaaacttcacgattgctaagcattttctcctcataaatgaaaggaagataatacgtactaggcagggatttaaaatgtttctgttacacttttcgatgcataatttaggcatttaaagttagtatctgttattctgatttaattttttgaggttagtaacattcatatataaattagcctttgtatattgcctaatggttaaagtactgcgtactttgtggttagcttactaatgtgttttcatttctgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaaggtaacttttaaatttttttgcataaaaacacaacaaaattctgccgtaatctaaatctttatcttctgctatcaccaagagaggtttctttgtgtttctatgtaagaaaacacagccataagttgatgttaagatgcaacttaaaaaagaaatggtcccataattatactctcacttttaaaacagtattagatgatagtttacagacatttgtatctttttctttttcaaaattattgagtgaaatgtatgttaaaaaaaatcattagctgcagtcatccctcagtacatgcaggaggattggttccaggtcccccatgcacacccaaatccatggagtactcctgtggaacctgcgtataggaaaagtctgccctccgtgtactccagtttcacatccgggaatactgtattttcaatctggttgggacaaacaattcaagtataagtggacccatgcagttcaaacccctgttgttgaaagtcaactgtgtattaagtttggaggctttgtgtggtatttcaggcgtcttgagaatttacgtttagccctcactactttgatagaggagctgtggtctccaaagtgaatagccctgattttttacaaattgtttactcctggagtactgttgttgtttttagactttagccttgaaattgactctggtaattctaaggcttgagtgatagaagtaattgtagtcctcccttttaaaaaacactgaggctgggcacagtggctcacgcctgtaatcccagcactttgggaggctgaggcgggcagatcacttgaggtcaggaggttgagaccagcctggccaacatggtgaaaccttgtctttactaaaatacaaaaaattagctgggcgtggtggtaggcacctgtagtctcagccactcaggagactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtagctgtaactacaggtgcgtgccactaagcccggccgattttgtgtttttttgtttgtttgtttgtttgtttgttttagtagagatggggtttcaccgtgttggccaggatggtcttgatctcctgatcttgtgatccggccaccttggcctcccaaagtgctgggattacaggcgtgagccaccatgcctggcctaaaatttttctgattgtcccagtattgtcctttatagtttttctccgctcaattttgaatcccttaaagtgcatattaaatttaaatgttatctttctttagtcctcttaaatctaggtgtcactggcatttttgaggagtctaaaccagttgttttacagaattaccctcaatttgaatttacacaatttgattctgagtaagcggggtttttttgcagacatgttaacctgtgtaggttgtcatgtatttttctgaatgtgccacatcagggctaatgtggtgttggctcttcccatcattggtgacgagaaggctgacaactccattgtaaaatgaccttttaccttttgtggttaatagagaattggtgaggtgatactttagaactctgaatatctttttctctagagtccttcaccagtgctctcatatccaggcatctatacatggttcttacctgaatcagttaactgtgttggttgtgaaagagtgattttctattttcataattctttctgtttttttttaattaattaacttacttattttgagacagggtctcactctgttgcccaggctggagtgtaatgatgcaatcatggctcactgcagcctccacctctcccagctcagatgatcctcccacttctgcctcctgagtagctggggccacaggcgcaccaccacgcccaactgagttttgtattttttgtagggatagggtttcactatgttgcccacactggtcttgaactcctgggctcaagtgatctgccccgccttagcctcccaaagttctgggattacagatgtgagccactatgctgggccattccttctgtttttattaagtaacattcccatgtaaaaataacctgtgccttctctccttccccggtttcgaaagttattttagtattagtggggactctaggattttaaaaattcaacataatggaatccatttctgtcatttgttttgagcatcaaatttgactagtggagaccccttaaagctgcctcttgtgtcctttgatttgtcctttgatttttaagtgcatcaatactttcagtttcaactttccctttccctgtcccagcctggagtcagctatttctccaaggaactgtggtcctttttagtggagaatggtccttagaaactgagatccaggcactggaagtgctcattgctcctggcctgtcatttcttttaggtcttttcaggagatagtagctaggaggtgtagatagtagctaggaggtgtgatgcttttttttttaattaaattactaacttcatattgttatgaactgcttccaattcaataccgttttctctcttcactttatatatttttttctttttactcctggtaaaaagtctgttcttagtaacattaatgtgtaatatttagttgtggctgggcacagtggctcacacctgtaatcccagcactttgggaggccaaggcgagcggatcacctgaggtcaggagatcgagaccatcctggctaacacggtgaatccccgtctctactaaagatacaaaaaattagccgggcgtggtggcatgcgcctgtagtcccagctactcgggaggctgaggcaggagaatcgcttgaacctgggaggcggaggttgcagtgagccgagatcccgccactgcactccagcctggaccacagagtgagacactgtctcaaaaaaaaaaaaaaaaaattagttgtttgctgagttccacaacataaatgaaatagtttcagaattactccaccaataataattcccacatcaaatcaactacataatattcaggacttcctagcacattctgtccttagaacgtcccttgaagatgtatggtcaaagtagtcagttcacactttggcttttttccctgtgtgattgttttccatctgatgcacagttaggttggtttgcttccgtttataaacttacctttaaatatttatagagcagctattgggatacatttattttttttctctcaacaaatactgaatgcctactctgtgctgtcacagcgtcacacgcagggcttacacacgtggttaagagcataattactgccttaagcggggccatggcaacaaggatgtcatatgaataaagggggcaagccctgtaatcaggctgtgcccggggtactgtggggtttagcgtggctcattgataggcacaaggaacaaagatttccagacaagatggtgattcctgaaggcaaatggaattattcagggaaaaataaacttaataccaaattttaaaacacttaaatacagctactacatttcctcttcagaagaattaaccatattgcttacagtctgtttttaagcactctagtaaaagaaatactgtctgtaccttgtcctggtaaatatttttattttgttactttagcttcttcatattgacaaaagaagagaatatctttatcaacttcaggagtttttggtgacagataatagtagaaattggcggtttcgagctgaactggctgagtaagttctaacagtttattagattatgttttggaggggtatatatttacttcatttttacattttctcagtttcttcattactttgtgtagatccaagtttctatgtggtattctagccctttaacgcttcctgtaatatgtgtcttactgtcagtgaatttcctcagcttttttattttttcttgaaaatgtctttagttcatctttatattatttttatcatggtgaaatacacatagccaaatttgctgttgatgacatttagtccattcacagtgttgtggaaccattccctctatctagttctgaaatgttaacctcccgaaaagaaaaacccatgcccaataagcatctactatctatggatttgcctgttgcggacatttcatgcaagtggagtcatataacacatggccttttgtgcttggtttcttcatttaacaatgttttcagttgtcctccatattgtatcctctagctgaacctgccttcctttttgtggttgagtaatattccattgtatggatataccacattcgtttagggcattcatctgttgaggaacatttgggttgggggtgtggtcttttgtgaatagtgctgctaggaacgtttatgtacaagatttaatatttgaaatctgttttcagttcttttgaggtgaatttgcaaggccatatggtaattctgtgtttaatttcttgaggaactgccaaaacttttccacaacagctataccattttacattcccatcagcaatgtatgggagttccagtttctctgtctcctcactaacacctatttttctactaaattttaaaaatatttctaaattggccaaataataattgtgcatatttgtgaggtatgtaatgatgttgcaatacgtatcggatagtggtcagataagggcagttagcatatccatcactcgcttatcatttacagctgttctgatgggcttggaacagcacttcattgtggtatgatttgcatttccctaatgactaatgatgttgaacacttttccataagcctgtcaaccatttgtgtatattttgtggagaaatgtctatccaagtctgttgcacatttttaaattggattatcttaagttgtgttgttgagttgtaagagttctttatatattctggattatagacctcacctgcattttcaaatgatgtctttgctgagtatggaatgtggggctgacagtttgtctttcagtatattaaagatgccactccattgagttctggcttgcccacttctgactcaaaacacacgcctcctcttctgccatatagtgccggggtgtgagtccatctagtcagggtcaagctgggtttgcgttttgtgattgctgtggttacgttcagtgtacttggggcttcagtttttctcgctgtgggctgccactaccattgtcgtttgctgagggtggcagctggggtaccagtggtcttctagtgtgagtattccacccggcgtttagcggtacctgcacccctgcgtaatgggtgggacctcctatctgtgcttggtctcgggcaggacttcctacagctcctcctggaataaggagcattagttctcctctcccacagttgcagtatttttgctgggcccacagggtggacaggctttggggcccctccaccagcaggttaagccttttgctttgcacgagaaaagggcccagcagagtgcttgatgattcatggctgtcagtcagttgcttctgcctgctatgagacatctctcctgtttttcctgaccatctttcttgaagcacccatgggaggcaggtaccctgtggaagtcagaaggttgtctgggaatgtgagctccctgtgtcgggcacatctggctttgtttgagccaccccatgctcctgccagccaccatctggccctgggcagctgactgcaattcgagctgatttctccctgccctgttaggtgctagcaggtgtcctgtccatccgggctctgctgaggggcagttctctttcccatcttgggaagttaggttgtttgtgtgctttgcaaccccagctctctgatgggctcaagaaaagatcttgaagtttatgtagctttttctactgtagggtcagtgacgttctttgcagttttctgtattctaagcagaaactggtcctatttggaatttttattttgaattttgtcagaaaataagtgtgtctctttgaggatgcatatttgtatacacaggtgcatttatcattgctgcataatctatattcatgttacagttgactttctgcttattagaaatgtaaatcctcttgaacataaaatctgaaaggcaaaagtctcacatccaaggtatttcttcaaggccatcattgaagctttcaggttagcttggtagatgtcatgaaagtctcagggcccctcagatgtgatgggaaggttgctggaggacaccctccctctgttatccctagcaaatcccttccaggaaggctcctcagagcctcgacaggtacacagtggactccctccctctgcggggacttcttactgagaaacttgattgtagatggaagcttctcagcacattccaaactgtgaccatggatcagtgtgggccatgttccagttgaacatactaggaagtgctttgctctgtctcagtccccatggatgcagaactctacagcttttgttttccttacactctaaggaacttgaatagcatgtaagtgcatttccagatacacagagactggaggtaactgtacaggagaggtctgcttaatcactcctctttgcgtatgtttgagacaggtgctcagtaatccagtattacagatgatttaaatgggtaacctattttcatttgtctcgctgatttttaaacattgtctttttgtaattcctttttgtagacagctgattttacttctagagttatatagtcccagagatgtttatgactatttacgtcccattgctctgaatctgtgtgcagacaaagtttcttctgttcgttggatttcctacaagttggtatgtattgaacttttaaaattttagatcagcaaactctaagatcctagaatggaagctgttcctcatttctccatgctcaccctcccaggtcagcgagatggtgaagaagctgcacgcggcaacaccaccaacgttcggagtggacctcatcaatgagcttgtggagaactttggcagatgtcccaagtggtctggtcggcaagcctttgtctttgtctgccaggtaagcgaggccctgggcttacctgtttgtgagtttttctcctagaagaatgtcttctttaacttcctacctctctctcaccctcttccttactcttaaggaacagaaccttatagtagcctggctgtttataggatcatctgcccccattgttgggcatctggtggcccctctctcccagctagccaagcccctccttacactggcatgcaccacacacaccccacgtgcctgctgtatgtgcttgttccacaccacatgcctggtatgtgcgtgttctgctctgcacacattcagacgtgtgtatatgtacatttcacagtgcacatacatgcatgttcctcactgttcctcactgcatattacacaggcatacatacatgtaccccaccacacacatactgtgcacacatataccataccacggttcccactagagggtgctcatgtctgggacccagagcgcaggtgtgaaaatgaaacacctgtgaatgaacactctaggtctccgtagagcagtttaaaaactgtgtctgtccgtgtgggcagttaattatgtaatttttgatttgagttcccaagtacgtggaattttggttaaaaagcaataactaaaatttgtacctgtggtcactcagagattttgttagccagtagtcgagtttttggctacattgacagagaagcctagagcagctgtttctcttccccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaaggtaggtagtgactccactagaagaagcgtgtgagtagagaaggaggtctgtggactgcactggatcagcagatatcaaagcagaagtattgtctgctcagagaaaataatctggtggaaggaaatactttagttgttccggtgattctcccaagagggcatggaagatgaaagggattttttaattagccctctactgttctagttggagtttatttatcggaagcatgtatcatttttatcatttaaaacttaggtttttttgtttgcttgatattttgagacggagtctcgccctgtcacccaggctggagtgcaatggtgcgatctcagctcactgtaacctctgccttccgggttcaagcaattcttctgcctcagcctccccagtagctgggattacaggtgcccgccaccacgcccagctaattttttgtatttttagtagagatggggtttcaccatgttggccaggccggtctcgaactcctgacctcatgtgatctgcctgcctcagcctcccaaagtgctgggattacaggcatgacccaccgtgcctgacctaaaacttagtttttaaacttgggtgttgtttttatgtacaaaccattgcctggcagcgtgccacttgcaatctgcagtatgggggctggtacctacctatgtttgctctcccttctgctttctcttcattaggcaagagacagatgccccatagtatttgttttgttggaaattataatctcttcaagattaaaggtggtttatttattttaatcgacccccccgccgcctgccgcccaaaacacctcataaatatagttgcacggatgaatgaagcacagaaagaagtttgtagtagatgtcaaagaataaggataaatgaatatttttttttctcctttttttttttttgtagttggtgtttggaagcatttttctttcactgctacttaatggctaagaagtgtgatgttttcatctatttattaatttaatattccttagctgtcattgaatatcatgagatttagtcttataaaaacaagataaatctcataactctttttattctggcactttttcttcctataacaaatcagtttggattactgtttatgtttcagtgtggcttgtttgtacttgtagaaatacccagtttaactgtttacactcgtacttgacggaactctgaagtgttccgttggactggtttcatctgtcctatgcacatgtcatttccagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtttattagtttctctggaatctgcctgtgtccctgggtttgggttttgctcttggcagcagcaggtgcctcttgggtgctcctcctgctcctgcctgcagccctaagagcaggtgggtgccgagtgtctggcacagcttggatgccgcccactgaagacagcagaggggggttgtcttgaagctcccgagacacagtcaagcatctctgagcctcgatgtcttcgtcagtaaaatgggaattagtaaaacctgccctgtttctcacagggttgttttgcaggcaaatgagttcctgtgtgaaggtgcttttgtaaagtgctgcgtgtataaatgtttgatgttcctgtaagcctggtttgaaaaccttggcctgtcggagtcccctggtgcttctgtgagttttggttttatttagttagccagcagggactcctcagtaagtcaaaataagttcctttgaacttcagtgtgggatttgagaataggtgggctgcttcctgtctacactattacaaataagcctttggctgctgcttctcgcattataacccagatatttacacactgcaaatataagtgtaaacagattccactgggaaggatgttcaaatgaatagataaatgcataggtaatatgtgaagtgggtaatgggagtggggctggggagtagccgtggagggtgtggggtggtctccgaaggcctctgaaagcagcatcagcagagatcggaggaggacctggccgcttgatttagcctcgtgtgtgagctgcagattgtctgctattatcatatatttttggcccccagtatttcagttctgaaaattgcattagaatcatacactagtagcatttttttaaagcagtggctatgctaacatggtgtatttgggggtaaagaacttgaatttggctgggcacagtggctcacgcctgtaatcccagcactttgggaggccgaggcgggcggatcacgagatcaggagatcgagaccatcctggctaacacggcgaaaccccatctctactgaaaaaatacaaagaaattagccaggcgtggtggcgggcgcctgtagtcccagctgctcggaggctgaggcaggagaatggtgtgaacccgggaggtggagcttgcagtgagccgagatgatggcgtcactgcactccagcctgggcgacggagcgagagtccgtctcaaaaaataaataaataaaagaacttgaatttaagttgcgctatagcgcttgtaaagttaaaaatgcacaagccaattcccactgcagccttcgcacagcctgtcctaccaagactacacagcactgtaaaatacctcaatggcaatgaatacaaaagacacctgcattgacagctttcacatcctaccatcaaggcactcccagtgtgaagactttctaatggaattcagaataagattggagtgttacccatttcatttcaactcttagtagttgccaatgatgccttctgtagcggctctgaagaaggcgaggtgaggtaggcatgttcttggcagcaggagtcaacctgtatgcgacaggtgtcctgggtcctgtctcacgtgtggcctccacttacacaggatctcctaagggaggaagctgggattccaaaggcagtataaagccaagcacatgtggacagtcccccacgagatgaaagtggaaacagcaaaccaactagtattcacaacttctcctttcataatataaaaatgagtaagatggtaagctgtctttgagggtatttaatattgggtggctaatcttagacgatattctttgatatcgtaggacttgtgagtgacgaaggatgaagaggaaagccttactttctggaatagcttcttagtcactgcctaaagttcattctctgctcgcccccaatctccccagcaggcccttccacgtgggggtgtagttgacatggggc

SEQ ID NO: 16114 - DNA, 94877 bp, Human
  misc_feature (1)...(94877): n = A,T,C or G
attaagcctagtgcccattaattatttttcctgatcctctcactcctccagccttccaccctctgataggccccagtgtgtgttgttcccctctatgtgtccttgtgttctcatcatttagctcccacttataagagagaagatgcaatatttggttttctgttcctgcattaatttcctaaggataatggcctccagctccatccatgttcctgcaaaggacatgatctcattcttttttatgactgtatagtattctgtgatgtatatgtaccacattttctttatccagtctaccattgatgggcatttaggttgattccatgtctttcctccgtgaatagtgctgcagtgaacatacgtgtgcatgtgtctttataatagattgatttatattcctttgggcatatacctagtaatgggattgccaggttgaatggtatttctggttttagatagaggaattgccacactttatataaaatatagaagcaatagataaaaatgtaaaaaaagtaactacccgattatgccaccattaagaaataactgatattaacaaatagatgcttattctttcaggtgtgaatatgtatctatgtgcatgtttccaacttttgaagcccacatagtaatacagctttaaaatttaccttctgaagctcgcaaatgtatttcatacaaatacattaaatatgttaaacatgttgtatcatacaaatgtattaaactctaattcaatctaaagtattttctaatgagttaaaatcccaaatattttcttttctcacaatgtttctaatatcaatgttgtttatttctaatactaacctaaataaattgattttacacttaattatttactatttccattcaccttaggagatttagatgtatgataaaacaaccagaaaaggtaaggtgactcaaaaatgtgctattgatagtgacagaacaatttttttacttaatagctttgaagttcttacagaagatatagtgctgaaatattttcatataatctccacttcttgacaaacacaaatgtcaatttaattgcacaatttttagatcacaaaggcaagagaaatctgaatgtaaccttcacattaaacttcagtagcttgcataaatgccttgctttgcatatattttttaaaatataggtaagacaagaaagtcatgtaactgttacaagaatgaattcagattttcacagtgtgaattacagggtgggaacaaagttgtacctttccattttaagttcctgagatacctaacacatgaaatgagacctcttttatcacattggtaaaggcatgagtatcctatattcatgtcccttaaaaatacaaatgaaattgggatgtaaataataattataagacaaagaaatctcataagctgaactgtgtatttttaatctacatgggaagataaaatattcttggacaagataaaaattatcctggggtcactttaggagtaaaatcatatgtaagaaaaatgtaattatagaaaatatggaaaatgcaatggccttaaaaactcaaaatctattaatgctctaaagaaatgtgcaattcctaaaattgaaaaaaaaatgatgcaggtcaatttgttgaagaaatgttcattgtgaaacataacatgttgcaataaatgtaggatctcagtccattatgataacaaccatgtactgcttgtgtatattctggtaagaattgttaattatggagccacaatgggaccaacaagagcttttactgtggccacagtattgtggagtagttttctaggagtgctctttctcaaattagtggcatatttcagataaagaaaggaagtcgtcttaacttgaaactgctgtgtcatttcttcttccttaactgaaattccaaccagggttcaggaaatgccctaatgagccacttctcttttctctttcctcaactaactggattccaaccagcccaaagtattcattactcacggctagatcgtttactttggttgtcccttctggcatggtgcatatgttatgggaagagggattataatttggtgctgtttgtagagatgacaacactgataaaatccactcattgctggtaggtaactaaaccggcaggttaattttctgtactttaaacaaactaggaagacaaactaatcaatacttgttttattttgatatgtgtggcttgcttataattataatttcatcttttatgataactaggtatcaggatatctgagtagtcaagttgtgatttgctattatttggggaaaatatgtctgaaactctattaatgtcttatttcaaccaagatgtggaaatcactgttttagttcatggtaaccaaagttatttatttttcaagtttaatattttcagatatttactaaattggaacatgatttaacattttgttgcctcttatatatgttattttatgagtaaatattaatttttgtttacatttgagcaatatctattttattggctttaaaggtaagaaaatatgagctctatttatagcaaaatagtaccagatagtatattagcatatattcttattccaggactaaaaattaattcctatttttatgtagatgtggatctaaatagcttgtgtagaagatgtcaagtatcccaatgcaacaacctttttttgagatggagtctcaccctgtcacccaggctggagtgcaatggcgtgatctctgctcactgcaacgtctgcctcccgggttgaagtgattctcctgcctcagccttccaagtagctgggattacaggcatgcgccaccacacctggctaattttttttttttgtatctttagtagagacgcagtttcaccatgttggccaggcttgtcttgaactcctgacctcatgatctgcctgccttggcctcccagcaattacttttttaaagtaatagttttcaattgtaataatcaaaagagttgtagtagaaactttaagattaagatacatatgaagatatttatacacatgtacatacatatatatatgctgtatatatacatttgcttatataaattacaatagatataatttcatatatatttatataagttataactccatactttcaatattgtcttagaatatttcactgggaatatgcattttaagggaaggagaaacctgaggtaatttcaaattcattttggatagtttataagaaacttcatttaactataagagtgtaaaataaccttcatgattctttcgtattcagaaagtgtgtcagcacagcaaagtgaaatggtacgcagtttattatcagcattattcggacaattctgcttcacttctattttagatgaatctgagtgtagcagtgcacttgcaagtatcttttaaatttatgttaaatattttacttttggatggaagctactttaagtaggctaaactttaagatctccttttaagaagtttttttaaacttttttttttagctctaaaacaaatggaatacatataattttcatgtctatttccttggtttgggttattattactttttttttaagttttcaattttattccaaaacagtagaatagttcaatgtagtacattttgttgaactgaaacttggagctcatgtcaaaaatgaaacaagctgaaaaatgtttcttaaaagtcagtttaattttaacgactgcggcataaggtttgttgtaagttctagatagcccaaaataattacaagacatttaaataaggtacaaatttgtagcatagtgaaattttcagaaatactactaacttatatagtggaagtaaaaatagttttgaaaacagtggtttgaatagtcagaaaggagaaataaggaaagaagaaactgaaagaaacaaaatattcttacacaatggttttagataaactagtgaaatataactcaaatggaatcattatggctgttgatattttccataatagtggaaaagcaatcacttaatcttttataaatcgttttacaaataaagctatcagatgtcaattagacattccagattcttcatggagatgaaagctcttacagtaaaaaatactggattatgatatggagtgatagcagatccagaaaggtggtgtttacaaataggttgctattttgaactatttgtcaacaaaataaaacacatgcatagtgcaaagcatggttcctgcacagattttactgggggtgtttactaagaagagtctgggaggcatagagcagtaggaatgacaatcatccccaaagtcataacctacgaagagagaggttaacagtagtcttgtaggaaaagaaaaacagcaagaaactaatttacgcaaatattccttattatatagaattgtgaatgccagctaattagagaaatctgtagaattgtgttgtgggtgtttggagatttataaaaatttggtggacaatactttgcctatgagagcttagctgatgatagatggttttgtgattccattaaattgtatttattggagcataaaaagtcttggccatttacacaccaataaataaagaagaacaggagaatattagaggtagtttatgttaaatgttaggagaattgggagaattcgtataattgaaaaagtgaaatagtaagatagagatgtagaatctcctcaggtgaccaggtttaagaatgaattggtcaaggcgagaaagcccttgttcccagtttttcagttgctctcaggaaatagagggaagttgagcctaatgatcttaaagacccgttaggtttctgtttctcttttctcttttcaggtttgaaagaataggtgagaatttgaaaatcgatctaaaaaaaggaattgaaaggagagtctaggacgtagaggtggagttttaataaggattctcatgcctcctaatgttcattcctaagagttaccatggaagagtattttcaaattgtctctcttcttgaaacatgctttctcagtttgccactgagccagagacttcttttatacctccctttattcccttctttattctttcttgcacaaacatgtttccaatgctcagcttccttagatgtatttccacccaagtaagaatgtgagcctgcacatttaaaaaatttttttgagacagggtctcactctgtcacccaggcttcagtgtagtggcttgatcaggacccactgcagcctcgacctcccgggctcaaaagagcctcccgcctcaaccccccagagtagctggtactacaggcatgcaccataatatccagctaatttctttttatttttttgtatttttttgtagagatggggggtctcgccatgttgcccaggctggtctcaaacccctggactcaagtggttgcctcagcctctcaaaatgctgggattacaggcatgagcaaccacaccctgccaagcctagacttcctatctgttcaatcaaatatttggctatatcttgttttccacttgcagcactcattctatgcggcatctttcctcacgctcccaaaatctagaccagtacctaccgtattattgacaatctgtctatagacaggtatttatccctgccaatgtctgcagagaacttctcaggggctaatatgttaacactctgttccctttgaccctgtgtagactcaaatggatttgaacctactgaactatctgaggtctgcaatagaaagtttgtcagcaacattttcacccccagcctttaaattctggtaaaattctaggcttcttcttaattaacatttggctaagaggcatctgatattttagtaatactctctagtgtttctccccacttagccaatcacttttcctcttctacagcttatgattgtccttcacatgtgcaaggcaatttttatgtgatggatgatctgctcttttcatcagaattgcacctactgttaaagatttttctgtagacatattcaaccttctttactttgtcattgctttcaaatgttaaaacatctattgcttttgttgcaaacaaccatttttctctattaacccttctaatagtgtttgaaaagctctgagcatatccactcttacagtaggaataagccagtggatgaatctgcccagtgacatgactgatgacaccattttctggagaaggaagagaatatgtgattttacctcgttcagtaatttaattaatatctatgtaaggttagttaagatggaggtgtacaagtagaggaggagtgtacctggtgcggtactaggttctgaggatgctaagatggataaggtatgctacctgccagtgagcagttcaggcatttcaacaattaattacagagacaaatgttacaatgaaagtatatatgaattatctgccaatctggaaagggttcaaagagaagatgggtgaagcatatctttaaaatgaattagctattctttaggcaggcgaaggcattgggccaaaaggtccagtggatcgaaagactagcatgtgcagagttgtgaaaagcatggcatattcaggggtctttgattagaagtggaaccattgtgtgaaataacatgaagtggggctgaagagttaaggtgggggcagaccatgaacagctatgcttttaagagttgttgggtttacccagagaaggagcttgatttgattatgttttagcatattttgattatgtttagttttatgttctccagctctggccatttggaagacacattagagggtgaaagactggagttattagttttaaatttttgttgatagagtgtttctgtatccgatttaagagagcaaaaatgactgtatgtggtgactatgggtaataccttcaaaatagttgtacctttggcaagaagagagaggctgaaaagatggtagaatgtacttcatgagaaaattgaaggtgatgtactactacattttttactgcagcaattctctcttaaactgaacatggattagcaaaccagtggactgagcaaatatttacaagtgatccagtgatttctttatggttgcttggtttgatagaacacactgtgaaatgggaagtcagaagttcagcatttttagcttgctaccaacttgacatgtgactatgagtaagtctgtctgtctgtgtgtgtgtatttcctgaagatttcacattgaattaatatctagtgtggagagtgaaaggctggggctgggcctgagggtgaaggttgaagtgtctggtggtgcttaaatctaggtctcttgtacctgaagagcagctctgaatttgctcctgagaaatcaaacttgggttggatttaggagctctaagattggaaatctagttcagagtgcaaaggaaggacctctctcctttttcctttgaggcccttcatcccacatttctgaaagattttcagagtacagaacataacaatgggccaatgtctcatacatctggtcttgttttccttaatattctctcctattcaaacagcctcagggaagcctgccttaggacagagctttttagaacaaaatgaaatagaggaaaaagcagctccttgcataatttgagaagtaactgttaatttgccttttcttcacaggacatctctagtgttccatattttctcaaaatgtattgccaattcatttgcatctccatttgtttttatatgaaacactggttataccgagctgtctctaaattcacttggattcaggcctaatggaccacacttagtgagatatatgacagctgatgaacagttgcttaaggggtgtttgtctaaagatgaaacaaacaaaaccatagcagcaacaacaacaacaacaaaagagcaagcaaagatattctggaatatgataggagatggaaaaaatgtataaaataaatggataagctaaaacaaaatagcaagcaaagatattctggaatatgataggagatggaaataatgtataaaataaatggataagctaaaacatgaagtactcttcttaacagggggataaaagtgagaccctgaatgctgaatattcttgcttgagtagcagtcattttagaagagttgtattgagtatcaaaacagtatattttatgaaatattctcctcttctttgaaacaggtggtaataggaaacattgattgggctctccttatgtactaacggctttacatgtatcatctaatttttgtctgacaagactcttggggcaagtaatgttgtctccagtgttcagaaaagaaaactgagatttgtgaaggataggtaaatttcccaaggtgaaagctgaacagtgagcaatgattggccaaagacttagatctaggtctggatgctgtttaggcccagatggattatacagtcttttctaggacccttttaaatttaaactttgtctttgttgttctctttcattcattttgaacaacctcgcctctccataggagagaaagggaaacagttcaagggagaagggtagaagaaaatcagaaatcacggttttgctaaaaatggtttctaggcttacacatggataatgaggcctttgactgtattagatttgcaaaaatagtagttgtagaggtaacatgggaccagaaaagatggctctatttcataaaagaaaggggcaaagtgaagggactcattaatgtcgaagcagtagatggataaccagtgacaaatatcaagtagatttgcttcagtttggtcagagaaaggtcattgattatttttggttaaactggttcacagaggccaggtctccactaaaaaagggaattaattgcttccatttcccactaattgcctcaatatttccctttgctttgtcattggagatttggtcagagaggcgaaaagtcaaaagtcagagtgtgatggaatctacataaaaagggaatctgaggagaccaaattatggcatttggtgtaataatgataatgatatttagcatttttccctgggagtgctgtggatttttagagcccttttcaatctttaatcagaccatagggcacatttaaaagagttcactgtttttatttccatctagaggatatggcatcacagagagatgaactgacctagggcaagtctcttgagatgttcatgctgtatgttagattacaccctctgagggtgagttttagcgggaagcctaagttctttccagaggttcaattcattcatgctccttcagagtctttagtttttttgcacaatattgtaaaagagttctatctctatcaatgaccaaaaaatcaccgaagaaaacactatgaaatcagtttgatatcacaatagtttctcagttttcaggatactaactggtgcttggaccattttcaagtaacaagacattctatctttatttgctgaattaatcagtctttgaattcttgtatacctctaagtactttggaatacatgagtcttatctttcagatattttgttttattgttttgaaatccaaagtggcactgcagaaagtggaaataagattggtttctggatgtgatagataagtattgaatcattctagttcttttgatttacttacaataacttcagaggcctaatagacaagtgtctctctttaggaagtcatgaacttacaatataaaccactcttttttttttttttgctggaagaaccagaaatttgttattgttaattagctatttgttatattacgggctcttaatagattttaaagcaagctggttacattttaattttaaaaccagctctgccataatcagctgtttgatcacagacaggtcatataatttgattgaaactcagtatcttcatttgtaaacctgatctacctcacggggtttcatggttattaaatgagaaagggagggtaaaacgtatagttcaatgcctgtatagaatggtaacctggcaactttagcctttatgctttttagtgctgcttttaaataaattatgaagatattaaagataaaactattaattaaagcaaaacttaaacataagagacctgtaaaaaagaagtcgaatacattacaaaatactatatttgaacaagatgctctcatagttatggtgaacttgaactgggccatgcctctacatagctagtgttccttaccctgccctgttgaaaatattttactaacatttaatcacttagtaatcaaaataactctgagaattgagttgtttaattttattcattataaagataaggctacttgacatccaaggaaggaaatatgtggctccaaggcatatagcttgtcagtgggagcccaggtttgaaactaggtgggctaattccaaaatctgcaatcttaaatgctgctcaaacaatgctttttaacatgcattagactgcatttcaaggttgtcatttgtgaaagctgagaaattacattgccctcaccctcatttttaaattaaggggattcttaaaatttctctttctcttgacaaaaatggctgtttaagaatggaaaaccgctgccaacaatggcatcaatgtcatcaaaccctccactgagttctaagtgtctttttataaatctccaaaaatatggtgagcccattcccttatctctcccttgttagaggacacatgtctcagacctctaaccaggacatgtcaagaggtgggcacgcgggtacttccacagtgcttttctcctggccaccccttccccttgtgcctttcatagctctcaggcagggccgataagcctgttctccccagtgctgaatctgaggaccaactctggggggagcccttattgtcaaactagttgctcacaactttcttgacttgtttctcttaaacaatatgacttaataaagctcccttcaaatatataaacagagcacacctactaaaacaggaagagctaaaactgtatacattggaaacctggtttgactgttctgatgaacttgactgctcaagtcagtcaaaaagtaattaccagttaagaaaaccattttgacagattttggcccactgactgcttatttgactggcttgcctgtcaggttgaagtggtcagattgactggagacagtttaactggaaaatttaactttggaggacgtgggtgtctgtataccagaatctactttaaataactgtatttgaaatctatacctattttcttgggaccagtgagagaagtctgaaagtgacacattgcagctttgactttctggagtgagatgtctcattgcttgctagagctgacaatgtatttataggctacaacaccatcacatttttcccctgtgcatatacagagttcaagaagtttgaaactctaccctgttgtggccaagtcctaataaggcattatcctcttactcttctgaagcactgataatagatttataacagcaaatgacttctcagatattgggttaccaattcagtcatttgtaacttgtggtaagcaaagtcgaccttgcctttaatggtagtgctttttaagaagaagctatgaaagaaaacaaaaacaaatcccaaacaaaaccttttatgagaggaaagagaatttggttggaattattatttgcatggctttttaaaaggaaatgcttttatatatcaattcttatgttcctttagaaaatgtactttcatataagttcccaggtttgggcaagacaaaaataacaccataaggatggaaggaatgatttattctcacattatagtgttggattttatgaggagaacataatgaggttattgtctgttgtaagcacatttttataaagtctgttttatgttggctgaatattctaatgtattcatattgagagtttgaaagatcctgttattgtttgagagtcttattcatgtgctgctccttaatttgcctaaaattttaacttttcctgtgaatatgttttctaaatgttcaggacttagatgctatctcctgtacttaaaaaaaaaaatccaatggtacgattagatagattttagggctacagtgtcaataacaactttaaaataatgacacttttcttaaaattgctaagcagtaatattttctcttagagtcactttacgtattctatttaaaatttttgctgtgtgattacgacaaggaaaggaaacatgttagctttgctttgcaggtttatgctttctaattatattatgattgtttttagcaaagaagccctttgacctgaataaaagagagaactaaatcgaatcccacagtttaaagaatgctatagggagaccactagggtatatatttaaattttatgtgttatttacattatagaatcattattaataatgtttcagcgatcatcttgttgcttcaaatcttttacacattcagaactattttctttagctataaaaatgtactgtccaaatttatctccctaccagcaactcacagagcctattggattgctccctcctctgcacaaggtattctcatttagaaaaaaaatgttaatttggaaagcaaaagctttgttttcataattactaagtgattaggaacaaagactcagtagtgagtagtgagtgtggatttgaattatcgttttgcttcagaagtccttaacctatcctctggccccactttctcaggcattatgtagtatgtagagaataaggtggctcacctcactggcttgctgtgaggattaaatgaagcaaggcaggcagagctctaaataacatgcctgacacatagcaaactttcagtaattattagcaattcatgctattattattaatatatttttaaaattgaagagttcaccagaatagaagtagacttggtttgatttttagattaagcaagttattgaagttagcacacaagttgcttaatctctctgagccttagttagctcatcaataaaatgcatcaaataaggaattctaatcataagggatcagataagagattatagaagggattagataagccagtggttaagaaagtgctctgtaaatagcaaaatactgtatgggtgtcttatttgttcttttcactgttctctttggattctattccacttgtctgcttgtttcataatcttggggctgtgtagcaaaatattcagtttcaataatagagaacactcacataaattgtgtcaccagtggtgaaaattattaaatgatggaaacatttagaaaccaaattatctgtgcaatacatcactgattttttatttagtctgatgaaaacattgcgcttaaagttaagaagatggctgccattttgtcattgtaagatagtgtgtaagccttaagaaagaggactaaaaccatgttggatgctgcaacctttgggaataatttcccattgagaacaggaagtatggttggtagacaagtttaccaataaatcttttgtgatagaatatacaagcacggacacttatgagaatgttgagtcattcctttagagaattagtgagcaattgaagggaaagatgaaattgttgtaaaagttaacaagggtagattgaggggtgccttgtttcctaggcccaggagctttcagagtgatccagtgtttttggctggaccatagctctcagtcttccagctctcttgctctctctctctctatacattctctttggtctgatggagtctcctaatccattggctatttttttttcctcactctttggcctgcccattgctcccttccacatccagcctttaccttttcttgtgatgattaaatcagttcttataattagagtcacttctggccctgttgttctgctttacctaaccatccatgaccagtgcagcctatcagctcagcctccaggctgctgtggtggaagatagtcccacaacaacttgcagattcttgcttttacaaaccagtgagtggtcttccatctcagttggggcctctaccttatccagctggcattgttttagcccattatcttccattccatttggtatatttggtacatttcacttctctcattcaacctcatacttcatcatttctccccatacactcaatagacgaatttgcctatgactttattgggaaaatctaataaaaacttaaaatcttcaacttcctccccagaaatctaaaatgtccttatgagcctcagctctattttttctcctctttcacagaagtagaatgatcttcccaaagctagattccttgtgttaggtctcacttacacctgttttttcagtcacttacttaattagtcaccctttcttgcttgtatcttctacttcaatccaataacatgttagcctgtgcatataaagttggtaaagcttctccatttataaacacacacactcacatacatccattaaccctggagccatctgtaataactgaagtccccaaaatttctctttctgattatgatcaggcattctgaaatctttaaagcagatgaagagtatgaactctggaatcagacttcctgcattcaaattctggctctgctagctatgggtcctttggcatattacttaacttctctttatcttagtaaactcatcactgaaccaggatagtaatagttcctagctcatagggctgttggggagattaaaagattaatacatgtaaaacatgtgcaataggtcttgacatctataagcatttaatatgtggtagttattaatactatattattattattggcttttttcctcattcactgatttgttcatttaattaatatttattaagaacctaatatttgcccaacactggatgtccaataataaataaagagagacaaattgcttgtcctaaagcagcttagaatgtagtcagtaggacaggtaatacataaaaaaatgaataactaattacaaaatgccaatactatgagagttcagaaacaaaaatatattagggaaggacctatttaaacagtggttagaagacattgtaacctgttcctgaaaagagagaagccatgcttttgtagaacccaagaaagagcattccaggcagtagggaaaagcataaatggaagctgtattgggggatagtgtttgtcttattgcagtaactgtaaaagtccagtatggctagaccacagtaggcataggagagagagagtggtatgggaagaagttggatagatagttgggtgatcacctattcaacacgaaggtcatggtacggaagctggatttcattctagataaaatggaaagtgccgggtgtggtggctcatgcctgtaatcccagcactttgggaggccaagatggacagatcaccaggtcaggagttcgagaccagccggccaatatggggaaactccatctctacgaaaaatacaaaaattagccagctgcggtggtgtgtgtgcctatagtcccagctactcaggaggctgaggcaggagaatcacttgaacccgggaggcagaggttgcagtgagtggagatcgtgccactgcactccagcctgggtgacagagcgagactctgtctaaataaacagacaaaaaaacatggaaagcaattgaaagattttagatgggagaacaggtgatccattctgtgattttaaaagtacattttgaaggctgtaagaagaatgattggagagggttggaggaaactggaagattagtagtgaaggattcacagtatgcaatgatggtggcttggactagagctctggtagcagaggcaaggatggttctatttgagacatagttgcaggttagagtggatggtggagttgtatgttgggggtaaggaaaatgaaggaataaaggaagactagtttctgaattggacaagactaaggagtagcaggttttaggagaaataataagtgcttgggacatataaattttaaatattgagatgtttgtgattatatagagagataggtagatatagtacatagtagtatataatacagatagtatatcgtatataaagctgggtgtcctatataagatatgctatgtacatatagaatattatatactgtatgcatatactataactatatatatccaatatactatatattatatatactacgtagctgggcctcctagaaaaaaatgtgaaaattccagagcagaaacataactttggaatttatgttatattagcatgtacatagtattttatctgtgggaatagggcgtgtcattcacatggaaagtgaatagagggaggaggaggtgcttagtgctgtacctgtggcacccccaattcactgttcaagtcactgcatgtgagcttccatcctcacacagagatagggaacagaaatgcaaatttgggagtcattagcatatagctggtatttaaaaccatgagcactgatgagatcctctatgggaagaatgtggagagagagaagaaggtgcctagtctgagccctgaggtctcctcactgacagttcacaaagttcctccaatccctgcaggctgatttctgttctcgccaagtccctgaactaattctcctgaggcttgccagtgacccagttatttctcagtctgctggggatatcttctgctccttctcttccctcatccctgaggcatttgattttgttaaccacttttttcttgaaactctatcctacattagctttgtgatggtgttctgtcttgactttccttgtgtaatacttttttgagattcttttagtctctcttaccccttggatattgatgctcctcaagtcctttacttaacattctgtccttctaaatctaattcttcatcctgagtgactttatctaaaaccctgatgcagtggcttctaaactggccaccacgtttgtgtctctaaatctgcacatcttagctgtgaactagaccttccccttacatgttccacaggctctcatttcattaagcccaatgctgaattcttcttctttccttcaacattttgctttcacttctattccttattttggtgccatcttcttcactatttcccatttcatctgaatgcataatatgtgaatcttcctttcccttcatcgtggtgtataaatcaatcagaagtcttatacacattttcctttaattcctatatattatcggtaatatttggctcacgaatcttcttttttctttttttcgtccttttacccagtaaggtctttcaataactccccctttatattattgcctgagggatatttctgaaatgctaattgatcacattattatcctactaaaagcctcaagtgtgtcatcggggctgtaagaacaaagcttagggtagtgcttgtacttccttatggatagcttctgctttcttttctattgtaatttgttctcatctacactttcttcagatcatgctgagaaagaaagggagaaaaagagagaacttttttcctttataacttctactattagagcatttaataacattgagggattgattaaaggcattagatttaggaaactgacctttgtcagaattttcctcaagttacttcagttatgatggggaaataccatggcaccagcatttccaggaaacgtgtttgatagaaaccatcagcaaaatttcaggtgctataagaatgagaaaataaaactcagaattatataattctaataatttataattatattataaatataatattgataatgatatataagtatatattagttttctattgctgctgtaacaaaattaccacaaactcagtggttaaaacaacacaaatttattatcttacagttctagagaatagaagtttgaaatgagtttcactgggctaaaatcaaagtatcaggagggtttagatccttgttggaggctctagagaaatatgtgcttgcctgcgttttccagcatctagaggctgcccacactgattcagtgttccacatcactctgatacctacttccacagtcacaccttctgtttgattctggtcctcctgtcaccatcttataagaacccttgagattatattaggccatgcacgataatccaggataatctatccatctcaaggtctgcaacttaataacacatacaaaactccttgtataatgtaaatttacttatccacaggttctagggtaagatgtggacatctttggtggggaggtattattttgcctgctacagagaaattgcaagtaactggaaaaaagattaaaaaggctaaaacaaatatactttcaaaaatatttttgttttaatttgtaaattttcaatgaattttttttcttttttaaagttggtttgtaagctcaaattagtatggaaaacagaattttgggtcctcctctatgaagttacagtaaaacattttccatatattccaaagctacattatctagtatttttattttctctgtatctctcaaaagtatttgacacagaggaaaaatcgtacaaagaaattttgtgtcattttagttctttccaacattttatatgcacttattcatttcttaaaattatctctcaaaaaatagcataatcatgatatttatgcaggataagccaagctgaaaataatattattttctgcctcctgctccctctctcctttttcattcttctttcttgtgaaagggaattagaggtttttcaggaaatcaaacattaagataacagtaaagatgatctcaagaaactaaaatttctcctggagaagaaggctgggtctgttcagtgtatatttattacataatctagggactaaagtggaagaaagcacctaaaagaaataaaacactcatctaaagttaatattttctgatggtagatttcaattgtaacattgtcctgtactgtatgaagaacctagatcttgcagcatatggtgattacaaaacaaagtgaaacacaagacacaacaaaaagtaatgagtgactatgtcaagttccacctatatttggaaagcaactccaaatgatttttctaccagaaagtgaggtcagttgattcatatttgtttgtttatatagaacacatttttttcccctagtaatgaggactggatttaaatttcattatacttattaactgataataagtaacttacagttgaaagaataccctattacaatcaaaatacatgcaatttagttcacttgttgcttgtgtgattgtgaacaagtctgataattcatctgaggtccagtattttttaatagatgaaatggaagtacaagttaagtcactggaatgctcacctcatgactgtggctattgttttgcattctgaagctttcagttagtccatgaggtcctgtgatcagtcttctcaatgaattgctcctccattttaatgttctttttataactataaataatttaaatcaaaagtgtgcttctttaattccaaagaacattgttgtttagttacaaggggaaaatgcagctatgacaaccatgtaactgaacacctttcctacacagaagcacagtacttgaggaatttgattgatgtagatgccaaaataacaggtgcatttaaaacccaaaaattcaagaataattgcatttattagttaagtaaaacaaagacaaggtatattttaccttttactcagaaatactggttttatctaccaaaattgagtgatagaaatgtacttaggaaagaaacccattttctgcagtttgtcaatcaaaatgaataatctaaaagtctcattttcaattagattattttaatatttaactacctaaaatgccccaatcatattctttagaaaatggttagactagaatactgcagttctaatcatgacattttattatgataaaaatgacttcattaattgatgatcatatatcaacccataaaataaggatataaaaagttttccagcctaagatagtataagaccatttgaattgtttgggtttttttttttttttttccagaaataaatctttataatccttttattcttatgaaaatgtataagtttctttgttataaattcaactatattttctagccaatgaattcattttttaatatctgaataggctgagaatacattgatattccatatccagcattaggatataatacaacaataaatatactgtatttgcaacagaattttataagagatggcaaacactatagtaagttttgggtttttatcccagatgttcccatttatggctttagatctattttacagcatgtagatttttttaaaaagtgcattgatgactttccagatatttgaaatatgaccttttaaagaaatcagtcttgtttctcctttattctctgcatccttgaaagaacattcacaacttcataatgaaaatgatatcaaaaggtcactatactgaggatggaaaacagtacatttaagcatgacatgagagctttgttttaacttaaaagtaactgtgaagtgtaaaacatcatctaaacacaattgttgatttctgaagcaaaatgtcttttgctttataaaagccttcttaataaatattaatgtttaaactctaatgcaatcagatgaacttttttgaatagaaatttaaagaaattttactgaatctaattgaagtaattaacttgtacatttccacctttacaggaaactattgaattgtagagggccttaagcttctaaaaagcatataaactgtaatattaacttatttaaatacagttatgtgtgagtccaatttgcatttctataaaggaatacctaaggctgggtcatttacgaagaaagaggtttattttggctcatggttctgcagatcctacaagaagcatagtgccagcacctgctttggctgaggctgcagggagcttacagtcatggcagaaggggaagagggagcaggtgtgtcacatggcaagagagagaaagagagagaggaggaatttccaagctcttttaaacaactagctctgttgtgaagtgatctagtgagaactcactcattatcatgagaatagcaccaagccattgatgagggatccaccccctgaccaaaacacctcccactaggtcctcctccaacactggaggtcatgtttcagcatgagattgggaggcaaatgtcaaaaccacatcaatccataagttctaaatataaatatgcttagtaatataaccatataatattgttaatacctggacaattaattcttattaaaagaatatatatttcattcattcagttggtctgttgaattggaaaggacagttcttcatactatttcttcaatagatagcatacaatcaatttgaattttaatttttgatatactataatttataaaaagaataaacaattttatatacagggaagtcttaaaaataactgtggagacctatttgagttttatgatatcatgacaccttatgaggtcatgaaattaaatgagatattatatattcaaagcatgcaggatagtcttttccacgtgctatttactcaataagcaaaaagaggtgcaaaatgtgttatccaaaatcctagggttagatgtgttttggagttatcaatattttagatttagaaaagtaatatggtgcaacattattacttgacacccccagaagggcctaaggcagcatcccataatctaacatattaatacatctgcagcaaagcatacgaatatttactctaactggaataaagaaagactgttaatagcctttatctcctggatgattttatcacctaatgggcttgtgccaatttaaaaaatccttctggttttcagagctttttggattttagagctgcagataaggggttgagaactgctaatatgaaagttataatagtgttggattaggaaaataaaggttttctgtatcaaagggttgaatgcataatttctgaaatagggcaaactaataattatttaattaaggttaacttacctgacagtgtaacacgcacagactttaaacaacaattttgcaaaacacgcaaaaaaattcaataaggagaagggggaaaaataaagtttaatatcagaatagattttcctatatgtaattagaagttaggaatccatcatatttagttctaagccttcttgtcttctaagtaggttcttccttcaatgtccatctcacctgtcacttaagtgtggatgtcatataaattataatggaccatacatcacttccaagttccagacatacgtctagctacctatttcatttcccctcctggacatcttcaaggcttcaaaaattcaatatgtttaaaaccaaattcatgattctctattctttcttgaacaccagtcttctcagtaaaggacatcactatccattcagttacttaagccaggaactcaggtgtcattccttaatctatttctaaacatctcttgaatccagctatttgtctccacatcacaactttaccctcaccacatgaccctcattcaagtaatgcttttttctttcttggactccctcatttactcttcagcatttatctgaataaacttttatttgcccctccctttattaaagaaaataagacacctttatatagctaaaggattgcatgggctggccctactagcctctacagcccctttggaccatgtcattatttttctgctctagctccattatcctttcagtgtgtttttctccccttgcttcctttcaccacaggatctttgcatatactgctccatctctccgaaatgctttttactatactcttgatgtagttacttcctgttcacccatcctgtttgagccctatcatcccatcctttgggaagtcttccctgacctctgtgtagacaatgtccttttcctatgtgctcaaagtcatgtgcatttctccgtcctatcatttatagcacttaaccatttatagtcatttgtgtgattgattaaaatctgtctcttccacctgcccataagctacatgaggagagagaccatgtttgactgtgcctaccactctgcccactcaagtgcctatcgtatataggcatgcatatatttgttaaatgaatcaatcagtgaatttactagcaagaactgactttcacttgaatgacttgttcctattttatctagtttctgcttggttttatgacaccttttaccttcaagggtttgccacattgtgttatagttatatgtttaaatatttatctcccctaatatactgtgaattctttgaagagtgggttatatctgttttgtttcattatatctccagagtccattgcagtaatatgaaacatgatatgtagtagacactcaaaaatatttgcagattcaattaatgctaaactgtgagcacagtgtcaagtgtattttaagtatcattacttacattttctgaatgtttcacattaacttattttgattattgatgatggggacagttgactttagtatgtgcatggctgttgtattgttttgaggccaaaatgaagttgacagtctctgtcttaattcaagtttacatcttaaaaaattactcatacttttaaaaaatggatcagcctaaacaaaccatggttattgctggtattcattttatttattttaaaggtataacatggtaattttactgagaaactattataaacaaatcaatgcatgtataaatggaggtagatgaaattgtaagggaagcttagactttatagaccaaattcaagtgttcgtcaagtgcaagaattttactgctagaacaccattgaattagaaaaactctgcttaataatactcatgtctttttagtcttttaagtgtggatcttttctcaaagacacaccactggaattatccaaattcaaatgattgggactgaaggaatatgttacaatcacattttatattattatccattaaatagctttggattatataatacgcagctgaaatatgctgacagttattcagaaacctaagtaaaacttttgatgaaccgggctctactttagttcagtagttatatctcaatcagacaagctcgactgtataatttaagttttagtcaagatgagatttatgggtatatcatatccacagactgctgtgaggaaagaaagatttgaagaaatgagttattaatctttactgcagaacattaacaaatgtcatgtggcttttatgagttggtacctaggaggtagtagtttcataagccccccaaaatagatttcctcttatatacctctgataccaagaacataattaatagttacctattattcacttgtgaagctcagagttttagttcatttattaaattcaagcttagtatgaaattaacaaaattaaataagggctgtcatattataatgaatggaatggtcttgctttttgatatgtatatgtgcctatgtgcatgcatgtgtgtatgtatttggtgatgttgtatatgtttttatttactatcaccaggtaattacttagaataaatctaattctgcctgtaaatatttctgttcgtattcttgctgatggtttaaacaggcttattaggtaggcacccatgtttgctttggtaatttgattggctattataataacagtgataaaaaatcttgttattgagataattgcctgtctgatgtttgccatcactttttagttttgagtttcaaaaggccagtacccaagaagcggatttatctcctcccaggttctttgccctcagtttagataagtggtctccaggtgggtggtgacatataggtcacagccctgctttctggagaggaatcactttcccttgggactggttttaacaaagcacaaactctcattaaatgtttgctgagtgaatgttgaaagaattagctgagggcttttaccattattgtatgctttctgtatagaaagataatattttaaaagaagctaaaatgaatataatcctacataaatatgaattacatttaaaagcatttgtatgatgttatcacaatatttaaggagatatgatgcaagtagacagtcttatacaatagagaatcatggggttgatggcatccttcacaatttttttgctgcaactacccacttgtttcttaaatttcttatacaatatgctgtctctactgttattcacctagtaggatctgaaacacatacaagaactaagtcaaaagactacagcgtagaacactagaaagtaaatcgtgggaataagtcacgtatttaggagcataatttgtaaaccattttgtgaaaataatcatatctccgtgtgggggcatgaagaacctttctagccagcattgcttggctggcccacattattccacaactcgctccactaccaggagattttaaaattcaaatgcaaataggtaagttaataacatttagttaatcttaattaatttctgactaaatctttggtgatttgtagagttgaaccctctgagactgatccaaacttggggatgtcaaatcagataccaaataccctgaaatcatctttgtgttggtttagctgctattatcagagagtgatacctgacttttttctatggcctaggttgctttcccatggatctctatcagttctctcagtagtcagaactcctgcattaatttcctgtctaaaaaaaagatagaaaaacacaaaaaggtaaaaccgtagatacatacattttgtatatgtaattgtattggcccgttctcatgctgctggtaattacacacccaacactgggaaatttacaaaagaaagaggtttaatcgacttacagttccgcatggctggggaggcctcacaatcatggtggaaggtgaaagacacatctcacatggtggcagacaagagaagagagattgtgcagggaaactctcccttatgataccatcagatctcatgagacttactcactatcatgagaacagcataggaaagacctgccccatgattcaattacctcccaccaggttcctcccacaacatgtgggaattcaagataagatttgggtggggacacagccaaatcatatcattctgcccccatccctcccaaatctcatgtcttcatatttcaaagccagtcatgactttccaacagtcccccaaagtcttaacccatttcagcattaactcaaatgtccacagtccaaagtcccatctgaaacaagccaagtcccttcgcctatgagcctgtaaaatcaaaagcaagttagttacttcctagatacagtgagggtgcaggcattgggtaaatacagccattccaaatgggagaaactggccaaaaaaagtgggctacaggccctatgcaaatctgaaatctggcagggcagtcaaatcttaaatttccaaaatgatctcctttgattccatgtctcacatccaggtcacacagatgcaagaggtggattctcatggtcttgggcagctccacccctgttgctttgcagaatgtagcccctctcctggctgctttcatgggctggtgttgagtgtctgaagcttttccaggtgcatggtgcaagctgttggtggatctaccattctggggtttggaagatggtggccctcttctcacagctccactaagcagtggtccagtagggactctgtgcggaggctctgaccccacatttcccttctgtactgccctagcagaggttctctatgagggccctgtccctgcagcaaacttctgcctgggcattcaggcatttccatacatcctctgaaattgaggtggaggttcccaaacctcaattcttgacttctgtgcaccgtaggctcaacacctcatggaagctgccaaggcttggggcttccgccctctgaagcaacagccctagctgtaccttggccccttttagtcacagctggagcagctgggacacaggacaccaaatttctaggttgcatacagcatggggaccctgggactggcccaggaaaccattttttcctcagaaacctctgagcttgtgatagtagaggctgcttccaaggtctctgtcatgccctggaaacattttccccatcgtcttggtgattaacattcagctcctcattagttatgcaaatttctacagcccacttgaatttcttctcagaaaagcccatttacttttctattgcattgtcaggctgcaaattttccaaacttttatgctctgtttccctcataaaactgaatgcctttaacagcacccaagtcacctcttgaatgctttgctgcttagaaatttcttctaccagataccctaagtcatctctttcaagttcaaagttccacaaatctctacagcaggggcaaaatgctgccagtctctttgctaaaacatagtaagagttgcctttgctccagttcccaacaagttcctcatctccctctgagaccacctcatcctggaccttattgttcatatcattctcaggcttttcatcaaagccattcaacaagtctctaggaagttccaaactttcccacattttcctgtcttcttctgagccctccaaactgttccacctatacctgtcacccagttccaaagtcgcttccacatttttgggtatcttttcagcagtgccccactttactggtaccagttcactgtattagtccattttcatgctgctgataaagacatacctcagactgggcaatttacaaaagaaagaggtttaatcaacttacagtttcacatggctggggaggcctcacaatcatagtggaaggtgaaaggcatgtctcacatggcagcagacaagagaacagaacttgtgcagggaaactcccccttatgaaaccgtcaggtctcatgagacttactcactatcatgagaacagcataggaaagacctgcccccatgattcagttacctcccaccaggtccctcccacgaagtgtgggaattcaagatgagatttgggtggggacacagccaaatcatatcagtaatactgatctccctatgattatgttttttttttttccaaccaggagatggctttttctcttccttaccaactattctcttcattgtacttgcatgaatttgtgtgattctaatttttcttaaaaattttggtttactcaataagcatactgcccctggttctttggttaatggatctaagcattattttaatattggactgtattttttagggaagttttagattcatagcaaaattgagcagaaggtactgagattttccacatataccctgcctgacacatgcctacccttctcttttatcaataaccttcaccagagtggttcatttgtgaatattgacgaacctacattgacacttcactatcacccaaagaccatagtttacattagaggtcactcttggcattgtacattctatgggtttggacaaatgcataaggatatgtattcctcattatactgaacatagagttgttcgtagtattcacttattacccctttcatgttcataggatctgtatagatatttattcttttatttttgataatagtttgtgtcctccctcatttttagttaactttcttagttagctagaggcttattaattttattgatcttttcaaaaaatcatatttaggtttagttaactttctttattgatttcctgttttcaactttattgatttcttctttaattgttattattccttttcttctacttactctggatttgatttgttcttctttttcttgtttcctaagttggaagctcaggttaattttagatttttcttttaacatgtacataaaatgccattaatttttctctaagcactgttttcattgcagctcacaaattttagaatgttgtgtttttatttttagttaattcaaaatattttaaaacttgctttgagatttcttctttcacttgtgtaatgtaaaagtgtgtggtttaatctccaaatattttgagggttttttttagctatctttttgttattgatttgtagcttaactcaattatctgagtgcagatattgtatgattttttaaaatttaatttgtatagtgtcttttatggttcagaatgtggtctatcttggtacatattccatgagagcttgagaaaaatgtgtatcctgttggtggtggtaaatagtctattatatattaaatatgtctgtctgattgatacttttgttgtctttaactatctccatactgattttctgcctgtcggattcaatcatttctggcagaagtgtactgaagtatccacctgtaatagtggactcatttctatctccttgccgttccctgtgtttttggatcatgtgttttgaccttctgtttttgggcatataaatattaaggattgttatgttttttagaatattgatctttttttaaatcatctaatggccctctttatccctaatcacttaccttgctgtgaggcctgctctgtctaaagttaacatagtaattcttgcttttccttgattactgttagcataataaatcttttcccatccacttacttttaattatttaattttttttttaaatttaaagtttaaaaatggtaatgtgagagaggagtgtgaggctgaagggtgctggcctggcctagccctacttttaatttatatatgtgtcatttcatctaaagtagatttcttgttatctgtcttttagttgatgcatttaaaccattgatgtccattgatgttaaaagtggttattaatatatttggattaatatctattctatgtgttactattttctatttgttacccttgttcttgctcctatctttgtcttccactcttttttcgccttttgtggttttaattgagcattttatatgatttcatttgctcttctttcttaacatatcagttatactatactttaaaagaaaatttagtggttgccctagagtttgcaatatacatttacaactaatccaagtccactttctttttttaaagttttaatgtttgtgagtatgtaacaggggtgcatttatgaggtacataaaatattttgatacaagcataaaatgaataataatcacatgagggtaaattgggtatctatcacctcaagtatttatccttgtgttacaaacaatccaattatactctttacttatttttaaatgtacaataaattattgttgaccatagtcaccctgttgtgccataaaacactagatcttattcattatatctaatgatatgttggtatccattaaccacctccagtacccccactactcttcccagcctcaggcaaccattgttctattacatagctcaatgagttcaattattttaatttttaactcccacaaataaatgagaacatgtgaagattgtctttctgtgcctgacttatttcacataacaaaatgacttccagcaccgtccatgctgttgcaaatgataggatgtcattcatttttatggctaaatagtactccagtgtgtatatgtaccacattttcttcatccattcatatgttgatagatccttaggttgcttccaaatcttagctagtgtgattagtgctgcagtaaacatgggagtgcagatatctctttgatatactgatttcctttcttttgggtatataccttgcagggggttgctggatcatatggtgactctatttttagttggttgaaaagcctccaaacttttctccatagtggttgtactaacttacattcccacgaagagggtacaagggttcttttttctccacattctcaccagcatttgttattacctgtcttttggattaaaagccattttaactagggtgagattatgtctcattgtagtttgggatttgcatttctctgatgatcagtgatgttgagcacctttttatatacctttttgtatgtcttcttttgagcacctttttatatacctgtttgtcttcttttgagaaatgtctatttggactatttgcccatttttaattggattattagatttttttctatagagtgtttgagctccttatatattctgtttattaatcccatgtcagatgactagtttgcaaatattttctcccattcaatgggttgtctcttcactttgttgattgtttcctttgctgtgcagaagcttcttaacttgatgtgatcccatttgtccatttttgctttggttgcctgtgcttgtgggatattactcaaaaaataactgcccagtccaatgtcctggagagtttccccaatgttttttttgtttgtttgtttttgtgttttttttgtttgttggttgttttttttttttcctgagactgagtctcgctctgtcgcccaggctggagtgcagtggcatgatctcggctcactgcaacttccgcctccagggttcaagcaattttcctgcctcagcctcccgattcgctggcactacaggcgcacactgccacgtctcgttaatttttttcagtagtttcataggtttaagtctcaatccattttgatttgatttttgcatatgataagagatagggtcatattgtcatttgtttttctgtatacgaatgtctaattttcccagcatcatttattgaagagactgtcatttccccaatatgtgttattggcacctttgtctaaaatgaattcactttacatttatggatttgtttctgggttctctattctgtttcattggtttatgtgtcagtacaatgctgtttttgttactatagctctgaagtataatttgaagtcaggtaatgtgattcctccagtatgttatttttgctctggatagctttggatatcctgggtgttttgtgtttccgtattaattttaggactgttttcttttttttttttctatttctgtgaagaatgtcattagtattttgatagggattgcattgaatctgtagattgctttaggtaatatggacattttaacaatattgattcttccaattcattagcatggaatgtcttcccattttttggtgtcctctccaatttcttgcattaatgttttatagtttacattgtagagatctttctcttctttggttaagttaattcctaggtattttattttatttgtagctattgcaaatgggattactttcttgatttctttttcagatcgttcactgttggcatatattgaaatcagaaatgttactgatttttgtatgttgattctgtatcctgcaactttactgaatttatcagttctaatagcttttttgtgtggagtctttaggtttttccaaatgtaggatcatttaatctgcaaacacaaataaatttacttcttcctttccaatttggatgccatttatttctttctcttgtctgattgctctagctaggacttccagtaccatgttgaataataggcaccttgtgttccagatcttagaggaaaggatttcagtttttttcctgctcagtatattatctgtgggtctgtcctatgtggcttttattgtattgaggtgagttgcttctatattcagttttttgagggtttttatcttgaagtgttcaatattatcaaatgcttttttccatatcaattgaaatgatcatgtggtctttgttcttcattctgttgatatgatgtatcacattattttgcatatgtctgaccatctttttacatccttgggataaatcccatttggtcatgatgaatttttaatgtgttgttgaatttagtttgatagtattttgttgaggatttttgcatcaatgttcattggggatagtggcctgtagttttcttttattgatatgtctttgtctggttttgagatcagagtaatactgaccttgtagaatgggtttagaagttttccctcctcctttatttttcagaaagtttgagtagtattggtattaattctttaaatgtttggtaaaattaagcagtgaagccattgccttttttttttttttttgctaggagacttattatggctttgatcttgctacttattatttgttcagattttggatttcttcgtggttcaatcttggtacattgtacatgtctaggaatttgtccatttctcctagatgtttccaatttattggcatatacttgctcatatcacagtagccctaataatcatttgaatgtctgtgatatcagttgtaatgtctcctttttcatctctcatttcatttatttgtgtcttctcttcttttttcttagttagcctggataaaggtttgttgattttgtttatcttttcaagaaagcaacttttcattttgttgatcttttgtatggtttctttcatttaaactttatttatttctgttctgatcttgcactaatttggggtttactttctcttgcttttctatttctttaagatgcattgttaggttgtttatttgaaatgtttctacttttctcatttaggtgtttatacccataaactttcctcttagtactgcttttactgtatttcatacattttggtatattgtgttttcattatcatttgtttcaagaaatttttaaatttccttcttaatttcttaatttgcccactggtcattcaggagcatatttttatatttccatgtgtttgtgtagtttccaagattccttttgttgttgatttgtagttttatttcattgtggtcagagaaaatacttgacataatatcaatatttttaaaatttttaagacttatgtgaatttttaagacttgttatgtggtctctccttgagaatgatcaatgtgttgagaagaagaatgtgtatattgtagccattgaatgaaatgttctgtaaatatctattaggtttatttggtttatagttcagattaagtctgatgtttctttattgattttctgtgtggatgatctcttcaatgctgaaagtggggtattgaagtttctagctgttattgcattggggttgctctctctctcttagcgctaataatatttgttttatatatctggatgctccagttttggggcacatatatatttataattgttatatcttcttactgattggctacgttatcattatataatgaccttctttgtctcttcttacaccttttttcttgaaatctactttatctattattagtataatgactgttgctatttttggtttccatttgcatggaatatctttttcaatccctttcttttcattctatgtgtatctttatagctaatgtgtgtttcttatagactacagattgttgtgtgtttttttttacttatccattcagccattctatgtttttttgattggagagtttagtccatttacattcaatgttattattaataaggaagaaagtactcttgcattttgttatttttttctgtttgttatgtggtcttctcttccttctttcctttatttctgtcttctttttagagaaggtagttttctctggtggtatgttttaatttcttgctttttcttttttgtgtatctgctgaatgttttttcatttgagttaccacgaggcttgcaaataccatcttataacctattgtttaaataggtaagttgatgacaacttaccactgactgcataaaattttgtttttctcattttaggatcctttctttattcttgacctttggtgtttgattattaaatgtcttaaggtagccttctttgagttagatctatttggtgttttagtaccttcttgtgcttgaatattgatatctttctctaggcttgggaagttctgtgttattacccatttgaataaattttctatccctctctcttcctctacctcctctttaaggccaataactcttagattttccctctggaggttattttgtggatcctgtaggcatgcttaattcttttttattctttttccttttgtcccctctgaccatgtattttcaaatattctgtcttcaagttcaataattctttcttctgcttgatgaattctgctggtaagagactctgatgcgttcttcagcatgcctattgaacttttaacctccagaatttttgcttaaaattatttcaatctctttgttaaatttacatgataatattctgaattgcttctccattttgtcttgaatttcactgaatttcttcaaaacatctagtttgaattctttgcctgaaaggtcatatatctctgtttctctgagatttgttcctggtgacttgtttagtttatttggtgaggtcatattttcctgtaaggtttttatgcttgtggatgtttgttggtgtctgggcagtgaagagttaggtattcattttattcttttcagtccgggctggtttgtacccatccgtcttgggaaggcattccaggtatttaaagggacttggatgttgtaatctaagttcttggtcactgcagtggtatctgcattaggaggcagctaaagattagtagtgctgtggctcttgcagactcatacatgtaccaccttggcggtcttagataagatccagaagaattctctgtgttgtctggcacggactcttgttcttttcccttaccttctctcaatcaaatggagtctttctctgtgtgctgagctacctggatcttggggaggggtgacacaagcacccctctggccacctccaatgggactatgctgtgtcagaactgaagccagcacagcactgggttttgcccaaggcccgtggtaaccattgcttgattactgtttatgtttctctcaagggcctaatgccctacaatcagcaggtagtaaagtcagccagacttgtgtcctcaccctcagggtgatgagatccccctccccatgctagtccagagataccagctgggagccagggcctgtatttaaaaaccttaggaatctacctggttctcttttctactgcagctgagctggcacccaatccacaagacaaagtccttcccactctttcttttccttttcacaagctacggactctcccaaagctattactgccccaggcctgtggtgagtactatctggttggttactcccaatgttcactcaagacccaaggtctcttcagtcagcttttggtgaatgctgccagctccaggactctccctttagtgcagtgggcttccctctggccaagagaatgtccagcaatgctgtctgatagccaagttctggaattgagggccctaagagctcactgggtgctctaccccagtgtggctagcttttacttaagatgcaagacaaagtcttctttactcttccctctccttttctcaagcagaaggagtctctccccaaacccaccatagctgggaatacgttggatcacatctaagccagcatgtctctgagtctcactcaaggcccatcacaagtactgcctgggtagtactgctgattattcagggcccagggtctaattagcattttaaagatcctgccatgactggatccttccctgctatgaagtaggttcccttctggcccaggatgtatctagaaatggccatgagctaggctctgcaatgagggcctcgagactctgccttgttcttatcctattgtggctgagctggtacccatgttgcaagacaaagtcttccttattctttcccttcccctcctcaagcataaggaaagagtctttcctggtgctatgagctgtgctgccttaggttgggggataggtggcacaagcactccctttgccaccccagctgatatctcactaggtcttacgttccccaagtccactggctgtaagctaagcacagcaccaagacttgcttgggaattgcagattttgtggcctaaactgcctttcaagtttattcagaaacccagagagctttacccatggtggtgagacttgcaagaactaaacttctgaccactggaatggacaattcccctccgggtagggctggtctaaatgctccctctgcgggtgccagctgtgttctgccctatgttgctttccactgtgtcaggacagcactgagttccaaagcaaagttccacagtcgctgcactctttctcccccaagagcacagatactctctccgagccgtgtcagggttgggggagggaagatgttggcaattcaagactgtctttcctaccttctccagtgtctctctcagtgatatgaagttaaaacaagatactgtgattgctcacctgatttttggttattatgaaggtgtttttatgtgtggctagttgttcaatttgttgttcctgcatggaggatgattgctggaggtttctattcggccatcttccccatctcctctgggaaatatcttgtaacaaccaaataatattcctaatttctccctcttgccacttgtataattgctgtcattaattttaattattatataagcatacgtaagcatatatatatgtgtgtatatatatatgcatacatagtcaaatgccttattattttatttttgttttttttaatatactttaagttctagggtacatgtgcacaatgtgcaggtttgttacatatgtatacatgtgccatgttggtgtgcggcacccattaactcatcatttacattaggtatatctcctaatgctatccctcccccctccccaccccatgacaggccccagtgtgtgatgttccccaccctgtgtccaagtgttctcattgttcaattcccacttatgagtgagaacatgtggtgtttggttttctgtccttgaaatagtttgctcagaatgatggtttccagcttcatccatgtccctacaaaggacatgaactcatccttttttatggctgcataatattccatggtggatatgtgccacattttcttaatccagtctatcattgatggacatttgggttggttccaggtctttgctattgtgaatagtgccgcaataaacatacgtgtgcatgtgtctttatagcggcatgatttataatcctttgggtatatacccagcaatgggatggctgggtcaaatggtatttctagttctagatccttgaggaatcaccaccctgtcttccacaatggttgaactagtttacagtcccaccaacagtgtaaaagtgttcctatttctccacatcctctccagcacctgtcgtttcctgactttttaaatgattgccattctaactggtgtgagatggtatctcattatggttttgatttgcatttctctgatggccagtgatgatgagtctgctgttggctgcataaatgtcttgttttgagaagtgtctgttcatatcctttgcccactttttgatggggttgtttgattttttcttgtaaatttgtgtgagttctttgtagattctagatattagccctttgtcagagggataggttgtaaaaattttctcccattctgtaggttgcctgttcactctgatggtagtttccattgctgtgcggaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccaggtttcccagcaccatttattaaatagggaatccttcccccatttctggtttttgtcagttttgtcaaagatcagatggttgtagatgtgtggtattatttctgagggctctgttctcttccataggtctatatctctgttttggtaccagtaccatgctgttttggttactgtagccttgtagtatagtttgaagtcagatagcgtaatgcctccagctttgttcttttggcttaggattttcttggcagtgtgggctcttttctggttccatatgaattttaaagtagttttttgcaattctgtgaagaaaatcattggtagcttgatggggatggtattgaatctataaattaccttgggcagtatggccattttcacgatattgattcttcctatccacgagcatggaattcttccatttgtttgtgtcctcttttatttcatggagcagtggtttgtagttctccttgaagaggtccttcgcaacacttgtaagttggattcctaggtattttattctctttgaagcaattgtgaatgggagttcactcatggtttggctctctgtttgtctgttattggtttataagaatgcttgtgatttttgtacattgattttatatcctgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgtttgtcctggccagaacttccaacactatgttgaataggagtggtgatagagggcatctctgtcttgtgccagttttcaaagggaatgcttctagttttttcccattcagtatgatattggctgtgggtttgtcataaatagctcttattattttgagatacgtcccatcaatacctagtttattgagagtttttagcatgaagggctattgaattttgtgaaaggccttttctgcatctgttgagataatcatgtggtttttgtctttggttctgtttatatgatgaattacgtttattgatttttgcgtatgttgaaccagccttgcatcccagggttgaagcccacttgatcgtggtggataagctttttaatgtgctgctggattcggtttgccagtattttactgaggatttttgcatcaatgttaatcagggatattgatctaaaattctctttttttgttgtatctctgccaggctttggtatcaggatgatgctggcctcataaaatgagttagagaggattccctctttttctattgattggaatagtttcagaaggaatggtaccagctcctctttgtacctctggtagaattcggctgtgaatccatctggtcctggactttttttggttggtaggctattaattattgcctcaatttcagagcctgttattggcctattcagggattcaacttcttcctggtttagtcttgggaggttgtatgtatccaggaatttatccatttcttctagattttctagtttatttgcatagtttttatagtattctctgatggtagtttgtatttctgtgggatcagtggtgccaccccctttattattttttattgcatctatttgattcttctgtcttttcttctgtaacagtcttgctagcggtctatcaattttgttgatcttttcgaaacaccagctcctggattcattgattttttgaagggcttttggtgtctctatttccttcagttctgctctgatcttagttatttcttgccttctgctagcttttgaatgtgttttctcttgcttctctagttcttttaattgtgatgttagcgtgtcaattttagatctttcctgctctctcttgtgggcatttagtgctataaatttccctctacacactgctttaaatgtgtcccagagattctggtatgttgtgtctttgttctcattggtttcaaagaacatctttatttctgccttcatttcgtcgtgtacccagtagtcattcaggagcaggttgttcagtttccatgtagttgtgtggttttgagtgagtttcttaatcttgagttctagtttgattgcactgtggtctgagagacagtttgttatattttctgttcttttacatttgctgaggagtgctttacttctaatgtgtggtcaattttggaataagggcaatgtggtgctgagaagaatgtatattctgttgatttaaggtggagagttctgtagatatctgttaggtccacttgatgcagagctgagttcaattcctggatatccttgttaactttctgtcttgttgatctgtctaatgttgacagtggggtgttaaagtctcccattattattgtgtgggagtctaagtctctttgctttatgaatctgggtgctcttgtattgggtgcatatatatttaggttagttagctcttcttgttaaattgatccctttaccattatgtaatggccttctttgtctcttttgatctttgttggtttaaagtctgtttatcagagactaggattgcaacccctccttttttttgttttccatttgcttggtagatcttcctccattcctttattttgagcctatgtgtgtctctacacatgagatgggtctcctgaatacagcacactgatggctcttgactctttatccaatttgccagtctgtgtcttttaatgggagcatttagcccatttacatttaaggttaatattgttatgtgtgaatttgatcctgtcattatgatgttagctggttattttgctcgttagttgatgcagtttcttcctagcatcgatggtctttacaatttggcatgttcttgcagtggcttgtactagttgttcctttccatgtttagtgcttccttcaggagctcttgtaaagcagacctggtggtgacaaaatcttcagcatttgcttgtctgtaaaggattttatttctcctttatgaagcttagtttggctggatatgaaattctgggttgaaaattcttttctttatgaattttgagtactggcccccctctcttctagcttgtagagtttctgtggagagatcagctgttagtctgatgggcttccctttgtgggtaacctgacctttctctctggctccctttaacattttttccttcatttcaactttggcgaatctcacaattatgtgtcttagagttgctcttctcgaggagtatctttgtggcgttctctgcatttcctgaatttgaatgttggcctgccttgctagattggggaagttctcctggatgatatcctgaagagtgttttccaacttggttccattctccccgtcactttcaggtacaccaatcagatgtagatttggtctttttacatagtcccatatttcttgatggctttgttcatttctttttactcttttttctaaacttctcttctcatttcatttcattcctttgatcttcaatcactgataccctttcttccacttgatcaaatcagctactgaagcttgtgcattcatcacgtaattctcgtgccatggttttcagctccatcaggtcattcaaggtcttctctatgctgttcattctagctagccattcgtctaatctcttttcaaggtttttagctattttgtgatgagttcgaacatcctcctttagctcagggaagtttgttattaccgatcttctgaagccttcttctctcaactcctcaaagtcattctccatccaggtttgttccgttgctggtgaggagccgcgctcctttggtggagaagaagcgctctgattttagaattttcagcttttctgctttggtttctcccgatctttgtggattcatctaccttttgtctttgatgatggtggcatacagatggggttttggtgtggatgtcctttctctttgttagttttccttctaatagtcagaaccctcagctgcaggtctgttggagtttgctggaggtccactccagacaccgttttccttggtatcaccagcagaggctgcagaacagcaaatattgcagaatggcaaattttgctgcctgatccttcctctggaagctttatctcagaggggcacctggctgtatgagatgtcagtcagcccctactaggaggtacctgccagttaggttatttgggggtcagggacccacttgaagaggcagtctgtccattctcagatctcagactccgtgctgggagaaccactactctcttcaaagctgtcagacagtgacgtttaagtctgcagacatttctgctgccttttgttcagttatgccctgcccctagaggtggagtctacagaggcaggcaggcctccttgagctgtggtgcactccatcaagttcaagcttcccggccgctttgtttactacctagtcaagcctcagtaatggtggacggccctccccaagcctcgctgccgccttgcagttcaatctcagactgctgtgctagcagtgagcaaggctccgtgggcatgggaccctctgagccaggcatgggatataatctcctttggaaaagcgcagtattagggtggtagtgtcctgattttccaggtactgtctgtcatggcttcccttggctaggaaagagaattccccgaccccttatgcttcccgggtgaggcgatgccccgcccttctttggctcacactccgtgggctgcacccactgtctgacaagccccagtgagatgaacgtggtacctcagttggaaatgcagaaatcacctgtcttctgcatcactcacgctgggagttgtagactggagctgctcctatttggccatcttggaacctcctcccatgattgccttattattttaaatacattaatgtagatcaatgaagaataagaaaataagcaattttattttaccttaatttattctgtttctgatgctctttgtctctctatgtaggtctgactttttgacctacattattttctttccctcctaggaatttttaaaagcatttcttgtaaggcagggctactgaaaacaaatttcctcaatatttgcttgtctacaaaagtctttatttctcctttaccttttaagggaaatttcacaacctacagaattctaggttggtgggttttttccccctcaatcccttaagtatttaattcctctcttcttgcttgcatggtttgtaaggaagagtcagatgtaatttttatctttgcttctgtatgggtagggtgctttttcttctagattttttttccagagtttttttctttatctttgattttctgtacttcaaatatattatgcccaggtatagattgttttttgttcttgttttgttttcatttggcatttgttctgcttggtgttctctgagcttcctggatctgtggtttggtacattatattaattgaagaaattctcagtcattattgctttaaatattgtttctgtttctttctccctttctcttcccttgggttttcccactgtgcacatgttacatcttttgtcattgtcccacagttcttagatattcttttttgtttctttttttgtttttaagctttttctttttgcttttcagttctgtagtttcttgttgtgaaatccttaatctcagagatccttttctcagtcatcttcagtgtattaataaactcatcaaaagcattcttcatttctctacagtgtttttgatttttgtattcctttttgttttttttcttggaatttctatcactctgtttgcattgcccatctgctcttgcatgatggctactttatctattagcatattaatcatagtttttaaaaaattcatcctggtctgataattttaacttccatgccatatctgagtctggttataatgcttattctgcttcttcaaaccatgttttttagccttttagtatgtcttgtaattttttttgataggcaggatgtactggatgtaaaagaaacttataaataagctgttagtaatgtggtgggaaggttttgggtaaaggaaagtattctctatataggttaatttgcaatagcagcatgttaggataatattgaaacataattttgagttctaaagatatgatttacttattgttttaaaaaccaaaaaatttctcttcattttgatggtcttatctctttgagaattcaatgaaacaaatcacaatctgtagctgctctgacctcctagcaaatactttgatatcctgattatggtttatatggtcttctagtggattcccaagatttactctaatgactcattctttcatttttatatgtgtttatatgtttatatatatataaaacacattttatatgtgtttatatgagcacatataaacacatttttgtgtgcctgctgtctgtcattctctgggctatgtacaagaagcatagcagttgagcagccagcaagataaatacagtccttgcccatgaagaactcattttttactaccctgtctagattgtgactatgctgtatactatttgagggcagacactgtgttaatctgccttctaccttcagtgtaccacttagtgcccacacatgcttgatactcaaacactgtgtcttgaataagtgaacaaatgaacaatggcaacctataatttcatttactttatcccacaaaatattggcacatccagttagagaaattcacaagataattttatgtctttataacctaggcaatttttaaggtattttaaaattagtggtacatagttaaactggtgttttacagtgagttatcccgttgttctgatattagttcatggttagtaaagtcagagattttttttctagggaacagtataatcacattttattgaatctttccatgctacaccaagtttttatactcttctgcttagtttacagatgttgtacagatagcttccaacacagtcctcactcttgcctgctaaacttttgtaattcctcacagataatcaataatttcgggagaattagagttagtcccatactatattttattctgactctgtatagagtggcctgaagaggagatggtattcttgctttgagaaaagtatctgtgacttcttttgcatgagtaacatttgtgactgtctcacaacttcttgtcttgtttcatctggatcttttctatttgagattttctttttatgttttttttatatatacttattatactttaagttctagggtacatgtgcacaacgtgcaggtttgttacatatgtatacatgtgccatgttggtgtgctgcacccattaactcgtcatttacattaggtatttctcctaatgctatccctcccccctccccccaccccacaacaggccctggtgtgtgatgttccccttcatcacacacttgtgtgtccaagtgttctcattgttcagttcccacctatgagtgagaacatgtggtgtctatttttttgtccttgcaatagtttgctgagaatatttgagatgttctttcctttgcctgctgtgtagtactatctctccttccaacagctgacttaaaatcactttctctttcaatatgtttttttaaaaccacttctttttaatttcattgcatgtgttatggagcttttgctttgcattgtgaacatttcagttatttgctcaggaaccgatattgtactgctgaggaagacaggctctgtattccacttctttctctcactagctgaatggtaataggtatgccatttaaactctctaaattttagtggcttcatctatatagtgcaatagggatactaactaatggtacctatctcctaaggttaaaacaagaatggaataagataatatatgtaaattgtttagcatagtgcctagtatctgttgcttaatattattatcattgttgttgttgctatagttgatattaacacttcccaatagattgtaaactcctataaccttgggatcacatctgtgacttcttttgtattcttgatataacacaagagtaagtgcttcaatgaggcttttggaatgaatggatgaaaagtaaaaaatgaattagttaatgcatgttgtaaattctgattcaacatattcttcttagaacaagagctatttcccaattgtaggtatacaatgttctttggcattcagttgcatagtgtgaaagatcattcagatttgtgaaactgaaagtgttcttcataatgtatatttcataaaagtatacagattaaaaagaattaatttagaacagtaggataatataaatagctaccctaaaaaaattaccactggcattttaatgaaatgttattttacagctttaaagctcatagcaatataattagtaatatgtgtaatctttattaccaatcttaatcttttttatatgactgaaaaattattttatgctagtacaattaaaataatgctaaaaatgtcagcataacagaattaaactaaagtaactactacaatattgtaccccaaaccagctaatttaaatgcaaaatactttgtagaggctatttatctgggctaatgcgtgttaagggatttaaggagtagtttgtgtaactgaaataaaaggaaaaataagcactgtacagcaatctttactattgtttaacatgagggaaatattaaatcggtttatatataggccacttgagaaaaatgtattagaagccacagaatagcacagtaaatataaagactactgccaggcaaaactacgttcacaggcttttaaagggcagatttgaaatgcttaaagttgtccttacacaaatgatagtacaatattaactatgataactagactgaaggtgtaaaattttgaaagtatgtggtatattttgaaaaagggattttggcagactggacagttgtttagctgacacatgacaatcgttagatttttttctgaatgctcctgtcaagtcataataatgactataccactttctcatttttataaggtgaaaatatgaaagggtttaaaaataagattaaaaaaataaaactgggctcaggatagaaatagggaagtacagaaaagtagaaaaaaatcatctagattttcactacccatacagtttcacacttaatattttgtacatatatttctagttcctgctctcttataatttttagttttcttaagaacaaagttttgatcatattccatagaatatttatgtgtaatataaaggaatccaagtaatacatgttatatacaaattacttgtaatagtgaatcatctgtattttccttacgttattttaggccctcattttttagaccctcaaaaaatattgtggtttttatatttattcctaatttttagggctactcatttaaaaaaactggttagcatttaaaatattttattaaagtttaaattacttcttaataatcataacccattaaaattgtatgtaacttatgacagaagtatggacgatagattggagagaaactagatgctatagtgtagtgtgtttattatcctagtgcaattgtggaaaggagaactctaatttcacagctgatgctgcacattgtatttgtttaattttgatcttgtaggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatgtatgtctaatggctggttataaaaatatatcatcagtttttgaaaaaacctctattaaagtaattgaagtcaacattttacagtaaacattctgattgcaaatgtaacaaaagaaatgtgcttttaattaattattctctatttattaactatatgcatataaattcctatgcataataaattataaaaattcttgtttaatatgcacttcaaatatgtattaatgtgaattaaaatagacactaatagtggtatgtgtttagaagatttagccctaattgtaaatgttttctgataaatttagttgaaatatttatcagtagttaaattgtcttaaatatccattaacataaaacagacagaaattacttaaatagcagtaaatttttgctgtagaaattgactattagaataagactaataattttattgcacttatatgaaattatatctggatcttttaacttttgcttttctatacattcaattctatttttaataaatagttggctactatttactaaataaccgaaatttagaggtgctgatcatacaaaataaatgagtatttagcttcatggagtttatatttattgtgacttgcttgtaatgaaccttcagaaaatgttgaagtatgaatagaactgggaaacactgatactagaaaaaagacttcctttaatgtttcagtataaaaaactacattaataactgagctttcttttctttttttccattagatttgttgataaagctatggtcctatgatctcccaggtttaatctcccaatctacattcctggtgtttattgccgatttcaggtcaatgcttaccatctattaagcctgtagcctccaggcacaaaaggataatgctcagaatcccattatttaaattccaaatgatagagaatttttttaaacaaattttatgttaacctggaaaagagaaaaaaataaggatgtggcagattgttaataaaaaataaaacaataaaaaaagggactttttgaaatctaaaaccgaatgtaaatacctacatgtatatttactcaaactttacagtagtggatatataaaaaactttcctaaaaaatgaatgtagaatcagtttctctattcagtctatgaagattgtaaaaatatatatcagatgaaataatctgttcagtaaatgttagatctacacacagtacagtttatcctacaactacttctcccaaagttcattttcttgtgtgaaaggttgatttctaaagagaaaaacaaatcttgaaggatatgcatatgccagttaattctaggtaaaatctagaaatgattttattatatattttataaaatatgtactctaaaaaatgagaatggaaaagcaacatagatcagctttctgccttttatttactttttttattctttaagcacacatcttacctttgcttttatcctaagtttgtatatataaagaaaattcacatgtttttagtggtctttgggtgctctcaatcaaataatctcatggctcagaagggttgaaagtcccaagaattgctctggccttggggcaatgtgaacgaacaatggctatagacaatttttttctatttttttaaaccatcatattttaaattatgtatacaaaagtatctcccaaccatcattaatgtccatttaatcacagttttactgagtctgtaatagttttaatcagtgtgtggtctctttgaatttggtatgtttatacattttcacatactgccatcattcacagacttactatctttgatagctaggatataccctgtgttgtcgcaatagtctaatacttttactggttcttggagtctgactcaaggcagaaagtgtatagtctttggatatagtcagtatagtatagctgtgtggtttcagtccttaatttctctcacccatgtgtgtacacattgtagagttgttttgatgcttgaattttaaatttttaacacaagggcagagtgggagctcaggagatggtgtctgttgccatcttttgtttttttttgttttttttttctcccaagccttttccacctgtgacatcagggagcatttcatcaattcaaagaagaccccagaaatcatagctaccacaggataagtctgagaacagctttagattcaggatttggtaattggaattaggagtaacttgaagactgaaaatctttaagatgaaatgtaaaatcaaaagaagcattttgtaacatgggtctttctgagatacaattcaaacttctacccatagcacatggacccttctgcacttaacccttgcacctggctcagacttatccttcagtatccccatagagcttcatgtttcagctctatgggtttaccactggttctcatggtggcggggctctccttcttacaccttttctttacctcctgcttatttgatcatgaccgtttgtctggataattctagctcacccttcaaaattcatttcaggtttcttgtctaaggtgctttccctggtgatgctctgtctgggcttagcgcctgttatctgagttttcatagcaacgctgatatcatatggataacaattgcacttttcatggcattctcacagcacatgctacattttaattatgccttttttctttttcttatcttttagtctgttaattgcttgatgaaaatacaataccttattcacattttaatatctagctcctaagatgaatttctgccaattaataatcagtgcatatttttggcaaatttataagttaataatgagtacccttatttcaataatatttctctacttgctgttattagtacagtgatactttaagtaatatggtataatttgagaagaaccattagaaaagtgaaatcaaggtattctagaaactcagaagataaattttttcaatgtgaggtctcaggaaattctggaagtggtaatacttgagttgggtgttgaaagacatatacatcaacagcaaagatgacggaagataatttttttgagtagagaatgctgtaagctaagggcagagtagacaagcataagtgggtttgagagtgatacaatttggtacaaataagtgactgaggttagaaaggaggattagggtggggctacaggacttaaatgcagatctgggaacttagaacatgattccaaggtagtgggggactgtatcaattagatctgcattaggaacatgcaagagaaaataacttcccatgatttaactaaatgagagttacaaatttttctcccataataatcttatattatctcatataatcttatgcaattatgtcttataattattaacaacatagaatattaacagtgatattaacaacaaaaataagagagtattcatttagtctttatgtcaggtggtattttaaattaattttttaaacagcactatggtttactattatctcctttttttgtttttgtttttttttgttttttttgttttgttttgtttttgtttggcgacaagtctccctctgttgcccaggctggagtgcagtggcacaatcttggctcactgtaacttccaccacctgggttcaagagattgtcgtgcctcagcctcccaggtagctgggactacaggcacaagccaccacgcccagctaatttttgtatttttagtagagacggagtttcgccgtattggccagggtggtcttgaactcctgacctcaagtgattcacctgccttggcctcccaaagtgctgggattgcagggatgagccaccatgcccagcccctattatctccatttttaaaacagggcaactcccatgaaaagtaggccagaagtaggtagtcagaggctgttgtagttctctgtgatgtcaacatagatcagttcttcctctttcttcttcactatgtgacttttatcttaatgggcctcatgtgatcacaagggggctgcttcatctctcaggccctcaaaccagatggacagtagagagagaagctaggagaatgcctccatgaggaaaggaaaaattttgcaggaattcacaagagacttatgcttatgacttagtcaaaactgtgtcacatggccacatttagctgatgtgaagctgagaaaaatgcatttttcttctgagcatattgtttcatcaaaaacattagtaagaaagaagaagaaaattgatatttactacacaactctcaatggatctgctgtgggaacaagtttttgagtacaaaagtatcataatcaaagcaatgcttcagaaacatttaaatggcggttgagagggaaagaattgaggttaagtttcatgctacatgaacagatgacagaatattacagtgcaatttagttatagcctgaatcaggaaaattggtggtagagagaataaaagaaatgaactcaggggtaatgttgatgcgtctcagtgtcatattgtatacgaaagtgaaggtggaagatgagtttggtgcaattttgagatttttgagcctttacaggatgaataacatacatagatgaagggactgttaagagaagtatggtagttagaaggagtgtagagtttggcatgaaagtgatgatgagttaacttaggacaaccaggagaagaggttcaaaggacaaatgaaaataaaaaatctatttctcaaaaaagaacttagaacggtcaataagatttcatttatttcttcattcagacagctgtcattgccacatgctcagggaacaaactgcacatcctatataatctataccatataggagcttcaggttgagggcaagagaaaaaattaacaaataattataatattatataaaaagacttagaggaaaatgactagtagggcatttagccagatgggatagcatgagcgcagaatagagatgggaagcagtgtgaaatgaatagaaaagaaggcagatggtggtaaaagatgacatcaaagaagtaagtaatcagcaaattacagagaggctagtactccatgttaaacagtatcaagtcactgtagggttgaaacttgggacctagggtaacataatcagatttgactctagatcactttgtcagctatatagagggagaagtctggagtcagggatagggaacagctgggagtctatttctattgtgggtgtgagaaagtgagactctcccttaaaacatgttgaactgtggtatcagtgagatcatcacgtggagatgttggtgacagctagatatccaaatctgctggactggaggaagagatttgaggttgtcagcatacggatggtctttgaaatcttgaatgagaaataaatccccttgagaacctgaatacagtgaggagagtgatagctaaagatactcttttgaagatgaccaacatttaagggatggttagaagagaaagcccataaaagtaaagtaaaaagataactgggagagtgcaatgtcattgatgccaaagaaagaattagtttagagaaggagggagtgattcacacacccaaatatagcagatgagtctagtaaaataagaactgatcaatatctgttgaacttggcaaagagtgaataaaaataacaacaaaagggatgtcagtaggatggtgagcagaagccattctattttgaattcagagttaatagaaggtggagagattgactatctgggatgtttgggatagttggacagaaaggtaacagagcaaaggcataacgggtcataaaataaaaattgttcaggtgatctgccagtgttcagactggatctaaaacaaaggctgcatttgatgagtaagatcatggattttaagatttttaggtttatgtgctgaactatcagatttagagagtgctgagttaaaatattcaactgcaagtgttgatgtacttttccacagaattctgacagttgtatatatttttaggtgtatacgtgttcatgatcacttggtattatttttcctttagattttaaccttgaattttatattgcttaatatgaataccactactgtggatttccttttggttatatttatgataccttttttaaccttgtttcagctttttctgttgtttacttttaagtgtgtctcttatagacaaaatattacaaaaccttttaaaaatccaattcaagagagagtttctcaatcagtatgttaactcatttatattcttgtacttactttactattaggatttaacagttacaatttcttatgttttaagttactatgctttccgtttctttgccctcttttttctatcttccattggtcagtttttatcttcttttctgtttgttacttctaatattttaagagtcatcattattttttttctacatctatatccttgtttaacattatatatgacatactcttaagtaaaaatctaccttagtatggtctcatctccttgttgtcacccacctttctgaattgatatttatagaatttatctatgtatagaattcatgtatatatatgtacttatctatagaaatacatatgtaattattatgcatgtatgtctctctctacatatatctagagttacttagatcacaaacattttactgttctttactcattcttttgttttgtatcagtttcatggttttatttatcttctgactggagtactccttaaactgtttttaaaaggtatttttgccttaaagtttctgagtttttatatccaaaaagaatttaatttcatccacatacttaaaagatactttgttggctataaatatgtaggttcaaagttctttacctttaatatttctagtattatcccattttcttcttgcactcagtgttgttaaaaagttttgttcttttgtaaacctttattttcacatatctgaaaacataaatgttttcctttgtccttgaatcttatactttctatgcctattatctccatttttacttttgtcaagcaatttgctctttctttgtattcttatgatcttaatttattattttgaggatgcttacttgcgggtttgtaattcttattttgtctgatctattaattctgtttcatctgatacaaaatggtgtgtttattgtctttttaaaataacaaatggattcttgggtttttaattatggagatacttagaagttgtgaaggttttaggctgggttttagattttaacatccattaagataatggtaaaactgaaattagggaaaaaagtagtcatgtaggtagatgacagaaatgagggatagtagtgttaaaggcaaaggcacagcctccaaaggaggatgtttctcatgtaacaaagaaaagtttctttctggaataagggaaacctaagcatgctttatagtcaacatgaaaaattaaacagaccgtgtcatttatgacgtaagcttccagagagaaaatagatgaatgacttatgtgtaacttttactgaatccactccaagtatccaaatgaaaagcactcctcataaattatgtttagcaatcttctttcctcaaatcttcttcacatctgttcagtacaaggtttttgcccgtttagtggtagaatataagtaaaatatcacaaaataaaaattcaagtttaataacaatcaataatttacttaaagaatttcagagactggaccaaacaaaagaaacaaaatatgcacatctattaacctagcttctttaaagatctctctgtgcacaaggatttaacatctgaccatggctagagctacaccctccactgtagtacccatgaaccacatgtgtctatttgaatttaaagttagtacaaattcagtaacttatttatttttattttttggagatggggtctcactctgtcacctgggctggagtgcagtggtgcaatctctgctcactgtagactctgcctccggggttcacatgattctcccacctcagcctcccaagtagctgggactacaggcacacaccaccacgcctggctaatttttgtatttttcagtagagacagggtttcatcatgttggccaggctggtctagaactcctgacctcaagtgatctgcatgcctcaggctcccaaagtgctgggattgcaggtgtgagccactgcacccggccaaattcagtaacatttaaaaaaattaaatgaaattaaaatttcattttcgcagttacactaaccacatttcacgtatttagtagtcatatgagggcatgtggttagttattactattaatacattggtcatttcagatgtaggacattcccatcattgcagaaatttctactggataccactggccttgaggattctgtgatgtcagtttcttgcatacttttccacttcatctctaactgctcttgcctttgcgcactctgctctattcccattagtgctcattctttctcaaacatgttgaacttgttcctactttaggtgtttcttattgttttcccaaggatgaccctttcccatgttaatcttatgtctgttcaaatgtcagtaaatcttctctgatgcactttataaaataacaaccattttcatcaagccgtatcctctacctgctttaatttcctcagcccactatttgttattaagctgtttatgggtctgtttccttaagactttgagctgcataagaggaagaatttcctgctgttggctatggtagctccagttctaaccacaagatctcacagtaaacattgcttaattaatatttgttaagatatgaatagtgttccatattttttggagtatcttagtagaattctccgaacactcaattctcttaagttcctagatatcttgctttgaagataacatcaatagaattataaaatatttttccatatctattagagtgtactcctgactgtatctgcatatatcatgggaaattcacagtactgtagttatataaataaaacattcacaatatatttgagtttatatcacatttaaaaatttaactaaatggaatatgatggaagcaaagagagctagagcagagagagagaaagagagagagagagaagcaaccatttttttaaacatataaactttaaaaatctcccctagctaaagtacagaagggaaggaaagtttctattttagaaaagaactgagaaaggaaatagaaagccaataagatttggactatagagccaaatttctaggatgtcagtccttcctccaccactcactcactatataatctgggacaaattattgaatttttttctctcagtttccttttctatatagcaaagtactcatttcattgagtgattataagtattaaatgaatgatgtatgtaaagcacttagaagcatgcctggtacctctcatgcactataaaagtgatttttattgttactatttaaaatgttcataattattgctgtttttgttattgctattgctattacctattattattggtctttagagaaggtaggatgaaatgtttccgtctcttctatatctacaggaatgtactgggtaatatttaaccatgaatatttagatatccacatgtaagatgcaatcagaacattttaaaagaaaaataaagtttgtagaaagtaatctctgtacatattaactatagggaccctatctgccttgagatatttcatgataaccactctatttatgtagatactgatttccaagagactagcccagggtgatttgtcaagttgtcacctgtcagcctttggacacaaatgcaagaaaaagcaacagaccaaagattgtcaggattcctgcattttcaatgctaaagtaatctgtgtttttatatatatatatatatatatatatatatatatatatatatataatattgaggttttatatatatgtatatataacctcaatttaaattgtctaaaaacttttaaagattgctagaatttttctctctgttttcagactgaagcacaacttttatcattatgtacaatattctaaatgtattatattttgctagatggaggacgttattgaggatataatcggtatggaatcaagttttaaagaggaaggagcagactctcctctgctaatgcaaagaacagtaagtgctttcagacccaagaaggtcattgaaacagaaatgaatacactctgataataaaaatatttgattagcaactggtgcttttttctgcactttttaaacagacaagataaaagatgaatactagaaaatatttattggtgcagaaaaaaaggttatctaatggttgaagaatatagtgcttgtactaatctctctctctgtctctctctgtctaatcctatatacatgcatctaactatatatctaatttgctagcattttctgtaaggaatttaatctttagattttctattttaagcacagcaagtaatcaaacactcttaaaaggtcatgactaaattttgactattttaccatgactaatacagctttcagatttagaggctctatacctttgtagaagaaagaaaatattacaacaatgaaaaatataaatttacttctaagccaatagccagaggttaaagtcaaatcgaaaaagatagaacaggcctcaccctcctttaaagtatgtagaaagacttctatgttgaaatcagtacaaattcctgcaatatgaagggatagtgtattatctcctatttgcttgctatgcgccttctgattgttcatttatgaatcataaaaatgttatctgtaaagggtgtgtaagctctttcaacatattttgaaggattattgtttgtttgtttacagtttacaatcttttagagaacaggagaaaaaagaatctcaaagatcgcaattgaattgttactttaaatatttaatttaaaaaaagtgaattctgactatattgagttgtggactattcatctataagtcaataggctagactacattatgatggatgttttcaatttagggcctagaaaaaaaatggtggaagcatcccttttttctgtatcaattcttaagtagactatctaatgagagaagtgtctctttctccttttctctagtatgcaggacctccacatagtgctagtcaagtcaccagtactaactctacctgctaaatatcagatgaggtttcaaatctgttttttgttgcaggattttttttcagttttcatttttttaaatatagaatgatgactctaccttttttctcttcagatttcaagtagccatagtgacatgaaaactaattctctagatacatttgatattaatgctaatatctccctttctaatttcacagcatgaggatcctattttcttaagcaatattcaacttctgagcttgaggaaatgatattaatttcctgcagccttctcttctttgtacatggtacttacttcattgaaattgtatactgaaacattctctgtcaaattatctacttgttttgtagagtctttgtagaatggtttactcagtaaaaaattggtgatgaatttcattgggaatatgtgtttgatatacacaatgtacttttacatagatggatactactggcctaagtgtatttacgtaaagaaatatctgctgttaactaaccaaagataactgataatttagatccacatgtaaaacaaagcagttcaattaaccaaatatttactgaatacttattatatgtaaagcataatattcacacaatatgagactgcaagttgagtgaggcacaattcacatgtcaagagatgacaatataatggggtagcacaatgagttgtacctgagagagggcgggaaagaatgtggaacttgggtcaaacccatttctagtccagacattgtgcaaatcacgtaacctgcctttgctttggtatctatttctgtattatgggaataatgaaaaatattggtctctgaaggctgttttaattgatatcttatagactacatgtgttcattttgaatgctagtcagagatttgctctgcagctcaaatgaaggagaaaccatgagaaagtgagaatttttggaagtcctttagaaagaggtgatgtttgaaatatagttatgaagtactgtatagttaagattttaagagatagacatgaaggcagaaaagtagcaagttaagagaacaacataaggcaagaagtgagaaaaaagagaatgtacaagaatagctggtagaataggggtaggaaactctgaaggatttttatagtttatgtagataaaagcaaagacttgttagattcagaaaaaagctttgagtaagtatattagccagtgaacttttggttgcaggtggttaacctgactcataaggggcttaagcatgaaaggaatttattggttcatgccatctaaaaatccctaagtaatattgtatgtgggcatccctttgtaaatttgtctctgttttcttctgtgctggctttattctcagccattgaacagacactgtcatagcctattcccagccatgcatacacttttttcttgctaacctagttttttttcagacatccattccttcacaagaaagaggaagtttctgattaatttaaaccaattctggtggccccatttcctttgccagagattgttttaagaatgggcttgtgctgcaattctggcaagttgagcaggatactgagacctgcttggaagttttcttcagtctgtaatttcaagaaagagaaggctttttgcttctccatgatttatggggcttctgtagccttttttttccccccaaaaggtagataaagtgaggaaaaacaaaagaaacaaagggaaagagaaaatcaacagatatggaaagaaatgctgcttatatgcccctggagaattattttgcctatggatatgtaaggttttttttttctttattttataagccaattatatcaggattttctgattctcaaaaacaaatgcatcctaatggaaacattcagttagtacgggatacctaagaggaagtatttttcttcttagttccagttaaagctctgggataatggagcagcttctgtcacatatctatttctaagccaatgtctctgggtcttgggcctaccctagagctgtggcttgaacagccctccacaacaaattgcccagactaagagtgagaaccaagaaagcagtagtcgttacccaagcaaatgtgaatggattctagtcaggctaaattaacagatgtttattaaaataagcttcaaaaatgagaatatttaccaataattattattatgtttacctactatatgacatgggttgtctgcgttagtccattttacatttccataaaggaatacctaaggctgggtactttttaaagaaaaggggattatttgcctcacggctctgcagactgtatacgtgaagcattaccctggtatctgcttctggtgagggcctcaggaagcttttagtcatggcagaaaggaaggggagccagagtgtcacatggtgagagagggagcaagagagaggggagaagttgccatgctcttttaaataactagctcctatgtgaataattgtcctagttcattatctaaagctagccctaccatttgtgtctgggatcccttccaaaggacttttcttctctaaatagctcctccttctagatcatgaatatatgctgatctactgtattataaatatcagcatttatcaatctttaataacactcactaaaagcaaacctaaccaaacagcaccctttaaacgcatttcctctctggctactaggctatttcatgactcctttacatacagacacaaaaaaactcactgcccccattttctccctgcctcgacttccttccctctcattctctcctccccaatagggcttttgtcctcacaattctaaaagggctctgaaaaccaatcaatagcaagccaatcaatagcaatcaatagcaaactaatccagtagcaaattctccattgtcacctgacttggctcctcagtggcatttaacatggttcaccacttccttcttcttgaagagctatctggggttctgtggattctctgatttttcactcattttactggttctttttcttctcacagatgtctaaattctggagtgtcctaaggctcagtctttggtcctcttttctcatatatcaatacatgtcctataggtaacatcaacacatctctagcctagatcaatcccctatatgccagacttatatattctactgcttacttgatatcttttgtggttctaacaggtatcttaaacatagcatggctgaaaagaagtccttcctccaaaatctgcttttagttgatgtgaaagaaacaaacaaaaatggtcattctttgcttttctctctcttactcccatactcacatctatcaatatgtttttgtaatctacatccaagatttccagaatctcacaggttcctatcatgtcctcttgtaaaacaggttccatcatctctccctacagccacaggctctgacctagctttcctgctacattttgttcccttacagctgttcttcacagagcagccagaataatcttcctaaagaaataatcagatcctgtttctccttgcttaacattttattaactttctgaaatattcggaatataatccagacactttattatagtcagcacttccctttgacttcagggtctggattcaatggcatcctttctcctcaaacatgacaggaatattatcatcttacaaccattgcacttcctttgcttagtttggaatgcttttgtctcagatctttgcatggttacctctttatgattcagatctttagtcaatgtcagcttgtcaaaggggcctttcacaattaccctaactccatgactcctcaaatcaatgtcttattttatttaccctctgacttatgagtagtgtaacacaaatgatcttctttattactgcatttacctatttattctatgcttccccctgtagaatgcaaaccccttgaagacagggattttgtatgtctcatttactgctgtgtctctggagcctaaaacagtagcctgttttgttgttgttagtacccagcatagtgactaacacatcacaggtgctcagcaaatgcatgttaaataaatgactaaaattcacacatagtattgaaataattgttttcattataattcctattcaggaatactttattcttgttgcagtagcatggtactactgcaacaagaataaagacaacaataataatagctaccatgcattggttacttactaggtgacaagaattatgcaaaatacttttagtgaaaaactacatttaatttcacaacaaacctatgagatagagactgttattgcctattaaaattttacaaatgaggaaagaagcttagagagttcagtaacttgcccaagttcatatagttaatgaatggcaaagtagggccttgaatccagccctgcatgaaaccagtgcaactatcttacccattctgctgtgccagcggtctcagggaagtagccattgcatagaactatagaatcctatgatttgaaggggtctgagacagatcttatcatctggcacactccagctgaatgattgcttagcctctgagtttagatctgtgtattatttacacccattggtcttagtttcacccctttctttcagagacgtggttgtgcatagtaactcatttcttttaacatatataggtattttttcaatcaagtgtctgtaaatgctggtggcatttggtagtctaagtaaactgttatagttcaagatcattccagagacgaggaatgagtaaatattaacaaccccctgtgcttggttggaacttgaaaggactgcataacatcagtgagcaagcttttgtcaatcacaatctagacaagattagtcttaaagtccaaagaagaaccaaagttcactttagtgtagaagtttccacacagttctcttggttattgtttgcaagtttaaggaaaagaaaatgatgaaggagaaagagaaaaccattgctattgtgaaggttatagacacttcaaagttaaaactggtgagcaagtatattttggaattctttcagtgtttggagatgaaaccaccttaaatactgaatttaaactttataaacttatagtcaataaaataaggtatgtgaacattgagctttgaaacgcataaaatatattctgctgtattgacaagcatgcttacttacaagattatttttagtgctctggactatagtaaaaaattataacagtatatttagtaaaaaatattcaaactcctgtttattattactttttaatcaaaagatgagggtttcaaactaattgttgcagtgtttacattaaattaattgtttttatttattactaaataggtcatatgtatataatatgcatgatgcaaaagtatttataaattatcattctttgttttatattttatctcttctattattgtatatagtcacatattgtatttccagataatctgccactatattataaaccagctcaccaaggacaggggatctcctattccagctcaacacattatatttacatgtgtcataataggacaaaaataataacagcaataacacagtgggatttctctattcagtgcatgtcatttaaactgtatacctctgctttagtagcaaagaaaacaaatttagaggaatattaatggtgtgtgtcctgaaactataaagaccttgtttattgcatctacattaataaacacccaaaaggaaagacaataatctttcaaacgccaattttttgcgtgcattgtgcactctaggctctcctacagtgatcctctttatacatgaagtttattttccttttatgtctacaattattctatctaatcttttaccatcttagggtcacaatgaatgttttcacaaaaaaacacaatataggatccaaacaactcaaaatactgcctcagtttcccttgacactcatattaaatatatcatagtgcacagacacatatatataaggtatttttttcttttgttatctctactaataaattatctggaaatataatatgtgactatatataagacttttttacatttttgtatttataatgaaattatctaggacattatatatatgtatatgtatatacacatatatatgccaaagattcttagctttacatatataatccattttcaggaacatggtaaatacatactataatgccttttctcttgctgagtgaataaaaatggagaaagataaaacaattaatttaaattcaattagaaaatgtattgcaagtttgttagccccatgttattagggtgaaaggaaaaataaaccaggctggcctgaggaggagtgctgaagagggctttcccaacgttgagccttagatttggatgcttattgaaggaatggggacattggtagtgcagaaaacagcagtgggaaagaatataactgagaaaaattaaatccaatgccttgtaactttttttagcactcaaaacacttaagactaaaagttttaaaggcaaggcccttctacctatagggtagataataaagaatccagacattgtgttagacattccttggtttgaatccaagctctctacttctttataaagctatatgatcatgaaatgatgatttcatttcttagagctttaattattttatgtttaaaatgacaattataatactagagttgttgtaaagattacttgagatatagttatttaaattattactatgaaatatgcttggtttagtacctggtatgtaataaatactcagctgtctatgacatagcacgtatgttaggatcatgcttgtattttattatcttcttaaaaaaattccccatatataaattcacagattccttgcagtaacattcttccccctcacaccctccctgccgctagggtttgaagtctattgttgagagccatgggcacagtatgtttacatgtggtggtaagaaatctttcatcttgagagttagtgggaaataatgtcgaatagagaaagtggggccatgcagcaagattttgaaaactaaacgcaagaatttgggcttaatacatgagttaaggcagaaagattttagatttcagattttttgactgggagaaagcagaaggaagttgtatttttaaactatgagttagtctgggaggggtagtggtagttaattgagagagatgaagaaatactagtggcggggaacataatttaggcttagggctgtgaggatcttgaaatatgagaatagggaagaattttcaaactgagaaatagctcttaaaaaaagtcatatctgagtgatagatcagatataaaatatgaagagggaagaggccaaaacagtagaaaaagcatatgtggaattcaggtcaggttatttatgttgtcctgtatttgtcctgataagaatagatggatatatgaacattttcagaggttaattttacttagatgtttctacaataattttggacccagatattattttcttatagagcagcactgattttaaacaaagacaaagctatatttttctagggttatgaaaacatgtattgtctcaaaaatatgttgccaatgcactgaatttgaataaaagtttcactgtcttttcttccagacttaaaattgcaatttggagacattagtaacttcaactaaaaaaaaaagaaaaaaaagggtgctattttgataaaatgtgagacaaatgcacacgattccttatcctaacagtaagcaaatgtgtaatggaaactttgacccacaagcattccatttagaggataaggatatatggtaaacagtgtttcacaattttgtatagaatcattctacatgtaattaaatcagcatctttacacagtagtagagtaggagattaagagtaacaaatttgatgaacagaatcagaatatctaagcctgaagaggtaggaaaaattccctttaagaagctattaccgtggtagaatttttgtaggtaagaaatattatgtcaaactatttactgatcttatccaaaaaagtttatgaaacacataccttatgtgtagaattactttcatatcaacgtcagttaaaacttaattaatttaaaactatacagaaaactccagttaggcatttaaaaagaaaatctggcagcattgtgaaattgttactgtcatttctacagttgttaccacacttgacaacaatggccttatctgttctttctcctttgctagtctaccatgcattgggctaagaaaacatgatcaacttgtttttcttagttgtttttaactttgtatatataaaggatatcaagctgtgtgtgacattttgtaacaaatgttttctcttaatactatattctgtatgaagagatagactgatactgtaaacatagcacttttcttctcttaccttattaccttggctagaatttcaaatacaaagttgaatgtcaaaaggaatgattttgatgggaataattaattaggatgtttgccttaaagtttcagacatattatttattaaattaccaaaattctattcctaataaactgagttttataataaatgggattaacttttatcaaatgcttttttctgaatttgttgagatgatcatagattctttttctcttttaaattataaaatacacttatgggaaatcaaacttgatggtggcaaattatttatagcttttgaattcaaagtgttaataatattttgctgaatatttataataatgagtgaaatgggcctatagtttttcctcctctaatgtctttgtatgattttggtgtcagtgaattgggacatattcccgcttgcctttaaagttgtttggaagcatttttacaaaatggcatgatatatttcttgaaaatatgatacttttccccataaaagtatctagttcagattttttctttgtgaagtatgtttaaagtaccttttgattcttcagtaatcataatacgattaccactattaattacttcttcagtcagtaattacatttactaagtaatatttttctagaaaattttgcattttgtctaagcatttacaatcaatggcaaatttttgtcaactgtgagcatagatcatttcacttatttatttccaatgtgggtagcttttgttactttttttgcctaattattctggctaaaacttacaacgctatgttgaagagaagtagtgaaaataggcatccttatcttgctccctgttggtagtatatcccattatgtttttatattggggtaaaatataagtaacataaaatttaccattctaaacatttttaagtgtacaattcaaaggcattaagtacattcataatgtataaccatcaccactatccatttcctaaactttatcaatatcccaaacaaaaactctgtactcattaaacaatagctccccttatctctgaatctccagatcctgataacctttggtctactttctgtctctatgaatttcactattctaggtacctcatataagtaaaataatacaatatatatcctattgtggttggcttatttcacttagcataattttttcaagtttcacccatgttgcagcattcatcagaatttcattccttttaagcctattccattatgtgtatacaccacattttgtttatctattcatctgttgatggacatttgactattgtaaataatgctaatatgaatactggtgtacaattatctgtttaagtccctgctttcaattcttttggatacatacttagaagtgaaattactggatcatatgttaattctatacttaccttttgaggaacttccatacttctttccacaatggctgcaccatttcacgttaccaccagcactcctcaatttttcttttgatattagccatcctaatgagattgaagtattacatggtagctttgatttgcattttcctaatgactagtgatattgggcatcttttcatgtgcttattggccatttgtatatatcttaattggagaaatgtctattcaagtcttttgcccattttgaaaattgggttgtcatcattctaagcaaactatcacaaggacagaaaaccaaacactgcatgttctcactcagaagtgggagttgaacaatgagatcacatggacacagggtggggaatatcaaacaccggggctggtcggggagagggggactgggggagggatagcattaggagaaatacctaatgtaaatgacaagtttatgggtgcagcaaaccaacatggcacatgtatacctatgtaacaacctgcacgttgtgcatatgtaccctagaacttaaagtataataaaataaataaatgaaattgggttgttagtttttgttgttgagtttaagatttgtttttatgtatatattctggatcttaatctcttaagaaatacatgatcggctagtagcttctccccctgtgagggttgttttatagatttttttcttatgtttatgtatttgatccattttgagttaatttttgtatgtggtgttaggtaaacatctaacttcattcttttgcatgatgatagccagtttttccaacaccatttgttgaaaagaattcctttccccactgagtggtcttggcacctttgtcaaaaatcatttgaccataaaatagagagtttatttctggacttgctattatactccctaggtctatatatcttattgtcagactcacactagcacagatttagataactgcagctttgtaataagttttgaaatctagaagtgtgagtgctccaactttgttctttcacaagattgttttgattctgcagggtcccttgagatttcatgtgaatttaaaatgcatttttctatttctttaaaaaatgcagttggaatttgataaaaattgtattgagttttagactgctttagatagtattgcaatgttacaatattatttcttttcatccatgaacacaaaatgcctttccacttatttatgatttctttcatttcattcagcagtattttttagttttcagtgtataagcctttcgcttctcgggttaagtttattcctaagtatttcattccttttgatgctatttaaatggaatagttttcttaatttctttttcagtttgttcatggttcatgtgtagaaatgcaactgatttttgagctaataaatgagttcagctaagctgcagtacataaaatcagcacacagtttgatggtgtatgtgcgtgtgtgcatgtgtgtgtgtaagtgtagaatcttagggagggttttcttaatatgagatcgtgtcaacagttagcagagatcatttcatttattcctttccaatatggatagcttttgttactttttcttgcctggttattctcacctaaatttacaatactgtgttgaatagaagtagtgaaaacaggcatccttatcttgctcctaagcttagtggagaaactttttaccttttaaatctaatgtactgttgttactttctcctttcatttgaaatgttattcatttaatcagttttgccagaagcatgtcaatcttgttaattttttttcaaacaaaaacaagctttggtttatgaatctatctttgtattgttttgttcttcactgatttacggccttattatattatctattctagtttctttggatttatttggttatttcccctttttttaaaagaatgatggttaatttatataattcaaaaatgaatctatttttatcatttattatttaaggctatgaattttctttaaagcattgttttgccatattctagacatttttacatgtgttttatctctgttgtattttaaaattccactatgatttcatcttaaactttgaggtttttaacaattttctaaaatttcaaaatattttggcaatcactctatgaaatgtgttgagggtttcttttgactgagcacctagtcagtttttgtatatgttccatatgtacttgagaaaactgtattcactatttcttcatgtgaaactatatacaagtctattgggctgagatttaacatttattgttccagtcttctgtagcattactgattatttttgtctgcttgacttttcaaaaatgaagagatgtgtgttaaagtcttccactatttttggtgtatttattcatttccccttgtagttctaaacattttgtttcacatatctggaggttactttattaggagcacacatgcttgtaattgttataccttttaggaatagtgactcattatccctaataattttttaagcgtgaaagccctttttctgatattaatatagctacatcagtttccccatggatatcatctgctggatatgtctttttccattctttaagttttaatctttatgtgtccttttactgtgtggatatgtctcttgtaagatacttttatctagttcctgttttcttactttatctgtcaatcctttacctagggagtctgacctgtttagatcaattattattattgatatgttttcacttgctcttcttaattcatttttgtgccccatttttaagtttctccttaatacattcttaccactttcacatcctttggcttccctgcgacagcaacccaattgtgctgatattatctagatcgagttacatggttatgtgtttcactcaatctttgatcttggatccactgccattatttattccgcaatcactttaccaagatattcgatcaattttattttatatttttgagcatattctttaaatatctctacttatttaagcatttcaccccaactttttccagtgttagtctttatgggataaactttcttaagcattgtatgcctaagaatatattttatcatggcctcatgtgtgaatgacatttgagctggatataaaactataaaacttcgttttattttctttcaatgttttaaaatacagatttgttttatttttccattcagttttgctactgaaaagtcttatattaattggacttttgttctttgtacacaatctttctttctaggcttttagatttttttctctttattattgtatattatttcattttagtataatatatctgaatgcaggtcttttctatcattcttattaggcattctataaacactttgatttttaaatgaaaataaaataatgataacttatggtgaaataaaatactgtcgcccattgattattattaattcttaaaaatgtgtctccgttactttaaaaaattctttcttccaatattatttttctctcttttcgaaactcctgttatctgtaatttagttctaataattctattccctgtattgtttaggtgttctttcatatgttctatttcttagtctttttccttatcctcctgggagattactttaaaaatttggctttatattttaccaattcgtttattccttttttattgtttccattatgttatttttccattctataggattttttttctaagcattctatttctcatatctctcatttctccttggtctctttggtcattatgtttactgttcattattttatatcacaagttattacaaatacctttgatgttatttataatggtgtttgttgccttacttttgaaatagtcattttcctcaaatattttgatattttgacctgctagctcattttcttcaggaaatattagttactgtagatagcagtgtatatgtggaaaggttagactctatttgtttcagtccctatgacttcagcgtggagatgtgaataaaatctacggcgaagagcctctgataccaggaaactactgttattcactcctcacctcaaagcagtttctcagatcaggagttcacttttttctatcagaaagaagtattgccttatagagaagtagactctgctctatcaggccttctctctcactttgttgactggattttataataaattatttattttatgtctttaaagtttgtgaattttttgttaataataatgtttgcctattgtcacatcaaagattttgctttactgagaaagcaaccttttaaaaatatcataataaatatttcttcataaaataggtattcatttgcctactgatctacaaaattaagttaaaacttggactttattacctaagttacttatacctttgacaaatgttgatagaagttttctttgtaaactttttcacaggtgaatgcaatctgtacattttcactaacactggactcttacatcttttaatggagaaaatgcactttaggttacatgaagtgtattacacactttgaaactgaactcaattgtttaatgatattcaaaaagtgatgagccatttacatgaaatagagaagtacctatagcataaaattaaataggatattaattattgtgctttagggcataaattagacaataaccaagatcagaagaatatgcaatacggctacagttcagcaggattagattcattatcagaatttaaaccccatttctaaggaataatgcactgggtgctgtctgactaggtaatatggaggcaaggaaatgctatagttaggtacctcttactttattgttgcggtatatctgtaatatggctccttttcttccttaacatttctgcaacttgccacttcttcattgaagtccatctgaattcaggctcttcagagggaaagtgcccttttcctagttctgtccccctcactccctttttgttcaacgtgtccattatgcttctcaaaggcacagtggaaatgtgcaattcaagctggtgatgcctcagctcataaccaacaggcctttcaaaaatgaccttggaaaatttacactttaaaaagtatggctaagtgagtcacatcttagaaaaacatctgctttttggatttcttccaaagaataattgtatttatttgatactaacacacattgtctgcctaatttgctcaactttgtccctattttacagatgagaaaattgaggagaaatagctgatgactccaataggtggcttttatagctcccttccaagacccataaagcaaaaattctcttacaattaagtttatataaagtaaacgtgaagagtcctaatagagttaataatgaaaaaatatgaaaaaatacatctgagagccatataagtctaaaatgtccttattgatatgcatataaactgacgtgatttcaactgtattttccaatttttcccctcaggtatatacaacatttattatatatactgtaatagattattatctcagaaactaattttggatataatatgtcctttcttcatatttacttcctgtctgattttatcagttctctcaaattgaattggagttttgcaaaaagtgggttgtgaagttagattcttcatgaagacttgttaaagcattgttttattatatgttttattcctagtcattgaggaaataaaaaaaattgcttcttattcagctcttggtttattgcacagaagtggaagaaagatactcacaatggaaatatcttaaaatttcaaatcctgcatagtgaatgcagcttgttctggaataatgagtattaacctgaaatatgaatattacttaaatgttattttcttgggaaatcaaatcaataagcacactttgaataatgaattggtgcaattttgaattgtgtataaagcaacttaggttttctgaaaaattgttcccaagaagcagttcaagaattgcagtgttgctataattggatgtaccctatattcactagaggcaaaagtagttttagactacttttggttaccagctgggatatttataataatctagaacattaagtgtacaatgagaaaaagtatgccttccaggaagggaagagtttctcatttaattaacagtgtaaaacacctcttgactgtgagttgctggtagcactgatggtattaagaagggtcccaaaatgttcaaccgttatacctaatttgtgggatgtggtgaactttccagctttgcaaagatgtatattgatttttgtccaaaataatatttttaattacatccatttataaccaggtcatatgctggatcaaacttccataactttgtaaatattaataggaattttccttcatacatgaactgatttctctttttgcttaaacacatataactttttttcagcgcatcttatctgtaagcattttataatgcatcttttaaaaagttaatgcatactcgtcttgtttaaaagcaaaatgccccaaattagaaattattattaacaaaatgccacatttaaagtggaaaatgtaatatatataactaaatatatcaatttgcacagaaggtttttattaatcttttcttcctttttcctctcaagttatctggaagtattttggatgtgtatagcggtgaacaaggaatttcaccaattaacatggggcttacaagtgcttcttgtccaagtagtctaccaatgaaaagagaaattacaggtaatgttgcttttatagttttaccctttttatttttattaatgacataagttatgagtgacatatattgtgctaactaggattttaaaagtataacaaaacagttacaaaaaagaaggcagacagtaaattcatcttttctttttatgataatcaagcagtaagttaaaataacttatagtttgactgaattgattcattattttggaaattgagcaaatgcacatatatgttttacatacatatatacatgtatatacacacatatatacatacatatataaaagacagcttcatttaacataggctcatttttatattaaatagatgccatttattaacatggttacaaagtgaaataataaattagagaaattagtctattctttgtatgcagaatttgataaaaaacaaatattggatttttttttctttttagcttgttttatggatttcatgatagactcacatttaattttcttaattgaaaataaaccctgagttttcaatagtttattttaattgttacaactcaaattataggagcatagtcaaattcttccaaaataaatgaggaaatcaacccagggtcaaaggagctactttcctaaaggtgtaacagctgattacaggcagaactggatcaacgtaagggtttcctgacttacaagtccagtgttagatcctccgtaagaataaagtaaataaattcacttgagatttctgcaataaacttttggtttggagctcaaacaccacggtaaaattttaaataaatacaacatgaccactcttaaagctcaatcaataattcaaaaatgtctatgcatccaaattattcagactaaaattaatgactatagttttaaataaatacatttaaataaaatgtattatcttattaactttttaaactataactctaataatattgtattatttttgttgcataacaacaaattacccctgaaatttagcaacttgaagtaataaacatttataatctcaaagtaataaacatttataatctcattcagtctttgagcatcaagaatccaggagtggcctagtgaattcgttcagaccagaatctcttatgaggctgtagtcaagatgtcagccagaagtacagacacctgagacttgactgaggctggaggatgcactcccgaggtgtttcactcaagttcttgtaggatagtgcttcctgttggcaagtggtctttgtccctgactgcttggacttcttcatagggttgcttgagtgtcctcatgacatgacaactagagatcaaagagatgccaatgtgaaagttaaaaatttctcctattatctagccttggataccatactagtcatttccacaacaagctagtggcttcacaggtcagccttatttatttaatgtgggagggaattacaaggtgtgaatactacaaattaagaatcattgtaggccatcctggaggttgatggtcatataaatacaaccacaccatatatacagggaagtgccatttactggaagaaagtgtggaagtgtttcatatggatatttgagaaatatagtgagttgcaactcttgggatgtagaaataataattactaataaaatatttaggttggaataatttctgaatctcaaaattctgaaaataataattgaatactatattttctgtacactatatttcttttggttatcacaatgattttaaggtaggtattgtattatagtcattttacagatgaagagcctgaaacacagagaagtgtggcaatagatcacatggctattaaatggagggccagaaaataaattcagtttttattatcccagagcctaaaagctttgccattgcctttcactgaagagtactgttttccaaatttctgaatatttgcatcaaaaatattattgtaccgttttggagcaaataatattttattttcacctaggagttctgaattatgttgcctggaggggttttaaggtagaactaagcatggtttttattatttttcttttgatcagaaactgacactagagctttagcaaaagagagacaaaaaaaggacaaccacaacctcagtgagtatatatttttccatataaaattaatgcaaaaggaaatgcatagaggttaaggtgtgtggtcttttattatactccataagtattttcatgtcagatggccaaaattaattgcacatataacttgatttattttgggaaatattaacaatgtgagctctcagaaaagctatctattttcacaaaatgaaacatctcgaattccctccttgatcattcacttccaaggaggctgcctgtgactgagatgagtgcatttggttacatttgaattctgttgtgactcactgactcaaaggtttaaagagataaaagtgacttttgaaaatgtacaacatttaaataataagaaacataactccaggttctcatttttctgtgtcaatttgctcctcctttcttaatgatatgttatctgaaaggcattgctgtgttgcagtgctgaatttcacctctggaacaaatagagccctcatgccttcctaagggtcaattagactctgataacaggtcatatgagatggagaaatcgggcaagaaaagtagattggcagcgaggctgagctttagaatgcttggtcatgtcttaaatgtgtaactgtctcaagtgagcttgactaattgagtgtgaagccttttcgttctggaagccaaatcaaaaactgagaacagagtagaatgaaattaaaataaataaaatattgcaaattcctaaaactaatgactaatttccttatgtatcgctagctgaaattgagtatacacgtacttgtgaaacctgcatctgttcataaagcacctgcctgtgtcacagtgatgtttgctgagtgtgtgactgtaagacaagagctggcacatggtcataacagtcctccgagaaatgattttattctcaaaggctttagtgtcagagcagataactttggtccagattatgagtggggagagctaatggttgagagaagggattagtaaattgaggaacttttggacttttctcttaatcagccacttaacgattactgaccttaatcctaccttctctcttctgtgtctgcagcttaaacaagtcatttaatgtagagtaacatggtgtcctgtatatccattatcgaagtgtttcttaatctagatacacctgctacatcatcttgcttttggaggaaacaaacacttaaaaaattataagttttaaatagaatgaatctagaaaaaccctaaaaacttgtgatgatcatagcaaaattacaaagtaagtccaatttaccagaagtttacataaaattatgttccattcttcataaagacccagaggccaggagtgaatttagaattttcagctcataggattttggcgtgaaaatgtcagggcagggcagtgtcagctctcagcttgcagccccccactgttctttctgcaccccctattccattctgtgctacaagtggcctcaaatgtgacggtgaacaccctgtcctgtacattcaagctccatatacagccctgcaaacaactgcccattggtcagaactggggcccccagtgagcacatcggtgtcatgttctgtcttcaggaggatggacccagggaggtggtctgcacaggctctggaagtgaactcagggaattagggaggaaattgcttgtgccgataacccagagtatagtttagaagggttcccttggccctgtggctgccttgctgagtggagagaggcatggccagagaaggcaagagtgcttcctctaaatattgatcagagtaagagcctctcttgcctggatctaagtacaggattaagtgaatatgtcaaaaactttgtgaagagtgaaaccaccatgacatgaagtagtttagtaatttcttaaaacttgactcctttataagtaactagtactaggtatgaacaccattgggagccagatttctcattctaattagccatttaaaaattcatagactactacctaagaagagtagagaagaaggttctgacattctacatcagataaatttaaataaaatatcttaaagaaatgtgacaggacaaaaacagtcccttattttgagaaaaaaatctctgaacttccttcatagttgttcttcatcttgtatttaaaagtctggcttataagagttaatgtgtgtggacacaaaattattaagaaattcttattattttatatgtgcatatgttatatatatacatttctatataagtatatatgtattatatgtgtgtatatatgtttctattagctttacctttattttctagtcagtgttttttgtggtgtcattttgctgttatttgaattatgtgcacaggggaaataggattggtgaagagggaaaataaactcttaccagaaccaattatattctcattttagaggaatcacaatgtattattcctaaaggtcaaattcattcatgtaatttgctttgtagagtaagttcaccaaggcaattgatagtctttgatgactttccttgtttctagtagcagttcataattctcaaatgtgaactgtttaagtattttccaacatttaaaaaaatatattttccttcttcttcatatccttttctacctttacttccccaaaagctttaaacatatctgttgaaaaagataccatgtataagtatatgttatggttcttgatattaggaatatagagtagaagactgctcttagagaagagtaatacaggaaatttgacagatatatattgtatgttgaacatttacgatgttcagaaaattgccataagcaatgaatgtatggaaatgcaaaaagagaaaacagtctctgaataagagcttatatcagcagttttcaaagcattggccccacaaaaacagtatcagcatcaccatgaaacttgttagaaatggaaattcttgcccactcttgtccccctacttccaggacacactaaaattagaatctttaagtgtgtggtgcaaatctattttaacaatccttccaggtgtgtctaaagagtgccaaagtataaaaaccacttatttatatattattggaaactaaaatagaaaaataaatttacagcctaatcaatatacatttatttaccacctcctatatgtcaagctctctggtgatacaaaaataagtaagttaggtccctgccctcaaggaggtcatagagtctaattggatacacagacctactatgtgctaaacattgcgttaggctttgaggacagtatatgagaagagtaaagagtgttgcacgacctcgaatgattacaatcctgatggactgacaaattgccaatgtgtgaaataatcaaagagttatacatattaatatatacttatacacatttcattatgagtattatagtattttaaggaatttttaaaaatgttttgtgacaaaatgtttttaaaacagtgtaaatcatagatttataattctaatattgaaacctttacttttagaatgagaatttttattttattcttgagaagtattatcttttgactaaatggaaagtttttttcccattgtttttaaaagattgttaaaaatgtttacagctgaccaaaagtgaactgtgcattaatgagaataatcaataatatttcttctttaatagttgaaagaagaagaaggtataatattaattaccgaatcaaggagcttggcactcttattccaaagtctaatgatccgtgagttcaacaatcatttctataataatgttataatttaaagacccccaaaatgaatgggagggaagaagggaggagagaaccaatgactaggaaactaagcagcttatagcaaaaataaggctattgctgggctcattttaaaatgtctattccagtctgattgttattgagcatcagggctgttactaagagttgtcctcttgagctataagaagtaaataagttatttttcctcagttcatagtgagtctttctgtatggtgacaatattgtcaaatttagtgataatgtcaaatactacttatgatgctgactggtatattcaatttttatgagtataacaattcttccaatttaaaatttgtgtgcaagtgaaaatagaattgttagattttccaaggtccccgaattttggagacacacaagtaacaaatggaatcataaaagcatattgattgatgctgaccaggctttgtgctgtatgcacaaaatgtccatcaaacaaattacttactcttgtaaatattgagaaataaagtgttaacttaaaatgttgaatgtttctttaaaaatgtgaacgcctgtaatcccagcactttgggaggccaaggcaggcagatcacttgaggtcaggagtttaagaccatcctggccaacatggtgaaactctgtctctattaaaaatacaaaagttagccaggtgtggtggtgcatgcctgtaatcccagctactcaggaggctgaggtgggagaattgcttgaacctagggggcagaggttgtgttgagctaagatcatgccactgcactccagcctgggcaacagagcaagactccatctcaaaaaaaaaaaaaaaagtgaaaacatggaatctgtagcattaataatgatttgaaaatatttcattaaaactgagaacttttgagtaggttgcgaaaattttctcccattttgtaggttgcctgttcattctgatggtagtttcctttgctgtgcagaagctctttagtttaattagatcccatttgtcaattttggttttggttgccattgcttttggtgttttagacatgaagtccttgcccatgcctaggtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttttatatatgcggtattatttctgagggctctgttctgttccattgatctatatctctgttttggtactagtaccatgctgttttggttactgtagccttgtagtatagtttgaagtaaggtagtgtgatgcctccagctttgttcttttggcttaggattgacttggcgatgtaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatgctcttttatttccttgagcagtggtttgtagttctccttgaagaggtccttcacatcccttttaagttggattcctaggtattttattctctttgaagcaattatgagtgggagttcactcatgatttggctctccgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaggacatggatgaaattggaaatcatcattctcagtaaactatcacaagaacaaaaaatcagacaccacctattctcactcataggtgggaattgaacaatgggagcacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattggcacatgtaccctaaaacttaaagtataataataataaatttaaaaaaaaactgagaacttttttctccaaatactggatattattcattatccggaaatgatcatgtttgataaagtgatacttgtgggccaggcacattgtctcatgcctgtaatcccagtactttgggaggaccaaacaggaagattgtttgaggccgggagttcaagatcaacctgggtgtgatccgacctctaaaaaaaagaaaggaaaagaaaagaaaagaagagaaaagaaaaaagaaaagaaaagaaggaaggaaggaaagaaagaaaaagaaaataaagagagagagagagaaagaaagaaagaaaaaagaaagaaagaaagaaggaaagagcaagcttgatatggtagcatgcacctgtactccaagctactcaggaggctgagacacaaggatcacttgaacccaggatttcaaggcttaagtgagccatgatcgcaccactgcattccagcctgggtggtagaataagaccctacacacacacacacacacacacacacacacacacacacacacgttatgtttctgagattttaaagcactttttctctaaatccgaatttgctcatttatttggacaattcaacaatttgttagaaaagggaatgcaatatttgtccttatgtacatactagattgtgaagacatttagggtctgaagagctcaggcctaatttagactctactccaaactcttcaaatcttttaaagtctctaaacatgtgactctgttagctaaagaaaacacttgtcttccctatatgcctgtgtttttataaaaataaaatcaaataaggtgtatgggaatagtttgcaagttataaagttttatgagagattattactccaaattttaataaaaactttatctaaagactcctttctagttctaattcattttctagaacatagaatggtaagtactttttgtatagggccagatagtaaatatttcaagctttgcaggccatacaaaagtctttgtcacaattatttaactctggcattgtagcatgaaagcagacacagacaacatggaatgaatgagcttgacctcatccagtgaaatttattgacaaaaataagctatgggccatagtttgtctacccttggtctagaatatgaaaattcaatttatgatagaccagaattgggaaaactgcattgcaagcattgtttttctcttccttatggatctcagaaaggagggttattatttgttttatttctattgtgttgtatgtaggcaaataacatttatttggggtctaatggaaaacacattaattagatgttgaatatgtctatacatggatttttccgtatatcacaggtagagaagacacttcactgaaatgtgtgacattccaaaaatctcagtactaattctgtttaaatacattttattccttggcttgctgtggcctcacctgttactccagtgtccctctttagggtttagcaatgagggtcccatgattgaatccagagtgtatcctcttaaaatgactctacctgagaaccatggtctggctccatggactaaggagtacccatctacgtgacaaaattattctggatccatttgtcaaattttcaaatgttattagggataatctaaaagtcacaggaaacaagaatgctggaaaaagggaagggtagcatagaggaggcaaatttactttgagggtgagaaaataaaagaagaaatgacattattatgttatgacaatgaggaaattaacaaacagtggatctgaaaaaaaaaaagaccatacaagattttagtttgagtttagcaaatttttgaataacttgttgaacaggtgactacaaccattaaaatgactaagaacagtttttaaaaaataaaaagtatatcagactatacaattatctagtatgagatattttaaattatgtgccatatctattaacgagtcatggaatcactcaaatgagacaaatgcagcattttaaacaaaaaaggaagaatagcattgaaaatatgagagtattacatgtaaagagaataggaaagccctgtgaaatctttgttgcagttttatttactaagagtgtgccaagtcactatataaagcgtatttcttatgacagatgcatttgaaaggtgggaaagccacaggttggcagaaagagtactgaattgagagaggaaacctggggcttatctcctaaacaccatatactcttgggcatatagcagcaattgtggcatggttggcctttgagtacctttccagctcatgattggaatatattttggagttggcttaggaaataaaagctaatacctgaagacactttgaattctatgaagtttttatttctatgtatcaaaatattcagaaagttctatttctttgcaggtcaaaatggtgaggtcagaaggaaaagtaatatagagaacagctgtaattgagacgtacaggttgagaaaattacatgaaaaaaacatgaccaggcaatgacaatctcttgaccggtgttaacaaaacaaaacccaaacaaaaataacaatcaaagagaaagagtgaagagcttctacaacatgtagtagttgtcctctttagctttcttggaaacacttttgtccatatgtgtttttgtgagccatgtttacaaaaattacatgagtagaaagttaaaagtattattagatctttaattactctattactcttgtttttgcactgtaaaaagttttctaaatagtttgaagtttttttacttaatctttactctcctctacaaccaaattcctcctgcttttgtgtaagaatgatagttggtgtagaatacgagacctgacaaaactttctaagtcaggagtcacaaaatgttgaagcagaaaaaaaaaaataaaaaaaaaaaaaaaaaaaaaaaaaaannnnnnnnnnnnnnnnnnnnaaaaaaagaaaaaaaaaaaaaaaattcagacctgtcatagtattatttctttctttttaaaatcttttttttaaattattttttaatgcttttaagtggatgtacacccctaagataacaacagattgtacattttccatagttttgcctggcagcactccttactccaatttatacatttgtattatctgctctgactgtaaatgcattcaggcttttaatccaccaacattttaagatcttaaaaaattgttgtgcagaaaatgaagggccagcatcaactatcaacattcattctttagccatgcctttattggtgtgtctgtgtttatatggtaccaccctatataatatttgtaatgcctactttgttgaaattgttttgggagagaggcaaaagtctctttagtaaatataaaaaataaataggaaagaatctagtacattaaaatttctttaaaatagaggaacttaaaaaaattattgtaagtgacatcaggtacaaattgaagggaggctcattgtgtgttctctactaccattttgaaggtttgtttttgaactaatagtactttaaacttcaaatatggctagggttatctttttttttaaatctgtttctctgtcctcaagcttttctttccatgagaaaaaatgacacaaaataagggtccataaggcttttgctactacttaaattttagtttagagtccattacatgtttcagttacagatacttggtttagcaccaaagatagactgtctctccccacccttcccaccaccaccatcccactcattcccctcaccccctgtgagtggaatgagaccaacagccattatagccttaaagaaatgacaaagcattttcaaacttgcgatgtccattgacaatgttttggtgcattgcagtagaacagagctcttatccaggctccagtaagcactttcacctgctggtagaaaaatgtctcttcttttaatattttactgctaatggcattgtcacatcaccaaaaatatatgtagaaaaatgttatatttccctacctgtgtactttatgctatattaaaaacatctcgtgactctaaattcaaaatgtatccaggttttccaacaactctgattaacatttagcaattactttggactcattctccaaacatattattagttctcatgcagtattacattcattaatgtatattttcagatatcaaaatcagtagcctcttccacaatttcatatctttaatttctcctgtcttaaaagtaagttttaatgaaatgatttcttctatgctatagcctaaaaagttatccagtaatgtttaattatatttacttatcttaaatgtatttaaaaatagctattcacatcaagcttttaaaaagttttgatgatgtttgtatagaaaaaaaatgactgaatggttttagaaagtttgctctattacataaagtgatgttgccagagtctgatttgtttcacaattgctcaggatcaccattcaggagggactttaattttttcttagaaacataaaagcaaccttattagaaaataggttaaaagattgctacatttgaaatgatcttaaaaaatttaggcttaagtcctcagtaatgtacatttcctagttcattaatgcagaaatactgcacatagattttaatcttggagttaataataaaagcaattttcactaaaaatataaaaactgtaatggtagaatcatgatattgcatttagctctcccacaaaaagtcactttattactttcttttgacacttattttcattctgggattaattttactatataagggcttcttaactattctattaaaatttctattcagaagcaataatatctaagagtgaataatagtcatgtaaatcattatttcatattaatgtaaaagattttgtaagttcttatgaattctgctgacatgcacaattgtgaaaaggttatctctccattctacagtgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggtttttataagaatgtagccatgagtcacatagcttacacatgactcagctgtcatcagttttcttcattggtctcatttattttttctcttattaacaattatttttccttttgaaggataattttactgctttttagaagttcgtgaattgggttgtttcaattaggatttgactagaaatccaggatcaagatggctgaatatgtatatatgtatatatgtatatacacatatatgtgtatatatgtgtgtatgtgtgcatgtatatatatatacacatatataatgacaacaaattacaaaatgcataaaatataactcatttcataaatgcacacattattatcctaatcaaataataatactaagtaaaacatttgtttctctacattatattggacattaaattctcccctccttctttcatttctttccaacattgctatggatttcattgcctcaaggcatgttgtgacagtgtatattaagtcacttctcatctgttcatataatccaaaatatcaaaatatgggcttttataactctcaagattttttaaaaatgtgagtatgcttagcaccaggtaaaacatttactgtttccatgaaaaggtcctgcatttacagtgagaaattaatcaggaagaataaatagatgactttctgctatctccaaatggctatattgtagtctgagccactatggaaccatcatcagtcataacctttgtagaacaatgagaccaaacttaaaaaaaagtctgagtaattttctcagagttatttttcatgcatcagaaatgtatcaatttcattatttgcaaagattattcataatttgtattgtattactcttcattttaaatgcttgttaatattttgattctatgtctggcttattctctagtgttaaatccaatttcaaagacattatttaatgattttcgtttgaaattacaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatccttatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaact

SEQ ID NO: 16115 - DNA, 59319 bp, Human
cagattcatcttgctgcacatatttctgatcatgtcatgtcactgttcaaaagttctcaacagttcctcacggaatctgaacgcctatcttaaaccctaaggccttaccactcaaaatgtggtctccagatcaggagcactggcatcagctgggagcctgttattctacaggctgtattctggagaatacagattctccagtctcatgccacatctattgaattaacaacttcgttttcacaagattcccaattgattcatatctacgcagctttgattacatgtttaatctctcataaacttcaagcttcaaaagcagggttgctagatttagcaaataaaagtaaaggatgtccagtaaaatttgaaaacaatgagtaattttttggtttaagtatgtctccactgcttcatgggacatactttttaaaagattgcttatctgcaattcacatttgattaagtgtcctatatttaatatggcaaacctattcaggagggtaggatccatgtctaacatagctttgtattcccctggaatagtacagtgccttccccaactgtttttgtttttttttgttttgctttttgagacagagtcttgctctgtcacccaggctggagtacagtggcgcgacctcggctgactgcaacctccgtctcccgggttgcagggacagggacaacctccgcctctcgggttgcaatgacttctgcaactctcctgcctcagcctcccgagtagctggtattacaggtatgcgccaccacgccccggataatttttgtatttttagtagagacggggtttcttcatgttggccaatctggtcacgaactcctgacctcagatgatctgcccacggaggcctcccaaattgctgggattacaggcctgagctaccgcgcccggccccaactgttcaatatatgtttgtttaatgagtagaaaatgagcttcttgagtatggaagtttctctttttatttcaacagttttggaatacaggtggatttttggtaacatggataagtcctttagcggtaacttctgagattttagtgcacccatcacctgagcagtgtaccctgtacccaatacgtagtaatttatcccctccccagtccccaaagtccattttatcattcttatgcctttgaacccacatagcttagctcccacttataagtgagaacataaaatatttggtttcccattcctgagttacttcacttagaataatggcctccagctccttccaagttgctgcaaaaggcattatttcgttcctttttatggctgagtagtattccatggtgtatatacccacatttgctctatccactcattggttgatggacacttaggttggttccatctctttgcaattgcgaattgtgctgctatgaacatgtatgtctagcttgcttttttccccctcaacactgtatccccagagactaacacagtgccccgcaccccgttaaagaaccaaaaaatatttgttggatgaataaaggagtatatcaagagcaatctttcaattatggagagggtcgtgatgtgtattttaatgaaagccaactatcttctctaatatttgaaaaaacaatgtttaaaaggcttctatttgtacaccttttcacattttagctggcagagttcaggacttgatggaaacataacgaagggctcagaatgtactcatcgcagactgagcccatatggtcacagtggggagagcacgctgcactcaagatgctagcaagcctgcagcaggcggcccagcgagacacggtcccccgcccggccaccaggcgcccgcgcacgcgcacagccgcgctcagtccgcgagggccgggtcgagggaggcggggctcccggggtgcgcgtgcgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtaagagtcgcgggggcgacggcgcgggctgtcaggagccggctcagcccgggcgggtgggcccggagtctggtcgcgggggaagggcattggcccgcagctggccttgccctcggctgcccttcctcccccatccttactgcgcccagtgcctgcccctgtccgtcacccgaggccccgcgcgggggcaggtctctgccaggcctgctcgctccgctccttgtagggtgtgtactccgaaaataggaagcgggagccgggcgacggcgggcgggggcgcgggcgcgggggagggcggcggctgcccaggaccctctcctgctgtcgggccgcggggcctccgccggggccggggaccggggaccagggacgcaaaggggtttgcgtccgtgcctgggagcggcccaagggcagtgcccagcgcggcggcctggcctgtgagtgtagcggcgggtgaggggaagggaaaaatcgcttaggaagcagaccttcacttctcccttctacttccccctcctcaaagcaaaatgcttccttttctgatcctctacggtttatccttttttttccctttccccatggaggcatctctccctccttctctctttcctttcgtggctctagcagtaagcttgcagctcccatgttccccaggaggcagcggagttgctcacaaaaagacgaccccctccccatagttgttttctgcccacgttggcagcagcccccccccgggggtcgatttggtggcacctcactttcctgctaggacttcttccgaagaagggaaaatgtgcaactccttttactgtatattagatgctgtgacagcaatggaaccagatgaacgacttaagttctcagatatttaaaacgagtaatggaataattcattgaactgctgctctcttaattcgcccctttcgtttggcttttgggaacgtcccattcccgagggtggtggggtaggggagaaccctgctaattttgactgtttctcggaaaggacccttagaagtaactgacagaacataggaatgagttagttgcagggttggaaatgtccactcttcgttaaagagtgcttcatttttaaatttcaaagccagtgcaggaaaatacaggtacatttaggtatgttgtggtgtttaagaaatcttcatgtaagtctgaggatattttcatttaggaccctctgctctagatgtttttatatgctgtgttcttgcaccgaaatagaaggttctgtcccattcccaatgtgaatggtcagaagtcagcctcatctttattttcggaaatctttttttctcttgtgttcttcggtgaaagtgataatacaacaacaaaatgggggcgagcaacgtctccatagcccacagacccagtaggcagatccccgtatccacaaaagttgctgtacagtattcaatgtataatcttgataaataatcctattttatttaggtgactgaaagtgtacaggagtgcacaaacatatttaaaattgaggcgtgctaaaaagcttaaaaagagattgtcgtgtttttattctaccattcttaagtgatgattagtagctcaagtggctagaaatctagctgaagagagactactcggtgtgggagttaatatagacctgccatgtgttgtaaaggcctaaaataaaaaagttttttaaaaatgagataacaagatgccttattatctggcactctcagggcactaagcttcataaagaggaatgaggaggttgtgtgtcttaaagcctgtgccgcctagtagcaaaatgttttatggttaaatgaatgaaaattctaatttgatttttgatgttttgtaagaatattatgtagatattttacatataaattttatcactatatttactaatttaaaaactgacaaaacctttaggttaaattcaagtaaccagtaaagtgaaattttaacgttcttgtcacttgagatatctaaaggttattttcattttgggggaggaggatgtgtccagtatgggatcagaaaacagagaggacttaaaagtgatattttaatattactcgttctactgccttattggtaattttcaaaaataagctcttaagctgggcacggtggtttccacctgtaatgccaactactctggatgccaaggtgtggaggatcgcttgagcccaggagttgtagaccagcctggtaacatagcgagacctcatctctaaaaaaaaatattaagttttgaatacttttaagtttttgaaatttccattctagattgcaaatttaaggaagagaagctgttaagatgtgtctagtaccatactttatatatgcttggctcagttagatacattcattacttaatttgttgttgtaagaggtagttctattaccatttcacagatgagtagagtgaggttcaaaagctttaagtagttcacccaaggacggtcaagatgaaggtagtatttaaagtttgtcttagtccaacgttgatgttcttgtgacattatgcgctctcttctttttttttttttttttttttttttttttgatacagagtcccactctgtcacgcaggctggagtgcagtggtgcaatcttggctcactgcaacctctgcctccggggctgaagcgattcttctgcctcagcctcccgagtagctgggataacaggcacatgccaccatgcccagctaatttttgtatttttagtagagacggggtttcgctatgttgcccaggctggtcttgaactcctgacctcaggtgatccacccccctcggcctcccaaagtgctgggattacaggcgtgagccaccatgcccagcagacattatgctttcttaaacaaaattgataagaacctcttctggttttgtctcttcatttttaatttgttgacagcttattttgaaaaaggagaaacgttgattcttccttagacagggtctcactctgtccacccaggctggagtgcagtggtgatcatggctcactgcagcctcaacttcctgggctcaagcagtcctctcacctcagtctccccaagtagctgggagtacaggcaggtgtgccaggacacccagcaaatttaaaaaaattttttgtagagacaaggtctcacgatgttgtccagggtggtctcacactcctggctcaaacgatcctcccacttgggcatcctaaagtgctgggattacgggcatgagccatgattcctagcccttttttaaaaagtaataccaagcaaatagtgttaggttctaaatttttgtcttgatgattttagaataaagcttattattaacacatttaaaggtgttatgttactgataggaagcattttagaaatcaatctagaataatagttttgttttttaaaatcatacacaattgctttttgaggatactactatgaagtttaataaccttttctcctttggccactgggtgaatgggaaataaatttagctgaagaacacaatgaagttctttaaagctcttaacttgctatagtgtgtcccatagactttttttttttttttttgagacggagtctcgctctttcacccaggcggtatctcggctcactgcaagctccgcctcctgggttcacgccattctcctgcctcagcctcccgagtagctgggactacaggcgcctgccaccgcgcccggctaattttttgtatttttagtagagacggggtttcaccgtgttagccaggatggtctcaatctcctgacctcgtgatccacccgcctcggcctcccaaagtgctgggattacaggcgtgagccaccgtgcccggcctcccatagacttttttacatagttacagaaaccctaggccaaaaacagttcattttcattcctgggtcagctgtattgtacagtaaagcatttttgtgaatttgaaattgtatgaaattatggtgtaaggctcaattgaaaagacccattccgaaacctctctctggataagagattcaagttccagaaggaatacacttagttactgatgggaaagatcgtttttcttcctgtaaccctttacctcagtgattacaataatctgtcccatagcttcaacttttaggtctttgcagttgtctcccaggtacatagctgtagcactaacttctttcctgattactggtcagatttttatctgctattcatgttcactggagatggttaattaggtatgttcaaatggagcttgcctagaagtaaatttataaacgcccatcttctttcctctcacacaaaggggggtataatctactcttgataatttttctctttatatctttattcccattattccagtcatcctggtttttaatttcagatttattctaactttttttggccctgtaccttacaatcaactggtaaaagttgtcacttccatcgtcaaaatatgtattatacaaataacttatttcttgcttgaaaagttaattcatttatattaatacttcgtttattatctctgcattgacctgattgttaaataatgtttggtaacaaaatttcactgtacaaacagaatgcaacttgattatacttgttctgtgccaacagttaagaagtaaagtcaagaaaaatgtctcatatctgttctttcccttctgttatatttgccactgttaggcttttactagaaaatttctagactaatccctcctgtttcctgtatctaagccatgctttactttgtcatttctctactctcaaaattttagtgcctggatcctccattgcctttacaaggaagccaagttcttaaaatggtattcatggccttgtattccattttaacctaaatagttctgacattttcaatacgtattgttacttaatcgtgctgtgaatttagagagacttcagagagctgcatactagtccatttctctctcttttttttttttttttttgagacagattctcactctgtcacccaggctgcagtgcagtggcacgatctcggctcactgcaacctctgtctcccaggcccaagcaattctcctgtcttagcctcctgagtagctgggactacaggcacacacctgcgtccctagctaatttttgtgtttttagtggagacagggtttcgctatgttgcccaggctggtctggaactcctgagctcaggtgatctgccagctttggcctcctaaagtgctgggattacaggcgtgagcgaccactcccagccactggtccatttctagcacctcagataaattatttaatctctcagcctcagtttgctctgaaatgttagaatgttgtagtaagtaccttcttcattaagttgttgtaagtctaaatgggcttggcatgtagtaagcgcacaataaatggtagttatttttctctgctcatgacttttcatctactttgagtgttggtactgctcccaggtctgtccccttttttgaaacatgaaaatctcagtcatctctcaagatttagcttagattacacagctagtttagcctctcatctgaactcttcaagagatcgttagtattaaatacaattttgcgtaatagttatttgcttaccgttttttcccttttccattggaattcctaagtggagacataatgtcatctttagcatctgttgttactctaccatgtgatgaataggatggctgtacctgcagtttatatacttctccctcagtgactggcttcagaaattttgtgtgtgtaaaaacaatataagctgccattgtatttcataatattaatgtaaaattagaaatgtttttattggctgggcgcggtgactcacacctgtaaccccagcactttgggaggctgaggcaggtggatcacctgaggtccggagtttgagaccagcctggccaacatggtgaaaccctgtctgtactaaaagtacaaaaaattagctgggcgtggtgtcgtgcacctgtagtcccagctactcgggaggccgaggcaggagaatcgcttggacccgggaggtggatgttgcagtgagcggtgatcgcaccactgcattccagcctgggcaatagagcaagactccatctcaaaaagtttaaaaaaaaattcttattattgagaaggtaaactcaagcaaaaagctattaatgtggacaatattcattcctaattctattctatagataaattatgttatttcaccaataaagtgtaaaaacttctgttgcagacaggaacttgatagcagctgtagcattagtggagtttttcagactttgtacattaaagtaaatttgtagtaaattttcagtgcatttgggagccatttttgcatgagtagttgaatagatagaataattgcatgttagtgtgagaatacagatatgaaaacacttagagcagagaatctaaaataatttttaaggttgaaaagcaggatggcaaaacttggatctgtggttccaagctatgacctaaaagcctaatcagtcacctgaagcaaaaatttgttaaagttattatagcaataatttgttaaataggagattcatgcatatcaaagaaaatggggtctttgtcttctgaaaaccactctctgacaggttccatgaaaatacccatggctgtttcaaaaaagaatttcataaattttattttgaggattaagtatagtttttgcattcttgctcttatgacatatttacatgtttcactatgcatctaatgactgagaacttttcttatacattctaattcgcagtgtttctactggaaatgacttttgaaatccatttacctccatcttcattcatttactaaatataccacatttcactgatttcagtactgatacttttttatattttaagatctctgaaatcaggctgcattgtacaatcaatgggttgtaatatttcattggtagcgtttttccttgtttagtggtacataaagttatgcatcttatattgattgtgaatcaggataggcaaggatatagttcagtaacaaaactcctaaaatctcagcacaagggtgttgaatgtggaggctttgtactgcatctcattcattccatgtatgtctagcgtgagttagcagagagccctgctcagggaagtaatttagcgttccagttggttagagagcttccatctaaactttcttctcagtcactgcagtggtgggaaggaaatggaatgaattgcacacttgttttttttgttttgttttgtttttttgagacggagtgttactctgtcacctaggcttgagtgcagtggcacaatctcggctcactgcaacctctgcctcccgggttcaggcaattctcctgcctcagccttccgagtagctggaaggagctcacgtcacttctgctcagatttcaattagctaaagcaagttacatgtataaacctaatttcagaaaggtcagggcagaagaggagaattggaatatttgtgaatagcagtaatgacagcatagattaagttttaaattcactaaagtgtagcgatcacctggaaggtagatacaatgcaaaactagattcgaagaggaattggacatatgtaatatacatactaaattgggtctaaaaatttagaagatagaaaagctacttctgcctaggggtatggtaaacatcagttggggtcaagctcataccagagagcacaacatagggaaaaataacaggaaagtgggaacaagcaggcagtgagttttgtgtaaaaagaattcagttaaatagttgagtgtctactctatatttggtacttttacaataagagatgcaaaggtgaattgtgctgtttaacagctgactgtcagggtttttccatctcatcaatgttgacagtttgggccagatattgttgggcaggtggacatgctgtgcgttgtagggtgtttagcaacatccttagcccacatgatatgccactaccataacccaggcttaccaatccagaatgtctcctggtggacagattcaccccttgttgagacccatgagtctagatagattagagctggtaagaacagttgagaacctggcttaagtggactttaggacctggtttaagttcgtcccacaagaaatggaggaaaaaaagatcgccaatagattttagagttggaatcaagaagacttgataaatgaatataggggaaaggcgtgagtcagagaaaactgtgaacattaaagtctggatgactgggaattggtaccactagtaacaactggagaacacaggaaagaggatacacagctgggaggaataatggtgaatttagttttggttgtacggagtttgagatgctagtcattgtctatgtgaaaatgcctagcagatacggagatagagaaacagcttggaaaagaggtcagctccagagattatatagagatttgagaatcctctttttgtgggttaaagcgagatgggataagccctttaggacaaaaagcttagacatgggaaagaggagagggcaggaagcgtatactttatactttgatttgaggaataagaagtggagagagacctaaaggtgaggagaaacccttgaggtcgaagtgttacctactgatagctagcacagagtaggtgctgaggtcacagaatgtgacgagaatttcaagaaggagcggtgctcagtgttgcagagattaaggagtatgagattgaaaaaagcctttggatttaagagaaaggaatgagaaacaaattatacctactctatgccagggactttaacatgtattctctctattaattgtcagaataaccttgttattatcttcattgtacagacaggaaactggtgcagttaaggctgtttaagtggtggactagggattagtggccttcaagagaataattttactagtgtttggagcaaggagtggagagacataagccagataactggagtctataataaaaagtatgtgtgtattttcccttttccagaaacggcatttcagtcttgtttgccttgtaaactactcatctttggataaccagactcaaggactttcttctcttcttttgtatcctgacatacctctgctccctaagcaatttgtacttatctttgttataacatttaccagttttaataaatttacctgttgtccttatttcctgtgttcttcagggccaggccttatgtcttcaccatctttgtaattccagtagagcgcctagcctgtattaaatcagtgattttcaactctggctgcacattagaatcaactggagagtttataaacaaaatgaacgcacaggctcctcttgtgggtgaggcctggagtgtctgtaattcctttttgttgttgttgttgttgttgttttaaagcttcccaggtgatctgaatgtgcaactaggattgagtctcactgtatcactgtattaggggctcaataaatgttgactaaaggatgaggagtggagacagtaagtacaaattattcttgaaaaaaattggtagtgaaacaaaagagaaaaatatgtattactactttgttttttcctgctatttcattttaagaataccttttttttgtaagagaacattctagggtgtataagggaaatgattcagaagggaaaaggaaattgaaaacgtaagataaagaatagtttacataacttactttcttttagttgatgataatgcctactttggattcatgggtttcttcatattttaaataaatggtaaaaacatatttaaagaagaatcaatgttgagttctttagatgacccagtttcaggttaagtgctgtgggccctgtttttaattaccaatcaaaatgataattataaaggaaaaaaatttagaggaaaacttattaaaacaaattaccactcttaagtttacccatattaagataaattcacctgacacacagacatgtgatagtgatcacttggtcataaactatttaaatgtcataaagttcaaaaaagtggttttttcctccggttttacctctaattctcaaaagacatagccattttttagagagctgtggaagacaacttcaaataattcttttagttgaagtggaaaagtgcatagtggctcctttaattttactaccagtgtctaaagcagtgaccctttttggtgttacattttcttgagaatcaagtaaaacctataagtcatttctcaagaagactagacacttcaaattttacatctgaagtcccttagggcatgggtgcaatatctggtcacctttcagaatcacgtggagagattttctaaaacatagatttctaggtccccattctctggagatagattcactgggtctggaatagagggtgggaatctgtattttttccaagctttccaggtgagtctgactgccgttcatatctgaaaaattcctaccctaatgtctccttccttgatcatggcggcccataccatgtggaaattataggggctctaggtaggattctcagataaaatactgatgcctcagtaaatttgaatttaagctaaacggtgagtcatttttagtatagctatttcccatagtagtgtacctttggactgctggagagtgcagggtcctttgcttctaaatttaatggctctagatggctgtttgggggttttgttttttgttgttgttttttggtggtgtgtatgtgtgtacatgtatgtctgtgtgctaccatgcacatacattgtctgctttttatactttcatctcctttaaaccttgcttaaggtttaaaaaaattttttttaatttttgttagtttaccatttttatagctgctttggtgaggactctatttcctgttaaggaattgttttcttcagacagttttaaaatctcctggaactcaagttttaccttagtgtttgaaaacatgttgccaaatgttcagcaaaggcactagaacaatctggagaattcatggacataagcaggtgaagtaacattaattttgccatctatttctgtaaattgtggtaatgattgacaacccacagtaaactctcacgttgtaccctcatgttctagatggtaattataaaactgaagtagcactaccaattgcttctgacttccagtaataaacacatcttgaagaggtgacataggctgagggaacccagtcacttccacctgtggtacttcaccatggagcttgtctttgcttgagaaaggtacattctgtaccattaatgcaaagagtgacacagtcaaggattgcaaggcagaaagatacatgtgaagcttatgttcatccagccctccttccctttgttctctttccctgataagtttttcagtcttattcagcaatgtaggtgtaagattgtacatttccaaattccatattccaagtatcataggccattaaaagtactagatgttttgcactcactactttttctgagatatcactcaaggccaaaggcaacaattcaaaaacctgctgatacttgcctggttcatcagggtatcccataatgataccaaggcttttgatcacagcttctcatatcaaatatgctttaccttccatttaaggaggaccagggagttaggaacttcttgaggaaagtaaggcaccactactccacaggatttagctacaagtagtgtcctttttgggtctttgtgactcacctcttcccatcactgtggtaaatgttcggcttctgcatgtgttggtccgacatgatgtgtgaatgccgtaacaccagttagtatcacttgccttggctctttatctggcctcttgatcatactagaaagaatgtggagaagctgatttttctttttagattcaagatgtaggcacgttgtatacaatctgagggcatcagtgtctctgtctttgccagcagcacgtcaagtgcaatgtatagcaagcaatatccaagcatcagcagaaggtgtttttcactgcagtcagagacacttctgatcctaagcagcatctcctgacacttgacaaaaagaaagtagtgcatagtggaaagcagaagacagtttcctgtggggtttatcaaagtgaactgtgcttttacttgatggagaaaacagcattctttcctttctctcctaagggaagggactggggaattctctctaagaataatggaattaggctgggcacggtggctcatgcctgtaatcccagcactttgggaggccaaggtgggtggatcacttgaggtcagcagtttgagatcattctggccaacatggagaaaccccgtctctactaaaaatacaaaaattagccaggtatggtggtgctcacctgtaatcccagctacttgggaggctgaggtgggagaatcactcaagcccaggaagtggaggttgcagtgagcggggatggtaccagtatactccaagtctgggcaacagagtgagaccccatccctccccccacaaaaaaagtggaatcaacattatctggttttgaaagatgaatatccttttttttttttctttccttgcctgaactgtttatgactgaaatctgttcattttcttcagagtcttgtagggattccaaagaaggttgaatggaatcacaaactaccaaatggcaaagtgttcatttttgaggatggccattttaggtcttctaatttgctccatcaaagaacatttctcactatttaataaattaattttatcttcccaatttgtgtactaacaaggagttctctacaggttgaggagtagaaacaagtgaaagaagattgcctaaaattgatataagagcttctaattcattttctttcactccactagcaatatccataaaatctttcccagttacttgatcacttccaaagtctcagtagatttgcaataaattggagggttttttttttttattttttgtttttgagacagggtcttgctctgtcagccaagctggagtgtagtttcacagtcatggttcactgtatccttgacctcccaggttcaagtgctcctcccatctcagcctcccaagttgctgggaccacaggtgctcaccatcatgcctggctaatttttttttttttttaattttttgtagatacaggatctcaccatgttgaccaggctggactcaagtgatcctcccatcccagcctcccaaagtgttgggattttacaggtgtaagccatggcacctggccaaattggacattttaaaatgtttatgttatcccgtaactcaaagttctgatcattattttcatctgaggtatttattgatgtaaacttggattcttcaataaaaattcagttacatagaagtttagaggccgggcgcggtggctgatgcctgtaatcccagcactttgggaggccgaggcgggcggatcacgagatcaggagatcgagaccatcctggctaacacagtgaaaccccgtctctactaaaaatacaaaaattagcctggtgtggtggcaggcacctgtagtcccagctactcaggaggctgagacaggagaatggtgtgaacccaggaggcggagcttgcagtgagcggagttcgcgccgctgcactccagcctgggtgacagagagagactccatctcaaaaaaaaaaaaaaaaaaagtttagagcactcaagaggtttgactggctcctgaatttcagggctcagtttctaatgttttcgttcctatgaaggaacttcattttctgcagcctttgtcaggttggctcagatcttccttagttaaaacgttgttgtatgtcaaccacttctctcctcccttcacatccattggctgataggaaactagataatcacacttgtaaatttatgtctgagataaaaataatatgatctgtggagaatctcatgttctcttctaatgtttagactatatttgcttttagaccttatttgctttcttaaaacatatttttgagtatctgaattccttgcttcctgtgtgccttgatatgtccccagttacatatcttaaattcaggcttcaccggtaaggtaagtgagatcttgttttaattgcctcctcttcattccattggtgagggaggggttcttgccctggaattgggaggttgacagaacatacaaaacctgacactggacagatgagattgacagcagtttattaatcacaaatactcagcagcccaggagagaggagacagcacaccacgcaggcccacatgggagttgtgcttgagaacggagtgaacagtcaggggctgtaggaggcagactttagtaagtatcaagagggtggagtgatccctggttctcaggacgtgatccattcattgtttgataattccaagggctggccgggacccaaagcttgctactcagagataagaaggaactgtgtctgttccctgtgataaaagattgtttggctaggggaccttatctgtgggagcagagtgaggagaacttgcagttaggccattcagggctctccctgttttccctaagtgtcaaggcacacgtaatattgagccttaattttagtctttaaaccgcaagtctcaatagtgctagccagttatcaaaggtatttgctaatgattgctgtactaaataatataccaagaagtttttaatagtataatttgatcttagagttttcctttctgtatgaccttttcttctgatactttgcaaagtttaagatattctgctgctgtgtgcagtttcaccacagtagataaaaagatggccaaatcatgtatatgaagtgatatggcaagcgggaagacgagagttcttgtttgagagacctaatggagtgataaggctccagttctgtgtatatgtgggatgagaaagaatggataggttgtaggagctagaaagtggcagaaagattgcaaaggtagtaatagccattatttgagtgcttgctctgtgccaagcacttttctaagtgtattatctcatttactgctagtgaggaaactgaatttagtttgcttaaggtcatgcaggtagtaagcagtggagctgtagtctgaatccctgcttaatgttatttaagagcttttgctgttaacagttaatattttacagccttagaagagccttatatatcatgctaaagattttgaacttaatcttgttggcattggggaaccatcgagtgatcttgacagggaagaaaaatcagaatttgcattgaaaaataccagtctggtggcaaggtggaaaatgaattttggagaaagatgaggccagaggcaggacagctttataacaatccagaaacaaagtgcctgggtctgaataaaatggaatggaatcaaataaaaggggaatggacttgagcaagagacactcgctgatcatgtgactgactgtaggagagaagtgcggaatgatttctaagtagtggcaataattttatcagaacagaaggcaatacatttgaatgataagttcaaggtatctttgaggcattttgatggagatctctaatagataaattatagttagaaaaaggataggatctttgtcttgaatgaggttatgataggtgtgtacatttgagagttactgtgtggtgatgatggaagcaatggaaatggattacctagagatttattttgttcctcacaaaagaatcgtcatagaagacttacgctgtattgggaggcagctatgtaaaaagctgaggacttcatccagagacttcattcagatcttaattctggatctctgttttctctttcataaattaagggtaatatcagctatatcagaataatcatagataatattttattagggcctgaggtataagagttgagaaataatgatgcatgtcatctcccttagtttttacctttgaaaactgaggtttacagaagttaaaatagaaacaaaatcttggctacagatcatttgcctttacttatgtaaagccccacatcttaactgcgcattgccaccatctttctctcctgtgttgctattactggtgtttgaagtgagcagggtcaagtggagggggaagggtgacatcccaagtaagaagaaaggatgttgatgtatgggaagtgaatgcactgcagacaacacagtaatacatgggcataagccactcttgaacagtgtaggacacaaagaaactaacatataatcacttgaaaatgtctgtattccaggtctatatttaagaatattggccaggcgtggtggctcacacctgtaatcccagcactttgggaggccaaggctggtggatcacgaggtcgggagtttgagaccagcctgaccaacatgatgaaaccccatctctgctaaaaatacaaaaattagccgggcatggtggcacgtgcctgtaatcctagctactcaggaggctgaggcaggagaatcacttgaacccaggaggcagaggttgcagtgagcggagatcgtgccactgcactccagcctggcgacagagcataactctgtctcaaaaaaaaaaaaaaaaaaaaaaaaaaagaaaagaatactgggactatgctaatgcaggcatacttcttatctactgctattgctgctaataataatagctaatattatttattcacccaaggtcacatcgctaatgactagtagaggttagaaatccagcctgggtcagtctggctccagagatcatactgtaaaccattacaccaaactgtttctttttattaggataagtttttgtgatttttgaatgtaaattatttgaaaattaacaatctatctacagcagcagtccccagcctttttggcaccagggacccatttcatggaagacaatttttccacaggggatagcggggtggggatggatgggggaatgttttgggatgaaacttttccacctcagatcatcagacattaattagattctcataaggagtgcacaaactagatccctcgcatacacagttcacaatagggtgtgcattcctatgagaatctcatgctgctgctgatctgacaggagacagagtgcaggtggtaatgcttgcttgcccactcctcacctccctgctgtgtgaccgggttcctaacaggccccagactggtacctgtctgtggcctggggtttggggacccctgatctacagaattgcattagtgataactctcaaaatgttcatttcattgaaatactacattccctcaccattttgaataaataggaatttattcgtgcttatagatttattcaacctgtaatcagtagctactgagtacagagtatggggcagaggaaacagattctgccttgaagggagatttaatgtttatttattcagctaatatttgagggtctgctatttgccaggcaccattctaagcactcagatatgggagtatataggcagtttctcccgctctgattgatttttttttcttcccagactaagtcagtgctacactttgaggattttgaaagcagagggcctggaaagttggccaatttttttttaaagtaaatgaaggtaaatatatttaaccatagatgccatatcaaaaaagtactcatttgtcttgctttattataaagtctaaactagaacagtttatttttgagtttcaaaaatcatgagttggttcaaataattgtaaacttacattttaattaatcagaactcaagtaattagaatcctctatttaatccagaattatttaacttgattttaaggggatgatggctcattgtgaactgcagcaatgcctactagaatttgtttttgtttttgttttttgagagggagtctcactgtgttgcccaggctggagtgcaatagcgtgatctcggctcactgcaacctctgcctcccggattcaagcaattctcctgcctcagcctcccaagtagctgggattacaggcacctgccaccgtgcccagctaatttttgtattttagtagaaacggttttttaccgtgttgggcaggctggtcttgaactcctgacctcaagtgatccacccgcctcggcctcccaaagtgctgggattataggcatgagccactgtaacctgccttttttttttttttttttttttttttttttttttttttgagacagtcttgctctgtcgcccaggctggagtgcagtggtgtgatacggctcactgcatcctcccaggttcaagcgattctcctgcctcagcctcctgagtagctgggattacaggtgtccagtaccacacctggctaatttttgtattttttagtagagacagggtttctccctgttggccaggctgatctccaacccctgagttcaggcaatctgcccaccttggcctcccaaagtgctgggattacaggcgtgatccaccacagtgaccatggaaagtctttaaagtcagttggtgaggaggattagaatattaatttgctttcacattacttacatggatatttttgtagtgttaaccaaagcctctattaaattctagaataacatcacttcttgctgcctgctaatattattgaatatttagggctttcttgaggaagtcacattcttaacaattactacttgaatgatgactgctaacttctttttatccatataacagtataataaaaaagaaatagagccctatcgcacatcagacacaaaaatcaatcctggacagattgaagaactaagtacaaagagcaaaactttaaagttagaaaaaatacaggagaaaccatgcaacctcagagtagagaaggaatttttttccccagtctttaaatacttgactgtattcagggcattcttttacaaaactacagtacaattatcaggctgggcacagtggctcacacctgtaatcccagcacttcgggaggccaaggtgggcggatcacgaggtcaggagatcaagaccatcctggctaacacggtgaaaccccgtctctactaaaaatacaaaaaattagccgggcgtggtggtgggtgcctgtagtcccagctacttgggaggctgaggcaggagaatggcatgaacccgggaggcagagcttgcagtgagccaagatcgcaccactgcactccagcctgggcagcagagtgagactctgtctcaaaaaaaaaaaaaaaaaaaaaaaaaattacatcactaatgcaccttcccctccacccccgccctggtccaggatctaaaccagaatcacattgaattttgttgtaatgtctctggtcttgcttaatttggaacagtttctcagcattgtttatttttcatgaccctaactcttttgaagagtacagactgattattttgtaggctgtccctcaagtttagtttgtttcctgataattagattcagcctatgaatttttggcaggagtgtcacagaagtgatatgttctcagtatatactctcagggggcacttgatgtcagtttttcagtttttcttattactgttgataactttgatcatttatttggtaaaggtggtgtatggcgagtttcctcaatgtaaaattactattctttagtaattaagtgtcacctgggaagatacttacaaacaatgtaaatatcctgttgttttattattctgcccaccaactttagcctcccttgatgattttttgcttgcaagaattactgtggtggtcacccaaggtggttttctaattcagtccctccttttacatttattaattggaattctatgatgaagggcttttctttttcctccatttgttagtttatttctttatgccagtatggactcatagattcttgttttattctgtgggttaccattcattactaccattatggaatgggttgcttgaagaattattattattatttttttttacaaaaaagtaagcccataagaaaaacaagatacgaaaaaatattgtttgacagtaatacgtttgtattgtctcagacagttgatgggcagaaattattttttttctcagggctcacatgtattttggatattttttgaacaccccaattttatcttctgtataggtcactttatagtgactagtgatgtgtgctcttctacaagaagcgcaatagaatggagcatattttttatgttatatttgttacttatgtgtatatttcataccacataatatttggaatcaagagaaaaaatgtaatttcaagatttaactcaggttatacttgaatctctataggttaacttttcaaaaccactctatacttcttgatgtgattgttgtgaggtatgcttgtcagctgccagggactttatcatggagggatagagttaatctcccacctgtagccactggtccccaacaaaaccatgccccgaaaatccagaattagattagaaataaaataaaactaataactctttcgtgattttgactccagtttgtccagaattgactttgaagaataacatgtggaggaagatggtggataaggaaaaaaaacatttagcagtgggcctagaaatgtatctaataactcactagattctttttaaaaagctataattcccaacggtaaatagaatgtattcacttaccctccatgtttgttagataaactttaaggaaatacatttgtaattattttcagaaattctactcttgggacctacctattgttaactggtattttttttttcttttttgcatttagaaatgagctagaataaataatttttaaaattaaagtcagcgaggaggaatgttgagtctgtagcagtggataaaaaatacctggatggttgaacaatatcttcttaggaaaacagtcaaaacttttactgtgagagacatcctttcttttgtctagggcctgagaaatccaaaggtcagattcttaccttttgaaaatcagaaagaaccagattaaagtatttcaggcacggctggtttaatccacattgtgtttggggttctcagccagtctgctcccttgacctcccaacccttagtggtacttttgacccaccattcactttggatgttgtggaagtccagtaataccttttgattactgtgtacatttagtgcaacagcaagggcaaataagttcataggataaaaatgcagtacagatcatttttgctttcttggtgaaaacccaaaatagagctgacgaaaattctaaatggtatattgccttttttggaaacaactaaaatttttaaagctcaactagttaaatgcattactaaatatgctatatgtgtgctgcttgctatcaggaatttaatttagccagttttataggtagtgtttgtataagtcattaggagtattaaaaataattacctcaaaattctaaaagtgttctgttatcacatttttaatttttgcctgtgatagtgatcaagacttcagtataaatacttcctaacaactccttctctcaataggaaggggatggggcagaaaggggataaggaaatgaagatacttacgtaatcataatagactccagtgtatgtttggcatgcacaatggcctataccctactctctccttgcctttttaaaattgctatttatactttacattttaatagtactcttaaacgttttagaagcaatatgttttgaaaacacataaaaaaatttattttttcaattagcatatagtgagtactcttttttgatgacttttagcacatgtatagatcaatgtaatcactaccaaaatctagatacatactagtacagttccatccaccccagaactctgtttctttttcctcgtctcatttctctgtttgtagtcaaactcttccccttccccacccctcagcttctagcaaccattcatcttttcctcattgctctaatattgtttatttgagaatgtcatatatagggaatactgtagagttactatgtaaccttttgagattgacttatttcattcagcataatgcttttgaggttcatttcagttgtcacatatattaatggtttgttcgtttttattgctgagtgatatttcattgtgtagatataccatggtttatttgtctgttcacccatttatggacatttgggtggtagattatttccagttttgagcaattatgtataagtttttatatgaaaataagtttgcatttctgaagggtagatacctaggagtgggattgctgtgtcctgtggtgtgtgcttgcttaattttataagaaatggccaaactgttttccatactggttgaatgattttgcatttccacagaaatgtatgagagttcctgttctgcatcctcaccagcactgggtgttatgtcctttttattttagccatactattaggtatgtagtagtatttcgtgatttcaatattcatttctctactgactaatgatattaagcatctttttgtgcatttatctgtcttatatatactctttggcggcgaagtgtctattcaagtcctctgcttactgttttcttacttttggagtcttgtgggtactttatatattctgaataaaaatcctttgttgaatatgccatttgataatattttctccagtttgtaaacttgtcttttcattctcttaacagaagtcttccacagagcaggttttacattttgaataagtccagctcactagttttttttttgttgttgttgttgtttttaatggatcatggttttggtatcatgtctgtgtgtggacaaaacacctatgtttttttttttgtattctcccactcagcacaacaatcaacacagaacacttctgtgacccagtgtttggtggggagaggtgggagtcccccaccaaaaatcaagcaatcagttctacagtggacaccagctgggtgtcatgtaatttaactccaataccatctacctggagatagtcacatcccacaggtggagggctgagtccccaagattgctccttcccccacttcagacaccagtcacaagtccgggcattaggaacttctgactgaccagctatagatccagattctcagaacccccttttcaggttcaataatttgctagagtggcccacagaactcagggaaatgcttacttacatttaccagtttattgtaaaggatacagatgaagagatgcatagggtgaggtatggaggaggggatcagagcctccatgctctccccaggcacactacccttcaggagcctccatgtgttcagctcttccgaagctctccaaaccctctttatgggtttttatggaggcattattatgtaggcatgattgattaaaccattggcgactggtaataaacataaccttcagcccttctcccctccctggagtggaggttaggaggtgggtcagaagtcccagccctctaatcttgcctcctctttcagtgaccagccccaccctgaagctatcagtcaacattagtttggaacactaagaagtttgaagcagaatctatgattgatgtcagataccagatagataacaaaaagatgataagatgataacaaaaatggtatttaaattagtgcttaccaagtactttagatcatttactcttcccaaaaattctatgagctagttactattttatatgcactttttaggtgagatagctaaagtagaggagattaggtaactgtcagtctgattccagaacctaaagttctattaattacaaaatgctgcttctcaagttcaaaactacaaacattccctttgtcttaaatagatgttttctaaccttttgaaggccttgtcatacatgtgacctctaactaggaacatcttcattctagccatctataccttttttccatgtttctctcctctgaaaatggtatctgtgcttagatacatgtacatgcacacataacacatacacaaacacacacagccatttccttttctttccattatttttagtttctacatcaaagcaatgatagtgctatcaaagtggtagatataaaaataaatcaaggctttgtttttgccaaggatggtcccttcatacagtgagtacttgaatgtgcataaaaatcacctggagatgttgtttaaatggtgtttcccaggacctgtctccagagattctgattcagtcagttggtctggggccaatgaatttgcacttttgacaaggtgctgctgaggctgcttgcctaaggactacactttcagggacactacctcagcttattcacaggtaccatgtagtgtgattggatggctcctatacataaggtgctttcactaaactattatgttgggcacatcatctaccctctcagatatattttcattagtgattaatctctttatcaaaataggctttattctcttaaaatatgcctgttagcacacctgttgatgttcaatctcctacttgtctttgaactaagatttcctaagatctggtcaggtctcctgttaaaccttttgaacttaaacttttcctttctcctttttttctacatgttttactaatttgtgagtttttaatcaaatatgtatgtcattgttcttcattttatttatgcctaaatgcgtcttgtcttcacacatagaaaattttgtcattgatttttttttcactttagtttagaagaaataaaattccttataagaaattgttggccaggtgtactggctcacgcctgtaatcccagcactttgggaggctgagatgggaggatcctttgaactcaggagttcaagaccagcctggataacatagtgagatcccttctctatcaaaaatacaaaaaattatccaggtgtggtggcacgtgcctgtagtcccagctgctcaggaggcggaggtaggaggatggcttgagcccaggaggcaggggttgcagtgagccaagatcacaccactgcactccagcctggtgacagagcaagaccctgcctccaaaaaaaaaatgaaataaaataggccagatgtggtggctcacacctgtaatcccagcactttgggagactgaggcaggcagattatttgaggtcaggagttgaagaccagcttggccaacatagtgaaacctcatctctactaaaaatacaaaaaattagctgggcatggcggcacgcgcctgtagtcccagctacttgggaggccaaggcaggagaatcacgtaaacccaggtggcagaagttgcagtgagctgagattgtgccactgcactctagcctgcgtaacagagtgagactccatctcaaaaaataaaaaattaaagttaaataaaataagaaattgtttatctgtaagcagctttgaatctttattcattcagtattgtatattttatctacattcagtctgtatgttgtgattatattaaattattgaaacagtagtgatcttaaggtgattgagtgaaaaagtatcactgtatttaaaatcttaagccattttcagtagagctttgaaataatataattttgcatgttttgtgcttattttagcagaagcctgtgatatggaacatttatatctttctttctgtttcaggtgcgtatagcagcaaaattcatcattcatgcccctcctggagaatttaatgaggtttttaatggtgagtgtttgatttataacactaggcttgatatatcaagccctctttttaaaagaaaaccaaaataatcaaaataagctaaggacagtatgcagaaaaatctgtgttttctgaattacaatgacaatatgttagtctggattttgtaatggctagaatataatgtatttatttatatatgatgattctgttagcaaattaacccttttaaagcctgaaataaattttattcatatcactgactagaatatatcctcattctgggaaaggagagtctttttggtaaatggttttatttaagtaaaactataaacgcatatagtagatatttcttcagtagaactcttaaatagtttaaaaagacaacaggccaggtgcagtggctcactcctgtaataccagcactttgggaagatgaggcaggcaggtcacttgagaccaggagttcgagaccagcctgggcagtatggtgaaaccttgtctctaccaaaaaaaaaaaaaaaaaaaaagccaggtgtggtggcatgctcctgttttgagaggctgaggttggggaatcatttgagctcaggaggttgcagagagccgagatcacacccattgcactctagcctgggcaacagagtgagaccctatctcaaaaaaacaaaaacaaacaaacaaaaaaaagtttcatcatgaccatatattttttggaattgtgaaaggaatttttgtatttcttttaaagaaaatcctatgagatcggtatgaatagccaaaagaaaaagggaaaaaacattttcatcctgcatagagcatgatagcacatgtaaaaacaatttgttatttaaattatgtcttgtaaatcacttcacagtatgcgttcctttaaacttcactggcagacgtttttataattattcacccatagatctgaaatttaaactgctgtaaagtctcctggttactatagactgtagcaatagctgctcctcagcagtaagaacaacatgcctgaaagaaaaatggcctgtagtgatctctttataaaacttcttaagtagttagaaaaatacattactttcaagtactatctataaatgtgttgttgtttcttcttcatatacatttgaacttcaccgtgtcttaaaagtgaatttacacagagctcttcagtttccgttttttaaacattctactccatagtaaactagttaaatgttttttaagaagtttaatcatttttttttcttagtataagatataggactgggcactgtggctcactcctgtaatcccaacactttgggaggctgaggcaggaggattgcttgaggctgggtgtttgcgaccagcctgggcaacatagtgaggcccccctccccatctctaccaaaaaaaaaaaaaaagatataatggaatctcacctcagaaaagattagttttgaaagtcagaaagtgaggcaaaagttgtataaagttaaaattaccctagaaatccctgaggtcatccacaaactacaataatacatgatttagtgcatacaattacatatggcagttcttatgcattttaaaatttaactactgagctgtacttagaaggcagaatggagaattggcattgtaaaaaaatccagaaattaaaatctgctgtttaatataactacaaaatctcatgtagtgaactagggagttggagagaattcagaagtacttttacttcgtgtaagatttcacttcttttttaatattcaggttctgtaacctacatatacattaatacatttgatggttgggggattaaagaagatagtctcttcctccttagggtcaaaaagtggcatgtaacttaaattgataatggtgagactgcactaaagtcagtagcttcccaattacaattcacagagccaagaataaacagaattttaagaaaaattttctacatacttttcttaccttgagttaaatgccctgcatatttaatcaggaaagtcctaaaagaatgtatgcatcctagaaattgctttcctaagtctcatttaaaattgacattgagttaatatattctctgttgagttgtagtaaatttgggcatttaggatgagcctattaaataggcctgggtagagggtaagctatggaatagaagtggggatataggatttatctaataaattttaactgaaagaatatttaagagttagataaaagggtgggcatggtggctcatgcctataatgccagcgctttgggaggccaagcccggtggatcacctgagatcaggagttcaaaaccagcctggccaacatggtgaaaccctgtctctacttaaaaaaaaaaaaaaaaatatatatatatatatatatatatatatatatatatatatatacacatatatatatatatatatatatatatacacacacacacacacatatatacaaaaattagcagggtgtgggtggtgcatgcctgggaatcccagctactcaggaggctgaggcaggagaattgctcaaacccaggaggcggaggttacattgagtcaagatcgcgccactgcactccagcctgggtgacagagtgagactctgtctcaaaaaaaaaaaaaaaaaaaaaagagttagaaaagaattaaatatttgaaggtaaatatgatatgaatgtgattattttctatttttattgaaaaccacagtgtcagaatgattccaaaaagagccacaaaattttagaattacaaagttaataaaaccttaacagttagatggttcccaaatgctgtttcctaggctgactgtgttagaatcatcgaaacatggatttctggtcttcattctcaaacatctcaaacatatagtcatagatctggactagggctctgaaatctacattccttacatctcctgtcctccaccctgtggtttatgtgttgcctgacttggagccacagcctgatttcttctttaagagaaatattttattcaaattatcctctttttatttcttctactcttcttatgataaaagcatggatttattatttttttccagagtagagctgacaaatagatcttgtttttcaatcatttacccatttggaactggaataggcatactgtccatgcaatatcgctgttcattatgtttaaactattgatgataaatttatcaaatagaacttcccactttgtgggataaaaataacagtaattataaatttctctattttttaaaatagttttttaggcagaagcatccattgtttaaaatcagttaatttcaaaattaaaatagtattatttcagtggttagcaaaggatattgttttttgtttgtttgtttgttttgagatggagtctcgctctgttgcccaggatggagtgcagtggcgtgatctcggctcactgcaagctccgcctcccgggttcacgccattctcctgcctcagcctcccaagcagctgggaccctaggtgcccgccaccacgcccggctagttttttgtatttttagtagagacggggtttcaccgtgttagccaggatggtcttgatctcctgacctcgtgatccaccctcttcggcctcccaaagtgctgggattacaggcatgagccaccacacccggccaggatattgttttttaaataaggacctgttgctgaaaagaggtgaggtatgtgaataggcagtgggttttttcttttgaaatggctttattgtaaaaatgattcatagtcattgtaaactttccaaagtacaaaaaagaatctaaacttcacaaaaaattctaccttccagttccctgttgttcaaatgaattacttcaaacatctctcaactaacaagtatatttaacaatacataaatatgataatatacatactaaatttttctcttcctgtttattatattacaaatgtatttccatgttggtaaatataagtgtacattatttttcatggctgcctagtttcacactctatgtaagaattatagtctttttacatttaaccagtttcttaatggaagatatttaggttgtttgtgttattttcatctaatgaaaaattagaatacattgtattatttactttataattgcaactaagtaaaatagccaggtgcttaggaaaaataatgaaagaaaatacagtaagactagaaaagaatttggttttttgatgagagccgtacgtgacttttttcttttatgttttacaaagtgcttggatttttttcaataaaaatgctatttttgaagtcaccttcaaaaataagaataatcctaaatcttttctgcagactttaacataccatatttccagtggagctcatctcccctttagttccttggagatacattacatatagcaggggtgtccaatcttttggacacattggaagaagaagaattgtcttgggccacacataaaatacactaacaatagctgatgagcttaaaaaaaaaaaactcacgatgttttagagtttacaaatttgtgttggattgcgttcagagctatcctaggccatgggttggacaagcttggattttagtctgcctgcattgactgttaagggtgtaaacaagtatgtatttctatttcattccccttcatatttactaaccaaaaccttttttttttttttttaatactatgttgtgtgtttggttattttggtcatgagtgatattttgatcttgcttgtgtttggggtgggaggtgttaatacatcaccaaaacaatctgcgttcattacattcttgaaacatataacaataataatgtagataacataattgttttgcagatgttcggttactgcttaataatgacaatcttctcagggaaggagcagcccagtaagtattatttatcatactaacctaactaaaatgacatgggaaaacgagagatgctttaaaagtgtgtgggggttttttgtgggtttttttgttttgttttgggatggagtctcactctgtcgtccaggctggagttcagtggtgcgatctcggctcactgcaacctctgcctcccgggtacaagcgattcttctgcctcagcctcccgagtagctgggactacaggcgcgcaccaccacgcctggctaatttttgtatttttagtagagatggggttttaccttattggccaggctggtcttgaattcctgacctcgtgatccacctgcctcagcctcccagagctctgggattacaggcgtgagccaccacatccggcctaaaagtgtttttaaagcactaatctctgacatagatatttgcacatcaagttcaaatgtgtatgattttatatatcctagccagggtaggagaaaaatattttttatcacagaaggacttagaggtacaactatgacatgaaattattcactgtgtgtctagcggtgccttatacattcagttaatactgtattttggcatttgcaaagttggaagaaattgtggttgctaccatttttatgtagattttgcattttcttttatgtttgaccctaatagcttttgagagcttttaaagttgtgagtttatttactcataaatgcctaacgtagtacctgacacatacatgtacactgaatttttgagtgatttaaagaagtaggcaattctaaatcttaatacatcgtctttgcaccagtgaccccagccatgacttttcgcagctatcctgcaatttcagagaaataattgattctctccctacttctcccaaaataaggtctagagactgttattttaggcttaccgattctactactcatttgaaaatgatgaagtagtgcattctttcttacaaagaaagtttagtatccatccagtcagttacttttcatcctagtataatacccaatatgtaaaatcctgactgatggctgggtgcggtggctcacgcctgtaatcccagcactttgggaggccgaggcaggcggattacgaggtcaagagattgagaccatcctgaccaacatggtgaaatcccgtctctactaaaaatagaaaaattagctgagcatggtggcacattcctgtagtcccagctacttgggaggctgaggcaggagaatcgcttgaacccaggaggcagaggttgcagcaagccgagatggcgccactgcactccagcctggtgacagagcaagactccgtctcaaaaaaaaaaaaaaaaaatctgacagggaaaatttctctgattttattgttagaacatttgaagcctttaaaaaataaaaaatggcctttatgaaggtagaggttcaacagacttgtgggcatatctgcttttgcttgtgattaaaatttctgttatttatagcagttttttaattgtggaaaaatacacataaaacatactattttacccattaagtgtacagatcagtggctttaatacctttatattgttatgtaatcatagccaccatccattttcagtacttttttcatctttttaagctgatacttgaaagccccaggcaaccatcattcaactacctatgaatttgacaacctaggtacctcttataagtagaatcttatagtatttgccttttgtgactggtctattttacttagcctaatatcttcaaagtttatccatattgtagcatgtgtcagaatttccttcctttttagggctaataatattctgttgtatctgtatagcacattttgtttatccgtttatcttccaatggacacttgagttgctcccacccattaattatattaaagtgcttcataggaatcagtgtagtttatccttttggttttagttaacaatttatgagtaaatgaccacttgctcctaaatattttaaagcttattgaaactttttatatattaaagtaaaattaattttctttataataatataaaacatgttgagaaaagtcttatggatgcaaaggaaacatacagcgtttttgaacaatactttcaaagtaagcttttcctttgtgttctctatgttaaataagttgtgggtttcatgtggtgcaaaaatgagtggattttttttaagtcaagaaatgagaaacttggtaagtcagagtactattcatatttatataaatagcatgaaatagttatacatttgactcaagatacgtgaaagtatgggacttttatttgtccaaagaattattgatctgttaatgattgttagatttaatttaaataaattatatttgttgtaagagaaatttgaagatgagcttcatttctcttttattataaaccaaatttctggaacagctgtgatccacacttcatgtgcattgtaacaggaaatacatgatattctgatcttttaagtaaacgagtatttgaggacatcggtaattgtgataaaatatgatgcttatagtatgaccctcagaaaaaactcatcaaaacctttactagaaacttcagattttctttgcatgtagttataatctcagtgaatgtttgcttactagtaaaaaaaaaaaaatagtttgattgacttcagtagtatgcaatttctcaaaactctccatttgagttcatgttgtagacatctctgggtgtctgtgaagtacagaatatatactgtaagtcactgattgacttgactttagaatgctattactctggttcacagtgtgctctctgtgaaataatttctgagcaaaagtagtgttaccctgttcttcatcccacttagttctgaattacttttgtcctcaaaagataataatttgttacctatcattgaggccatccaaaactacgtaacaaaagcttagaaggcattataaaaacatttagaatgtgttccagtggcagtttcactagggtaagtgtatagctatagactgtttctttttcacttgcactttttgatgttgaatttcttttatacaaatacatctttcccacatatatgtatgtttcctcctttcctccacctttgccttgttgctttatctcctttttttttctttgccctttaccttttttgtagtggggaaaacatgacaattattctttagagtggttgtaatgggacatctttacaaaaagctaccaactcagtatgtttcagagcaaaattagccatactgaagagttggtattgtcaagtcaagaacactttgaaacatccagaaatagctttttattcaacagacattgctagactttgctgtgatgatgagataaataagccttttagggattttccagtggagagtcagacatgtttaatattagaccaagtgaaacgaaatacaatagaggcatgtgaaagggctttataacccaaaggaagaaattttaaatttctatttagaggtggtttttgagctgttttaaatgaacaggattttaatagtaagaaaaatgatgtggctaaacttagggaagagcatggagaaaagtataagatacaacttgatggaaagggtataaaaatctaaatacagtaacaggtgacttagaaattgattgggcgacagaattctgcaagagcagggagaacattgtttttaccgtgtctagtagaatgcttagcttatagtaataagagctcagtaagtatttgcatagatggaggggtggatgaaggaatgatgagtgggtgcatgaagtgagttttatgacctgaagacacttgaatttatctggtccaaactactgtttttgtatctataaagtaagtgaggtggcctgtactggttaatgatatggttgaagcaaaatttggatattatcactcctagatgagtaccttttccactgtactgtgtaattgtcaccatttaacttattttgagcctttaagataaaattttaacctatttcatattacttgtctccttttcagatttcctatttttcctttatcccctcctcccaagttagaggtggatggcgttttatattacgggcaataaaaggctttcagtccagcctgggcccaatttactgtttaaacttatttaaatatgaccttactggaaaatgaatccaaaattctaattgacttggttttaaacatacttttgggataaatcatttaaggattaataatgccctggctgtattgagtttattcttaggaaaattacagttttcgtgaattaggaaaatgagaagtgaatagcttcttttttctttctcacccttgtacacttctgtattcaatgtcatcttttttgagcatgtagtatcaagaatttgacagctaataatttaattctactttgctatttttacatttactagtctcctattaactcatcagtaacgctttgttcaaccaggctttcctttctagaggagactcaggagctaatacctgaaaattcagtggacgcctggccatcccgaataatctggaagtttccaagtagattagagatgtatttctgagtttggaaattctcagtatcctttctgttaagtgacagtgatttcccagattttagatttaatttaaaaatacaatttttagataatattttatactcttgagaattttttctatacatatatatggtaatgtattattctttactcttatggagtagatagagagtagctttattcttggatccatctcgtcaccatttcctacctcacactctgcggtttttaaccttagcaactgcctaactgctttttctggctctcgttgctccactgcccaattcatcatctacactgctgccaaattaatcttctttagaagtacttctgtgttctcctttctcaaaaagcttctgtaactctgctctgtctcccaaataattattccatcattcagagcctttcagttcatttcagtaagtataactgaacacccgctatgagccaggcattgagcttggtgctttctgtgatgttggacctaacttattttctcaggcattttgctcatacggtcactctgctcttttctgcccatccctccaatttccataaaccagagcctatccagtttttcaagtcggtttttcagtatcacagttattaagaaattaccccaattctcttctcttctcactgttgcctcaacagaatgtaatctttttttttttttaagcattctttgcagtgcttcattggtaattctcttactatgcttcatactttgtgttatggttatgtttatccattttctcttttattcacctgtaggcctttgatcagagaatgtatctaagtattctttgcatctcttacagcacctagtctgtttcctggtatactaaatatatacttgaacaattggatgcatctcttatcagtaactaacctttattttcaggttcttgaatgaaaaggccagttatatttactgatttaattttattttgctaaacattgaaagctggacatcattgttcagtttttaaaataggcatgtcattatttgtagttagtataagttcagtaatggagaattacaattttatttattttgcagtgtgcaatgtaggaggagactttattgatgggtgaattttttgaccattgtttttaaaaaacattaaatatataattttaagtaattgccattttcttttttttagtgcatttgcacagtataacttggaccagtttactccagtaaaaattgaaggttatgaagatcaggtatgtttcatataaacactattctttgttttgtttataaccgttaaggtatcctgcaagagctgtgaagtggtatgctgcaagataaaaaattattcatattttaatcataaccacttatgggcaaagtaattgaagttttactttcttttggtgataccagtaatactattagcagaaagtcccttttagaaatactcagatgtagttcatttaagattttagtaaatgattactgtaaatctactttcttatttttttctgggaaaaaaatcaatcccatattaatccaaagtctagaatatatgtgtagtagatttatatcataatttggttgctctggaattctgtagttcttcatgtgagtaatttagcatttagtgattattaaatctcttctttccaaactacaagttagatttgctaagctaagaaaagccacaaaaggtcactagcattttttttttatttagagtttctaataaatagtgattatatgaatgcatttcatgcttgcatgaaggacagcttatgtaaaacactatgaagaagaactggtaggtagaacataagcgaaagtggttaagaaagaacataagagaaagttcttagtggctaatcatgtcaaagcttttatttggcattagtcgttacgtaatatgtagtcatagttacgggggacaagcaaagactaggctagaaggtgacttgtaactgaagggaaattttaagcttatttatagatatgtgtgtgtatatacaaagctatgtagagtgtcattgtattaatctgcaaaatttattttatctctgggaagatttgggtttttttttttttgctttttctttactactataaataatgccatattaaacatctttgtacctcttatattaacaatttttttgggataaattgctataagaaaatttgctgtgtcttttaaaaatgttagatagcctccaaagtcactttatgaacctagtgtaattttaatattaaatatttaaaactaaaaagataaaacaaaaaaggtaaacagtatactaacttcacatggactatagattttaaaactttaagtaagatactaacaaataggatttagagatatatccaaagaataatataccaaaactaaacagaatttttacagaaatgcaaaaatggttccatgtaagacatattggtcttacatattaataaagagaaaaatcttatgatgtatcaatagacagtaaaaagagatttgagaaattcagtagccattttctcattaaaaataaaaattctagtaaaatagagaatcgaagaaaacctcttaaatatgaaacactttaacaaaaattaatagtaaatgtcataaactaaaacattaaaataattttagttaaaatgtaaaattagctaggtatgcctgcttatcagcattatcatttatcataaatggagatgtagcaaataagacaaaaacatgagaacttgtaaaatttggaaaagaaaacttatttgtgacatgatttatatatttaggaataccaagagattctaataatataactcccaaccaaaaaaaaaaaagctattagaattaataaaagaatttggggagatgtctgaatttaaggtaaggatacaaaactcatgagttgtcctttattacagcaagtaaggacctgaaactagaaatggtgggggtcagagtgggccagggaattcaatttaaaatgatggtaaaagttacagattaggaataagcttcatcaaaaaaaggcatacgattatgaagaaaatagtgacggtcttctcaagcaacaaaagcaaaaactgacacatgggatataattaaagagcttctgcacagcaaaggatactatcaacagagtaaacagacaacctacagaatgggagacaaattttgcaaattatgcctctgacaaaggtttaaatccagcatctataaagaacttaaatttaaaagataaaaacaagcgcattaaaaagtgggcaaaggatatgaacagacacttttccaaagcagacatacttgaggccaaacaagcatatgagaaaaaagatcaccatcactgataattagaaaaatgcaaatcagaaccacaatgagataccatttcaaaccaatcagaatggctattattagaaagtcaaaaaataacagatgctggtgaggttacggagcaaaaggaatgcttatacactgttggtgggagtgtatattcaactattatagaagacagtgtggcgattcctcagagatctaaaaacggaattaccatttgacccagcaatcccattactggttatatacccaaaggaacagaaatcattctattataaagaaacatgctcacatatgttcattacagcactattcacaatagcaaagacgtggaatcaatctaaatatcagtgatgatagactaggtgaagaaaatgtggcatatatacaccatagaatactatgcagccgtgaaaaagaacaagctttatgtcctttgcaagaacatggatggagctgaaggccattattcttagcagactaataaaatatcttagcagaaaatcaaatatcacatgttctcacttattagtgggagataatgatgagaacacatgacacatagaggggaacaaaacacactgggacctatcagaggatgaagggtgggaggagggagaggatcaggaaaaataactaatgggtactaggcttaatacctgggtgatgaaataatctgtgcaacacctgcatgacacaagtttacctatataataaacctgcacatgtacccctgaactgttaagaaagaaaatagtgatactcttcttgaaacacataaaacaggatctgaccaatggaaaggtgctctacattccattcttagatagaaaattaaattattttaaaagtaatgtatggatttgatgaaatttgaattagaatcctgatcagtttttttttaattggtcaatattttcataaagtttatgtggaaaaaaaaacatgcttgaaataacgaagaaatgtgtgtgtgtgtgtgtgtgtgtgtgtgtgtgtgtgtatgtgtgtatatatatatatgtatatatttatgaaaaaaccattaagcacaatgagggagaattgccttaccagatagtacaagttgttttacagccaatgttaagtcaatgtggtggtgtatggagtagacaaaaaatcattagagcagcatggagaaccagaatttagtctcagaatatatgaaaaattttatacagatattggcataactggtttctataagaagaaaattaagttggacctctgtcacatacagtatacagaaatagatttcaggtggttttaaaatgtgaaaagtggctaacattttagaagaaaatctgagtctacatgtgcaatacagggctagggagaccatcttaaataacactggatacccaggaagtataaaagatggacattttactataaatgtttttaactgtagaatgaagcctatcttaaagaactcttataaattgataagaaaaagacaccagataaaaatattttattatatttgctcacagaagagcaaatgacccacaaatgtgaaaagccatacttagttttatcagtagtcagtggaattaaaatgatatattttctaccatcagactaaaaaaagagctatagtgcctatcattggtggtaatatggatggaaacatactctcatatatgtgtagaaatttggattgtcacaggagtatatattaaaaattataatacctgatgtccctaccaccactgcttgggaatttattcaatagaaataaaaggatccaatggaaataaaaacatcagtatgttaaaatatatgtacagcaatactcatttcaccttttttgttgttgttattgagtcagggtcctgctctgtcacccaggctggagtgcagtgacacaatcacagctcgctgcagcctcaatctcctgggctgagtagctgggactacaggcacatgccaccacgactgactaattttaaaaaatttttttgtagagatgaggtcttactatgttgcccgggctggtctcaacctcctgagctgaagctatcctgcccccttggcctcccaaagcactaggattacaggcatgagctaccacacccagtcttatttcaccatttttaatgtgttcctcctttccccgaaaaaggaaacagcccagaaataaagagatggcacatcagtagtggattggcagactaaattatgttataatcacgtcatgggacattatgcagccatttaaaagaatggtgagaaatatatcacttgactttgagggatttccataggatgtttatattgaaagaagccagatgcagagaagagagtgtgtgtgtgtgtgtgtgtgtgtgtgtgtgtgtacgtacacacacacattttcattgcattcttataaaataatgaccagtcgcttctcggccttttggctaagatcaagtgtagtaaaataatgaccaaaaaattctgtgtgtatgcaagtatagacatgtgtatatctttatctgtaagattttatgactatgaaaaaaaatttagaaaggtatatcctgtgttgttagcatgatatatatcagagggatggataagtcccgacatagctaaggagtcaaagactggaagaattacaagagaaggaaaaggggaaattttttaaataaagcacaaaatatcagattatacattatgcattgtggatgtattatttaaatttatggaaatgaagtatgtttttaaatacttggaagtcaattaaaatcagttgtcaatgtagtttttaagaagcaagaaacagatacgtcaaagtaggtaagactgtgggcccagaggcaaggtgggggacacaccaaagaggatttgcaccagaccaaagccattcaggtaaccaccctgattggaggttctcacaagttctgtagttttgaggaactggagtctgataccagacattgtaaactgttagagttctcaaagcagaaaacccaccaaacccacttgaacagtgtttttagaggttgcattttttttcaccagtagctggaagttatattgggagaaaatctgatctgcactggatgagagtaatgtcattgtctgtatagtcaactcatttgaagtattaatagttgtaccatatggttaaaatatatgcttggagtaggattgttttatagttttaaggaagaagcttaaatgagtgtaattatgatgtatcaatattgaaatgctgtttttttattttttttctaaattcattccatcatcaaaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtaagtcatcagtagcagctttgtgtgtgtgttttgtgtaaatgtgagtctttagcgtctcttaaaatttacagtaacttacagaattgacattgtataatttgtcatttttttccttaaatatttctaagaatgtttactattttttcaagaaattctggataataaatagatatactaggatggcttaaaatagagaaatggttgtaccttgatttaaatccatgtagaaattctaatacattgattaaaggagcaggatatggtgagattctgtaatcttatgttcatgactcgtctcagtttagatcaaagttatttttattaagtcacagaaatcttagaacaaataaaattacttggaagtaaaattatgtgtttctgtattttacagttacatttcttgtgttttttgtgtggttctttcgtaggttcaacctatttttatattttcaagaaatatatggctgggcacagtggctcacgcctgtaatcccagcactttgggaggccgaggcaggtggatcacctgagatcaggagttcgagacctgcctggccagcatggtgaaaccctgtctctacttaaaaaaaaaaaaaaaaaaaacaattagccgggcgtggtagcacgtgcctgtagtcccagctactcgggaggctgaggcagaattgcttgaacccaggaggcagaggttgcagtgagccgagattgcgccactccactccagcccagtcaacagagtgagactctgtctcaaaaaaaaaaaaaagaaaagaaaaaaaagaaatacaaaatatggtagtaggaatacatttcttttttaaaaatttcataatattatttgtaccctgacaggcttttttagcacccccagtttgtgcttcagtggccttttccattgccagagtgatcttttgaaatgcaaatcaggtcattaaaattccctgcttgaaatccttcagagatttcccgttgcctggacttaagagtccaggcttttgaaggtggcttaaaggccctgtgaccacgtggcctctgcttacccctccaacctaactctaccatatatcctagtttatacctgctttctcaatgtaattattaatatcaccagtagcgtaccccatttctttcttggaagtttcctggttaggacaaaaattcatatggtctgcttaagtatctagctctctgattatttgagaaatattgcaacataacctcaaatatcttatgtattacttgaattataacttgttcatcaggattattttggaggaataacgagagtcaagggagtacttgttagagagtcctcatttgttctagaggattgaaaggcacaaattaattattatttttaaagcagtaggcaagaggtgaaatagcattgtgatacatcacaggcattctcttaacgacctttctcacttataagtaagttaatttattccagtacttttaagtgactaaagaaacagcagcccctaagattgtgaagtgaacaaaggtgataatcacaagctaggtccagttttcacttgcatggaaaaagctagattagcatctgtatgtttaaaataaattatctacttatgaaagtagattatctagaatgttcgtgaatatttcagagtacaattaattttaatgaattgtattttatttagtgtccccttttgtggtccactaataatttgattacgcataaatatttgagaacatgtttttctagctactatattggaatgatggcctactttgtattttatgtgttcttgtcaaagtactgtacaatttgcagtattttatagatttttaaagttggacattccatggccctaaattcattcttatgcttattttctttgccaataaggtgtatggcaaaaaaatagatggacagcaaaccattattgcatgcatagaaagccatcagttccaagcaaaaaatttttggtaagttaaaattttggatattggggagttttggcattgttttaagtctttgtagttcttgctttagtgatttgggctacaccttgtttgtttatgattaagaacaatttagagatggtataaaattttagccttttgatataaggaaggtaaatttgctcaacagcctaatcactaaaggtagtggtaaatctgttgacattcagtggaaagagtatgggactagcaaacagcatcctgagggagcatgtgtgcctgcgagaacaccagttggcaatccatatgctcattctgtgaaggggctgttcctgaatgaaacttatgtgcaggagaacaaagataattatagaacaaaaaatgatactacttttgtgaactttgtgactctgaagtagaggattgctttgtacttggttagccaatgtgaggaaataatgacatgttttatacaatgaggaagattacattcatgccttgtaattttgtgtacaaataattccattattccttataaacttcaagccctcaggagcactgatttaccatactggtcttggacctttgacaagttgttggtcatttttattcttagacaagactatttctgagtacctgttataaaattctgaggttctttaagactttacaagtccataattgaatgaaatctttacgtttatccctgttttacatgctgaggtcaccagaataagtatggtcataatatttaccttttagtatattagcctttgacttactagccaagttggttggtggtgctattaagggtaaagtaacaggtaacccctgtgggccagttgggttcatggcccaaggttgctccactgcttagccatctcagaaataaatgcagggttgcaaggttaaccaagaatatttggaggaatgcagatccatcatcactgaaggaaaatcaatgccatatgtgaatgtatgccttaatgactagccacagttccctaaaggttctgtcatatagagttacttttatggacttaatataagtgtagtttctctgtgttgggtctaaaatcttgtagcattaatctagaatcctgaaacaatatttataaaattattactaatttatgttatttatgccaggaaacacataataaaatcaatcttgttgagatggagctactattagaagaaaattctttttactacgttcttctttataatacattggagctgttacaataagcttactaatttgtctttttaaaatctaattcctttgagctttaacatatataaaatgaagaaaatgtctgtccttgagttttattttctgtttagagacagagtcttgctgtgttgcccaggctggtctcaaattccagggctcaagtgatcctcctgcctccggttcccaagtagctggaactacaggttcacatggtgcccaacttgtcattgaattttctattctcactatttcactttacaagggtaatttttcctaagccatcactatgagcattgtatcatttaacttaatggctttcactttctggaaaaaaatgtattttatatgctttgatatgatttttccatagtgataatatcatggcacaatagtctcagtaaaatctaagtagttaatacaaagaactatacttcaagccaggcatctgtaatcccagcacttttggagaccaaggtaggaggatggccagaggccaggagttcaagaaacctgggcaacatagtacgaccccatctctaggaaaaaaaaaaaaaaattagccaggcatggtggtgcgtgcctatagtcctagctacttgggaggctgaggcaagaggatctcttgagcccaagagttcaagcctgcagtgagctataatcacgccactgcacttcagtctgggtgacaaagcaagaccctatctctagaagaaaaaaaaaagaaatatacttcagttcatctaaaatataggtagagtaaaaatcagaagcaactagtcttagatgtttcttagatttcagtagagaccttctcttctttgtctctaccatttctccaggatctagcagtattaggggcttaatataaatgtttgttgagtgaatacatatttgtaattacagagttaataaacgagaggggcagaatataattaaaggctaggacatattggccatttactctactaataaaagagtactatctactcagtgtcatttactgttactgtagtaattaatgcctttggaagaatcttttgaaatagttctcaaattggtaccactacttggtttggaattatttttttttcttttcataatcaatggttatataaatgtatattgtcctagtcagtattttatatatgctaaggactcactagctggcttggcactaatacctcaataaaaggaatacttcttttggaatcatgaaacaaaagtgaataaacctccaagttatttttccaaccaaccttctttgaaaaatcttggatgagtcactcaaatcaagacatgttataaaattatctgttattttgtagaacatatacattgttctaataataattttcaaatattcagtgtaactgtaagtatgagaatacaggttgaatatctcttatccaaaatgcttgggaccagaagtcttttggatttcaaatttttaaatatttacatcatacttaccagtttaacatccctaattcaaaaattcaaaattcagaatgctccaataatcgtttcctttgagcatcatgtcagtgctcaaaaagttgcagattttgaggtatttcagatttttgaattaggaagactcaacttgtactatcattctatagactttatgattgggtagactacatgagtattgaacccagaaatcattgtctagcaaaagccagtatagtgattaattaccctgtgactattatataatgttcaaaaaagctaacatattagaatgtccttagcgtgcagagagcaaacagagacaaaaagaaaagttaccctgaaaagtttgtcagaaaaatagaatatcagacgctaaactactcatccagaattttgtcaaaaaagaaaaataagataaaattcactggtagacaaaaagtagtaacataccagtttgtaatttctcagtttcaaaccatgaatatgtatttgtataccaaaaatcatttcaggagcagagaaggaggatatgccttttatgtggagactttaaacataaaattggaaaactaaaaaaaaaaaaactcatgttaataagtatagtcctttatttccagatatcaaaacctctttaagagtgttgtataacatttactagtcattctttttaaattgtatggtactttgtatcattcagtagatgttaaactacactgagtgtatttataaaagcccctgttaatctaaacatttattccatttattttggaaatataagtgatttgattgaagaagtaccttaaaatttatctccacagtagcttatgacttagttttgtattggtttttgttttgttttgttttttttaaggctagtcaagtggagatggaacaaagaaacctgtaactgattgtgatcaattagtggcaaacagcactgcacacacaccagcctgaattgtattttaagccttagctttagaattctggcattaaatccattatgtaagttctttcttatcagtagggtgaaaattaaatatgtatcataactggacttaaccttttgattatttttgactatttcagtgattaaaaatttaatgtccagtattcatcccccacactctctcatactgtagcatgaaatataatctgaaacttaaaattgattcaaattattttccctaccttatttacagctgctgtttttatttttaaggaatggtcgttggaggtcagaatggaagtttacaatcactccttcaaccactcaagtggttggcatcttgaaaattcaggtatgaaaaataatttgtttactgatctttagatgattctgaacagagaaacaactaattcctaagtttacattttcatagtatatcatacacatttctttttcaggtctttgttttggggtaatgggaaaaacaatagtgctgttttaaatcttttaaataacctggcagtttattccctagtcatcaaaaatctgcaaggatagctgacagattataaaacacagctaaaattagatgctgccatttggtctgctcttcagatacaatttgttcatgcaggcgtcttctgagtttgagttgtgtacttctctcctctgaattgggtggagtggggtgaagtatcatattaatatatgcatgtgtgtagttgtataaatatattgtatgcatgtattaacgtgtatgtattggctgggcgcggtggctcacgcctgttatcccaacactttgggaggccgaggtgggtggatcacaaggtcaggagatcaagaccatcctggctaacacagtgaaaccccatctctactaaaaatacaaaaaattacacgtgcctgtagtcccagctactcaggaggctgaggcaggagaatcgcttgaacccgggaggcagaggttgcagtgagccgagattgcgccactgcactccagcctgggcgacagaacaagactccgtctcaaaaaaaaaaaaaaaaaaaaaaagcatacgtgattgtttgaagatttagttaatatggctaaaagggttaggacagacagacaccaagtactcgatgaatggtagtcattattgtcagcattattcttccttcacttaggcctcagtggcgcttacctggataattacagcagttttaaaatggtgccccttgtaggaccaaagcttattgagagcaaggattgtctgattcacagtacagtcttcagcatttagcatagtaccatatgattgttattttgttgaattggtggactctttgacattcacactgccatcaaaaagatagttttttaaatttaaatgtggatatgttacttgactatgtaagaccatttagtagtacactctcatctgccagatagtccagacatatttgcatgacatacaaggcccagagttgactggtttgctacctgtatatatttctacagctattactctccccaacttcacatacctctagtcctctctgaaatatactgaagccttttttaaccctcagaaagaatctagagtactgctaacatactttatacatacctttaccatgttgtgctgaaatacgagatcagggactgtgtctttttaaaagccatataacctcagtaccttatgtagcagcagtgtttacagcactcattcagtgtttgttgagtaaattcatgtctgagtttggggaattaaatggttggtggaaatacacaaaagaagaacaggattgggaaggaatattgtgagctcagatttggacatcttggttttagataccagtagaatgaatgactgtgaggcaaaaatgtccagcagtcaggtcaatagaaggcttgcctgaataactacaggaatatctctaactagtctcctcactaggctgagggcaggaagagtcttgctggagttcaaaagttttggggctcagcagagaagtctagactagagctgaaatatgtagtcagtctgcattgatatgcttgttgacgcaataaggttcttgatgattcctgtaatgtggtttctgtaatttctttttctaataggttcattattatgaagatggtaatgttcagctagtgagtcataaagatatacaagattccctaacagtgtctgtaagtaattaattccacaataaaatttaacctaatacttctgtaaaaccagaacagttttggaatgaacattttaagtaatatttctgcttcagattaccgtgttttctgatagattaaagataagtaattgcaaacctgtacctaacttttttgcagctttgagatataatttgtataccattcagttcattcatttaaaatataagcttcaaatttttctcttttttttttgtatattactaacagggttggacagcagtcaccacaatctaattttagaacattttcatgctccttaaaagaaacactgtaccattagcaatcattctccattctacccagcccttcccccagaaccctcccagccctaggcagtggctaatctactttctggctctgtggatttgcttgtgctggacatttgatataaatgtaatcataatatatagtcttttctgactggcttttttcatttaacatgttcaacattcatcctttttggagcatgtattagtacgttgttcctttttattgccaaataatactctgttttatggacataccacattttatccattcttcagttaatggacatttctgtgttctactttttgctgctgtgaacatttgtgtactattttttgtgtagctttttaaatttatttttggtatatacataggagtggaattgctgggtcatttggtaactatgtttaaccttttgaagaactgccagactgttttccatcttatagtttcaccagcagtgtataagagtttcagtttttctgtatctttttccaaaatgtgtccttttgatgatagccatcctagtcagtatgaagtagtgtcttattgtggtttttatttacattttcttgatgctaatgattttgagcatcttttcttgtgcttatgatcatttgtatatcttttggggggaaatacctattcagatcctttgctcatttcctaattgattattcacatttgtattactgagttgtacttgttcatatattctggatacaagtccagtgtatcacatacatgatttcagatattttcatccttctctgtgttgtcttttcactttcttgatgatattgtttgcaaaacagaagattttggttttgatttttttcttttgtcatttgagatttgaaatattaatagaaaccattgtctacccaaggtcgtggagatctactccagtgttttcttctaaaagtattatataatagttttagctcttacatttaggtctatgatcttctacctaacttttaaactgtatcctatcttttcatttcagtagctatttggatcatgatttaatgaagttttttttttaagttcatctttcaaatttaagaatttttgaacttggttttatttctccacagaattctttcacacattctttcccttgcatatgcaactgtttccttgttgatttttgttggtttggttggttttgtttttttgagacaagacctggctctgtcacccaggctggcatgatctcagctcactgcaacctctgcctctagggctctagccattctcccagttgagcctcctgagtagctgggactacaggcacgtgccaccacacccagctaatttttttttttttttttttttttttggtagagatggggtttcaccatgttgcccagctagtcttgaactcctggactcatgcagtttacccaccttggcctccaaaagtttggcttttggtttttttgccccatggatattgacagtataacatttaacagtgacattttctcatttgtttgtgtcatatacctaaaagtatctgtgtattataaacatcaactgcttatatacaatttacagatattaaagaaaattttttttttttttttttttgagacggagtctcgctctttcgcccaggctggactgcagtggcgctgtcttggctcactgcaagctccgcctcctgggttcacgccattctcctgcctcagcctcccgagtagctgggactacaggtgcccactaccacacccggctaattttttttgtatttttagtagagacggggtttcaccgtgttagccaggatggtctcgatctcctgacctcgtgatccacccacctcggcctcccaaagtgctgggattacaggcgtgagccactgcgcccggccagaaaaatttatttttaactcaagaaagcatttaagaaacatgtatgaatgtgttaagacagatgctacctaagaagataagctatatttacatatacatacatacacacacacacacacacacacacacacacgtatttttttgagacagggtgtcactctgttgcccaggttacagtgcagtgtgtgaatacagctcactgcagcctcgacatcctgggctcaagccatcctcctgcctcagcctctctagtagctgggactacaggcgtgtgccaccatgcccagctaatttattttttgtagagatggggtctcaccatattgtccaggctggtctcaaaccctggccacaaccaacctttctgccttggcctcccagagtgctgggattacaggcatgggccaccacacccagcccctgaagctatcttttaaaaaaatttttactagcacttaggtgatttctgctttgacctaattggtactctccttgcaaaatttgccagtgaaaaaaacttactaatgtctgattttccatgagatgttctccatatagttacatatcatatgtaattactacattcaatattattgacataacaagggtatggtgccgtcttgtttggggagtttgacattgagcgaagatgcttcctggatgggtgcggtggctcacgtctgtaatcctatcatttcgggaagctgaggtaggtggatcacttgaggtcaggagtgcgagaccagcctggccaatatgacgaaacctcgtctctactaaaaatacaaaaccccatctccactaaaaatacaaaaatgagacgggaatggtggcacattcctatagttccagctatttgggtggctgaggcatgaaaattgcttgaacctgggaggcggagattacagtgagccaagatcacactgctgcactccagcctgtgctacaggctgagaccctgtctcaaaaaaaaaaaacagatgcttcctaagagaaatttgtccacaagagtacagagggtacggttttgagagatggtcatagtaattaaacttgactaatatgccagtttgtgctcgtttttttaggaatgaccatttttactctatcttaggaggttttcattgttttatatttttacaccatatatataaagtataaggtgttagagacttttacattaacactgttttattttttaaatccagattctgttaactttactgttaggaaaaagcaaacaaacccatctattggcatgttaaaaaaaaaatttccagaaaaatacattcttcctgattagtgattttttttttttttttggtatcactgttctgttacgtaatgttcagtaaatatttaacaatattcagataaagagtcatcaattagaaatctttaccaaacttcttacccataaaggttgtctattggaatgcatgtccagtgtttaaaattgaacttttcatccatgtgtgtatcattgagatttcactttccttagccagctgaacattgagaccagcttattctgtagacttttaaaataattttacctattttccccttagacttagaataattgatcttacaatatttgttctatgtcataatttccttctgtgttatttattataacattacattaaccatacatatattttaaaataatagtggtttagttttaaattactatttttattttgtttttttttttttcagaatgaagtgcaaacagcaaaagaatttataaagattgtagaagctgcagaaaatgaataccaggtatgattttttaaatattatataagctacactcacatatgaattaatgtcactgaaattttaatttcagccaaaggctgaatttttccattgcatcagttagagtctttttgttgtgtgtctgcttttaacacaaaggcagacttactaatgtgtaggcaaaaagagtggcaagtaaattgaattccattaatagtttgtgttttcaaaatactaagactaggccgagtgcggaggctcacgcctgtaatcccaacactgggaagccgaggcaggtggatcacgaggtcaagagatcaagaccatcctggccaacatggtgaaaccctgtctctactaaaaatacaaaaattagctgtgtgtggtggcatgtgcctgtagtgacgagtgctactcgggaggctgaggcaggacaatcgcttgaacctgagaggcagaggttgcagtgagctgagatcacgccactgcactccagcctggtgacagagcgagactccgtctcaaaaaaaaaaaagactaggttttggccaacataatttctgagtgcagattgagtatctctgatctgagttgcttggaaccagaagtgttttagatttcagatttttttggattttggaatatttgcattatctatttaccagtcaagcttccataatctgaaaattagaaatctgcattagtgcttcagtgagcattgcctttgagtgtcatgttgatgctcaaaatgtttcaagctttggaaactggatttttcagttagggatgctcaacctgtatcagtcaaaatatgccagactttaagtggctattttttttctggttggaaattttaattcaggctgtgtcttagcatttggattatgtgtaatctgtttagatcacatttcattttgtgctttactttttatattatttatcagcttctaaactacactcttgaattgaaccatttaatttgtgaattggacaagtttctactccttaaaaataataatctataaattgttctgacatactaaaataaattcaaaatgacacacaaatattaagtctaatttatagttttatttcattaagtttattcaaaattattataggctttttcttctagctgcttttattttatttatttatttatttatttttgaagacagagtcttgctctgtggcccaggctggagtgcagtggcgcgatctcgcctcactgcaagctccgccttccaggttcacgccattctcccacctcagcctcccgagtagccgggactacagacgcccgccaccatgcccgactaatttttttttgtatttttggtagagacagggtttcactgtgttagccaggatggtctcgatctcctgacctcgtgatccgcccacctcagcctcccaaagtgctgggattacaggcgtgagccaccacacccggctcttctagctgctgttaaacagcttttaaaacaatgttgggattttatttgactgtttaaaaacagtgaaacaggctgcttaaataaaacttattctgaaaacatctatgtgctttataaattgttctgttctttgctttactttaaacttctaactattgtttttcatagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgactggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgacattttgtctaaatcatcttttctttagttttaaaatacaagttttggcacattgggattcctaaagaaaatgaattggtaacattaattatctgttcctttttaaaatatatatatttgaaagtttgatgatggtgaactaaatactagatctaattgacaagcttagttgtatcagttaggccatcatgagtttctatcccatgaaagtcatcaatttcctatctctgttctagtctggaatgcattactgaaaatgtatgcaactgtttttaaggtgatttgcttgtgagacggaagatttatcaaaaataatttagaacaggctgggcgcggtggctcacatctgtaatcccagcactttgggaggccgaggcgggtggatcacggggtcaggagattgagaccaccctgactaacacagtgaaaccctgtctctactaaaaatacaaaaaattagccgggtgtggtgacaggcgcttgtagtcccagctactcgggaggctgaggcaggagaatggcgtgaacccgggaggcggagctcgcagtgagccgagatcgcgccactgcactccagcctgggtgacagagcaagactctgtctcaaaaaataataataataataataataatataatttagaacag

SEQ ID NO: 16116 - DNA, 9889 bp, Human
tgatagtgaccaaatttttccttgttgtccttctgatgggcgtgaaatggcagctcactgtggcttgaatttgccatttctctcttcactaaacgaggctgagcagttagtgaagttgctgctgaaacaaagaatgaaaggaagccagcgtgaagatctaggagcaagagacgtaggggagaggaggaagagcagcaggtgccaaggtgggaaaggtctgggatgttggaggaacagaaggaaggctgggggtgggatccttgtgcatgggggagggagagaggctcaagccaatgtcagctggggtcagagcagcggggccgagttggctgaggagaggactttggcttttactctgagacaggcgcatgggagggtttgagcagaggagggggtgatctggcctcactttggcttcaagcaaaggatcctgattggagctaaattgacacgggacggggagtattccgcttaatgactgcttactgcctctgtcccccaccctactgcccgctctccagctagaaccaggggaggacgattttgttcacggctgtcacacccggcaccaagtgactaaacagacagtagttctgcccttcaggttggtggtggtggtggtgtggggtgcttataggtttttatagtcttccttcacaggtggaaacaagaacggtgagacctgtgaggtttatttcagagccacccccgggcctggtacgcctcccagggaagctggggtgggggtgcagctgcccctcacttgggcccaccccacatgcattcagtcagggcccctatggagccgtgttacagcctttagacacaggatcgaggatcttcacggggtgaggagacacgcccggcccatgccttctttctcccaccagcctacagggatctttttcaacgaaactctaaccaggtccctcctcagctgaaaatccttcggtggctccccagtgcccttgaggcaaagtccaaactcctacgaggccctggggcccagcacatctgacccctccgggcatgcccatcccaccccatccctggaagctgctctctaggagttactctgaagcagttgccacttcttccctcgggccttttcccttgataattcttcacttcctctgggaagtcaccccgaccccctgtcaggtgacccgcctcttaacggtcgccgcgtcccgtctctcccccaccaaagcacacttccctttgcattgtaattatctgtttacttcgtctgtctccctcactggaccagaagctacccttcgggagaggctctgagtgttctgtccggggctgtgccctggccccaggtacagtgccccacacgtgctgggcgctccgtaaacactggataagggaaggaacgggtgctcttggctagctgggccaggctgctttgcaaaaaggccgtggcatttcaagccgccgagagccacgtgcggtgtccctttcctcgcttcctccccagtgatgtgcgtttccctcgtcaatgccacgctctccaggcgccagccgggcggaggaaatttccgccccctcccaagcccgaggcgggggcgggcgtcggaaggtcaggtgtcccggccggcgcgcagcgccagggggcgtcagaagcgctcagaccaccgggcgctgagccggtgggcgcgcggcgtcctgccggggtcccacctcgcagaggcctcgcttcgctcgacgtcccgccccggacagccccagcaccggggacgacccgcgctgcgccagcgaaccccgcctcggaggagtccccgcccgggctctcaccgccacgcggcgcgagcccggccagcagccggcgcacctgctcggggagtggccttcggcggagacgagcctccgattggcgcggaggtgacaaaggggcgtggcagataaggccccgcccctcccaccccccaccaccccccggagtacttaagggagttggcggcgctgctgcattcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccaggtgcgttggaggggttctgggctccaggaggtttgggggagacaggcgaaggctgcgtggggggcacctgagggaggcggcctgcctgagccaggatcgagtcacaggatgttttgtggaccattgcgggctcgggagaccgggcaagtgggtccccagttccggggatctgtctgggtggttgggggagtgccgtgtagagggcaggggtcttcagcttggggggcctttgtagccggcgagaggcggaggagctccgcaagaggggaaggagaggaggcctgtgtcaggagggccctctggacgctgctggggagagtccggagtccagagggttgaggggaggggtggggagacgagatgtgtgtgaggagggggattggggcagggtggtggctccggggctgggatgatggggttctggcctcaggctggagactggggacttaggagagggagatcaggaaatgacctccttcaactgggggtcctacgtgtgagagactcagattgggtgacctgggcgaggagggcaggaacctggtctgtcctgtggataatttttttgatctaattatgtattgagaatcggccccacccagcccctggccagcggtgggctcatgtttgttgattgagtgaatgatttaattaacgcctgactctgctttttctccctcagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggtacgtgcccctccaggcgcccccaccgttgctctctctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcctgtttctcagccaaatgggtcggagctggatatgggaaaggtgcaaccaacaccttgctgtgggggccaggtgtgaaggggcccacccggccacaccctctcccgggtccgccccctccctagccagacaggatgttgtcagaccccccgcctggctctgaatccttctttgagaactttctcaaaacttaggctgatgtttctcttctgtgagcctcattttctctatctttcagatgggcatgagaacagcttttggggtttctatacaggctaaatgcaggaatgcatatgggaagcacctggcaaagtgccggtacctgctaaactctcacaaaaatggttccttggcatttgctctgcttccttgctgtgtgactttgggcaagcaacttaacctctctgagccttaggggaaaactatgatagcatatgttttagagagtggctgtaaaggtggctaatcactttatagtaatttattatacccgaacggttctcaggtcggcttccccacccccactgaatcctagcacacagaccaggaaacggcatctttggggcagaaaacacaatcacgtcttttgaaaatttactaaatgtgtaaaaaactttctggacatggagaaaaggtagaactttttagaacttgaatggtggcagccactgtgcctggagctgctctttggagagtgacagttgagggagaagattccacagggttcaagctggccaggttctgccatttcctggcctggcgcctgacctctgagcggtgagggttagtgaggtgtctgggaggactggcaattcgcgggctttattggcatcttattcgactaaggctacccatttctcttccttcgtgcaccaattgctctgattttaacatgtaaaggtccaactgcctggcctcctgggtgcctgcccagctcacagggctctattttgggacagttgaacccctcagggtgctgcagtcctgcctgcctctctcacctcccatctggacattattttaatgtaaaggcatggctgagacacagaaatccccttgaaatgtatcattgcggtcctcattgactcccattgtgtgccttaatggtgggcccagtgggtgggggctgggaggggtggagcaggtgcatggggcagcggtgcccagcacctgttccagtcacagctgctggcccactgcatggcaggcccctttaatccggggatatcgcatgtacagtgcccccctcggcgccctttgtccccgccggcctggtgccgatttcacacttgccaggagtaccatgaaggcgtctggggggcgagggatccaaggagtgggggtctgtgcctcctgcgtgtgcacacagcccccgcccccagcccatcatgtcctagaatgtctccttccccttttgtttgggttcaggtctcatcacactttgggcacttactgtacaggagggtagtgctcaggacttcaccaacagccctgggaagggaagggaggtgctgtcctaactctggtcttacaaatggactccagccccttttccagatctccagagtcagcccttagttcacaagggtgaacttacccttctcattcacatgaagacttagaatgcaatcaacaaacccttcaggcgtggcgtgtggaggctgctgagtaatggcagagtggagtagtgctcaggcacccctcccccaatcctctatgtcccccaccctttggagtggcgagtttccatttctgccccatgagactgagtccagctctcaggcgctccataagtccctattgaatgcatgggtcccattggagccatcctctggactctctcctaccctggtagctcagtgtggcaccctaggcacccaggaggtgatggaatgaattcactctcagctcttaaattccatccagcgctgggatttcacaggcgggccctgaccttgcgggcatatcagactgggcgtgaggggattggagaattgcatgttttttaaaaagactattcagtattatggaatagtgtctagcacttagtaggagctcagtagattaaaaaaaaaattatagacagggtcttgctttatcgcctaggcttgtctcaaactcctggcttcaagcaatcctgcctcactcggcctcccagagtgatgggattacaagcgtgagccaccacacccagcctcaatagatttttgtttaatgggttactgttatgaccttttatttggaaaatgctgcatcccccagaaaaaaacaaatcaacattattggtgtttttggaactatatagctttttggttggagcagggattgttatgaggcatgagtgagggggcagactcctctgaggcctctttaatttttaaaacagacttatttattctctaagggcttgttgaggatttactgggcacccagctccatgtgcaagacttttcccaacacagccttggccaggcagatggtgtgtcagggccacaggtttccgtagcctcttgggtgatagaaaggggcccaggccctgggctggggctcagaagggactcaaaggaggcccttgcccttatgggactcagcctgattggagaacagacaaggagatttgggattacagcgcaggaggtggggtggtgaggaaagcaggctgctggccgggccccaggagtggcctaaccagcttggaggtgggggtggggaagcctcttaaggctgactctggctttggcccccaacagagtaaatcaaggaatgactccaggactgatggtaaggacaccagtcacgtcctcccttgactgaaggcagtaagggcagtaggtgaaatcagaggctttggggtcctgccaggggaacctgaacatgctacttctgggcctcagtttcactgtctctgaaatgagaccacagtaggatcaagtgacagtaggatgaatcagtaaaggtgttgagtcattgttgaccacttcgcacgtccctgcgggatgtggatgagtaccctaccttctgtcacttatcaacccctatgagtggggggtgaatagccccattttacaggtgggaaaatggaggctcagagaagccagacaacttgctcagagttgcacagtgggaagcagcagagctccgtcaggtcccggcctttggaccctggctgtgtgtttgacggaggcctggctttcctgggatcatgggattctttcagggtttggggtatgcggggagggattcccatcactgccagccgttgtcccacggctcactcggcctttctggcgttctctccccaggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccgtggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacccccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaagtctttggtgtcatagaggagtgggtattttgaaaggtctttggtaagggaggaggggacaggaattcctgaagcttagatatttctgacacagccttaaatcttgtccttggaaacatcatagggctttggagtcctgggtgtcactgtcagggaccttatgagactgggttttcccgttggcctgggtgtcctgtctgctgctgtttgggtgagccagcggcatccatacgagctcttcactatacactgtggctttttactttctcgttcttgaattttgaagttgatctggcccacggagtgcaaagctggcttcctgggtcttatcaactagacaggctgcaaagctctgccccagcactgcaggtcttttggggtgggattgtccgcttcccccagatgcgagtggaatgcgaccaaggagacagaggatgtccttcctgtttccaagggctccaggcccccttgggcctccttgtcagtcccacacctccgtcttgctgctgggtaccaaatggcctttgatgcgaggaaattggctggctggagccagtagggtgagaagccaggccaaagggtaggggtcactcagcttcctgctccgaggacggcgggacggtcagcatgcgtcttgggctagggtaattcattccccgccagccgatggtggtgacctcaccactgggggcctcttggggccaggagaaaatgagtgtcctttttgaacacaaaaggtgctggaggtgccagtttcctgtgaggagctgaggcgtcccagagcttcggagccccagagtcaggctgggggtggggggagcttcatgttccaaaggagagatgattctttcttctaaacaggaaatggtgacccgcaggccgggagcagcccttaatgacttgcagctttcctcccaaaaggaaaaaaaaaaacgttctctaacaatcgccaaattgtggcctgcctccctgaagggaagttagggagttggggggatgggggttgggcatccatgagctgaaggcctactgtgtcctgggtccctgcgggtccctctaggtcgtctccatccacccacagtaggtgctgaatgaatgatttcatgacttcacataatccctgggggtcgggcctccggaaaatgaggcacagaggtgggcttgcctgaggtcaccaagcccggcccctcaggtcatcctgggagttcggtaggctgggctcatgccgctgactctcagggcacctggagcaaggctctctccctctgggggccccagtttctgtgtctataaaacagggtgacagtagtgccttcctctcggagactgtacagaggcattcattcattcaggggtttcgagggtaccatatgtgccaggccctggggttacacccgtgaacaagacaggccatccctgcgttcatgggacgtatgttctggtcggggagagagaaagcaaacaagtgattaaataaacaagccgcttttctacagtgatggtgccaggacagaatgaaagggtgccaggcactagagaacaacggggtggggctccccaggccaaggcagtgagagccctggaagagctgaattccagcccggacctgaaggaggagaaagatgccggcagggaaggatctgggggagggaatagcaagcctgctggaatgtgctgcccccatgagaaagaccaggatggcggagggactgggaagacagggtgggagaggagagtgggcccagctctgcagagcttgtggtgctaagcaggtgggaattttgtctaagcccctagggcagccactggggctgtaaagcaggagagtgctgaggcctgctgttacctttcctacaaagatctccctggctgcttgggagaatggatctcaggggtccaggaggagaaagacaaaggcagggagaccatgagaaagccagagggggccaggcaccctggctcatgcctgtaatcccagcaatttgggaggcttagacagg

SEQ ID NO: 16117 - DNA, 26313 bp, Human
ctctgggggatgggtgggaaacattagagaatgactgccctagaggaatcctccagttgggatgcaaagctaagaaagggagagtgtttaaaggaggggctaagcaactgtgtcctttgcagtgcagaggaaaggaggtagtgagttcttggcggcaccttactataagctttacacaagattttcaataaatacaataaaagctttacacaaaattttcaataagacaactggtttagtaatatgttgggatgaaaggaagatttcagggcagtgggaacatactgcacagcccaaatgattaaaaacaacaacaacaacacaggactgaattagaaatgtgatattagatgaagtttaagtcttaggtttaacaagtatttgtggactgcccccctactgtgactggcagtgtcctatctgctggaaatagagaatgaggtgttactcctgctttcagagacttcacacagttatacttttttttaataattggaagctgtcttttttccttaaaatctttcctagctactagagaataaacacaatatctgatctattctccgacggtgccagaagttaagcatagggctgtctcccaatcaatgcaaggccgcatttgaaactgctccctcatttcggaaagcattctgaacactggtcctttttgcttattattttatggcttgggatataccttaagagatgatttgaaatctttcgaaagatttcaatgtccctgtttaatgttggccacgtggggtttttgacattatgctaacccaccccacctctgtcattcccagtataaagcaccaaaagcactagcttgaaatacagtgacttctaagcttcgtccattattccattcagtcattgtttgctgcgcattatgtacaggatactgctttaatagtgatgaaacctaatgtcagccaagtgttttgtcaaagagccggaatccacatcccaaggccagatgtattgagtgtggaggaggcactggggcctggtcccgaggttagccaagcggttagatgaatccacccccagacacccacaaagtttagatttgtaaatgttccacccctgtaacacatccccctttcacaatgacaaaggcaatttgagggaattagagtgactggttaagaaactatgttttacaatctcactgtttcttgaaaatagatggcatagcagtggagtttgcaagtagaatatagggattacattttgacgtgtttgtgagcttctagttttgtatcatagagagacttcaggaaaatgcaagtggagatcactttccaaagaagacaagattggcaggttaatctgaacactcatttgttaagagcatgttttaattgaccttggactgtgctctttccctattgctttggacttttgggctgggatgggtggatagtgaggactgcaaatagtctttcgttactcctttttctttccaaatctcccaagggtaagtgattggagcctcagtctaccactttgaaaaggttgccaagaccagaccgtggcttcagaccatggcttcagtgcttctagcagtcagagagtcagtggtttcttttctctatgaagaaccatgaactaattctgagaaggtgaacttaaagagagcagaaacctttaaaaaaaaaaagttttaactaattcataaaggtctttcttctgatgatcagagtgctagaatacagattgggtatttggagaagagatggaatatatttttttttaagttgatgctttttctagaactgctggatattgacagaaattcctctaagctctactagctacccaaaagatgttggtgtcctgaaaggtatggaaaatagagttatggtcatgtagggttttaaaagaactaaaagaggctttaaaagtccaaaaagaaaaaaaaatccatagctatgtggtgtgtttttttaaatgattgcttctgaatccacctctttttcccctttttgctttctgcagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcaggtatatttttagtaaagaggtggtctgattagaatgtctcctcccaagagaggtaaattcggttgcaataattattttcaatgggaaaagcgcattgtaaaagagggatttggctgagttttactttactgctaaaaaagctcttgccaaatgaatcctcgttcatttttgttaacaatatgactcagtctgtttgtgttgctataaaagagtacttgaggttggataatttacaaagaaaaaggatttatttggcttatggttctgcagactattcaagaagtgtgatgccagcgtctgcttctggtgagggcctcaggctgcttccactcttggtggaaggggaaggggaagcctgtgtgtatggtgagaggaagcaatgtggcaggtgagaggagggcagggccaggctcttcttaacaaccagctcttgtgggagctaatagaggagaacctaccgcaacagcagcaagccatttgtgagggatctgcccctgtgaaccaaacacctcctgtaggccccacctccatcattggggattacatttcagcatgaggtgtgcaggggacagacatttaaactatagcataatacattaagagtgactggatgactacttctttttttttttttttttgagacggagttttgctcctgtcatccaggctggcatgcaacgggtgatttcggctcactgcaacctccacttccccagttcaagtgatactcgtgcctcagcctcctgagtagctgggattacaggagcatgccaccatgcctggctaatttttgtatttttagtagagatggggtttcaccatgttggccatgttggtcttgaactcctgacctcaagtgatctgcctgcctcggcctcccaaagtgctgggactacaggcataagccactgtgccagggctctttcttttcaactctttcaaaaactgaatacaggaaggaagtaatacttccacatgattaagtgggactctcttgaggcctctctagtccagccagggatggtttttatttaaaaaatagattctgagatttcatcttactaaggattcatgattcgcctcatttctgtaactgaggactaatgtgctttctgggtttgtttgggtttttttgagatggagttttgctcttgtcacccaggctggagtgcagtggtgttaatctcggctcactgtaacctccacctcccgggttcaactgattctcctgcctcagcctcccgagtagctggggttacaggtgtgcgccaccatacctggctaacttttgtatttttagtagagacggggtttcgccatgttggccgggctggtctcaaactcctgacctcaggtgatccgcctgcctcggcctcccaaagtgttgggattacagacatgaaccactgtgcccgagcttttttttttattctcttgagatggcatctaagtttgtctcccaggctggagtgcaatggcatgatcttggctcactgcagccttgacctcccaggctcaagtgattctcctgcctcgtcctcccaaagtgctaggattaaaggtgtgagccaccgtggctcattttttgtattgtttgtagacatggctaatttttgtattttttgtagacacggctttcaccatgttgcccagtctggtcttgtactcctgagcttaagcgatccacctgccttggcctcccgaagtgctaagattataggcatgagccaccatacccagcctcctatggcttcttaatgatttcgtctaagcccaatattttaaaatacttacatttaaaaaaaaattctccctctaaatcagtcctctcttcttctctaataagttacaagatttttggaagttcactgtcgaatgtgaaattgctttgcaaatgttgcaaatgcgaattattctgtggcgcttagaaaatcaagagaaagcattgcctctcttaaaagaattgcctctccttaaaagaattgaccacatcctaatttatcagtttcctttgccgtccactttagcaacagaggactgtagttagcaaactgataaacttttgatactttcttgttggcaaagaacaagtgaatgacatttcagagctttttagacaaattgtggtcgcactgggtcaagttacctgagctctgaaccatacctgggagaggaaaccctgcagtttccgtcttgcatgtggtggtaggttttgcacaatccgcacacacattctcactcgactcatgtggctctgtcagttaaggcagaattttatgctgtttgcatttttcacacatagtacatataatcttggggaagatggcgcagcttgatcatgtgactctttccctaaaccctgccaaaatcctgcttctagttaggtgaagaaacgaggcagtactgactgcccttccagagcgctctcccctgtatagcactgagtaagggaacatttgtgtcctcatgacatttatccagtccagatgtcatacttctgcagtgttagatgaggctggaatatctgtctctctgggcatttggcagtactggcagttctctcagaagttagaggggcatgcagcaggaccccatttccacaccactgccggtctggcaacacaggattgcgctacttcctgagttgctgtctttgaaaactgagtacagaggtgagtttcacccttggagggtgtatccagtgacccgttattattgaacttggtgtacttttattctcaaattatcatacacccaaataccttttccttgcatctctctggttagaacaatctattttttgttaaacgtgtttatttctctaatagattggaagtctgtgccatcagggactctcttactgtttattagatacttgacttacatgatttcatgtagtccctcacaagaacccagaaggtagctactgtgtccccattgtagggataaaaggaacaaggcacatggaagtcatggaacttgatgcagcagcagggttagggtttgctgattctctgactccagggcctgtgccctgaatcgcagtaatggcttcattccttttgtcatctttgtatccttagtaccttatacactgcctcgcacataggaagcacttggtaagttatttttgtatgcatgaaggaatgaatttaacaagaaagcacgtcttaagtgttgtagcatgtttctaaggaggtcaccatcttgtggagctgctgtgtcactggcacatctttggcgagtaagtacaggttgagcatccccaatcagaaaataccaactccagactgctccagaatccacacatgatgaaaccttgagtgccaacacgacacttgaaaaaaatactcaatggagcattgcagatttcggatttttagattggggttgatcaactggtaagtataatgcagatattccaaaatcctaaaaaatcagaaatctgaaacacttctggtcctaagcatttcagataaggggatactcaacctgtactgaaaagaaaatagcatttcactgaaagtgtatttaatgaaaacccatcattcttcttcatttcaaagcagttgtctacctagcacagtcagagagggtattctgggcccagcactgctgagacagccaaatgactgacacctctggcccgaccacttctgcctggagcactgttggcttaatggtggtaacctggattatgcaccatcctctgctgaaataatgctgaggcacatacccacattcaggcatctgcattaggccaagcatagctcaaaagcccagggtgacatttaagtcatgctggttttctttaagtttaaaagcaacatggtgattagtgaatgaaaacagacttttggggatggggtctgtgaacctggaaataaacctgaagtggtgaccaggagaagcttcctgttgtcactgaaagccattggtttgtgagattgtgaatctgcagagtgagtaaagtcatgctggtgtgctttgtaatctattaatggagtgggtcatcttcacctctttctcggtggttttagatgtccagtctgtagtcttcgatgtggctaccctcccagtaggtagtcatcctttaatggactaactcttgaagaatgctaattctttatatttcacagatatttgtcccagtggcatctttctagtatatataaatttccatatttttttcaagcagagaggcaagtgtttggtcttttctcaaatgggaggggaaagtggtgattcttgctggggtccattggtcagcactttcgattccttctcaactggatttggtaacacaagggagaaggcaggtttttacctcctccaggtattagggtagcaataccaagcttagctatacattggaattcccaaggacgtttccaaagtactgatgtctgtgcctgactgctagcgattcttatttaattggcctgaggtatagcctgaatgttagaattttgtttgtttgtttttgttttgagacagtcttgctctgtcacccaggctggactgcagtggcaccatctcagctcactgcaacctccgcctcctagattcaagtgattctcctgcctcaacctcctgagtagctgggacaccaggtgggtgccaccacccccggctaatttttgtatttttagtagagatgaggtttcatcatgttgcccaggctggtctgaaactcctggcttcaagtgatctgctcacctcggcctcccaaagtgctgggattacaggcatgagccaccacacccggcctggtgttaggatttttgaaagcttcttagatgattccaatgtgcaaccaaggctgctgaaccactggtgtgaagcaatgctgaataagcagttgctgttggacagaaatgttggtctgcaagcccatgatatcagtagccatttgaacctgtaggtaggagtctgttgttttcccattttctatctatctatcttcttttttttttttgagacggagtctcgctctgttgcccaggccggagtgcagtggcacgatcttggcttgctgcaacctctgcctcccaggttcaagcgattctcctacctcagcctcctgagtagctgggattacaggtacccaccaccatgcctggctaatttttgtatttttagtagagatagggtttcactatgttggccaggctggtctcaaactcctgaactcaggtgatccacctgccttggcctctcaaagtgctgggattacagatgtgagccactgtgcctggcctgttttcccattttcttttttgagacaaagtctcgctctgttgcccgggctggagtgcagtggcgggatctcggctcactgcagcctccaccttttgagttcaagcaattctcctgcctcagcctcctgagtagccggagctacaggcgcatgccaccgtgcctggctaattttttgtatttttagtaagagacacagtttcaccatgttggtcaggctggtctcgaactcctgaccttgggtgatccatccgccttggcctcccaaaatgcagagatcaccgcgcccggcttgtttttccattttctaaatgtaaaagcagctgccttctttgcccttcaagaacatgtccaggtttgaaatagattagatttaaattaaaaagtaaaactgtggctgtagaaattcaacaggcttgtttttctctcagcattttcctcattcagtaggtacatgctttagaagagtaagaagttatatttggaactccaaggggataaggtataaccccacccgttgctggacagctagcaggggagaaaaacaagggctcctcacgataactgcacatagttttaccaggtcgtgagcaattaatttcctctgtctctttcattttaaaaggcctctattgctactgaaaagcagactttgtttgtttgtttgtttatgatggagttttgctgttgttgcccaggctggagtgcaaccgtgtgatctcagctcactgtaacctctgcctcctgggttcaagcgattctccttcctcagcctcctgagtagctgagattacaagtacctgccaccatgcccggctaatttttgtgttttttttttttttttttttagcagagatggggtttcaccatattggccaggctgatctcgaactcctgacctcaagtgagcaccccaccttggccttccaagtagactttattttaattaaagttttatttaaaaatttttaaacaagaaatcaggaaattaagccacccctcccaagatgtagagtaagtttctggaagatttttgcaatagagttgttgtgtatttgaggattcttaaaacagtgacatattattaatttagtaatcagaagaaaaataaatgctttttttttgtttcatgctaggtgctaccaggcttactgtatcattgtttgaaggaagtagaaaggaatttatctatcttcaaagaaactccaaatagtagaatcattagagttagtgatatcttgtctcttgcctcatgttttttaaattctagtttcctgattaggttctagctctagggcttgggtcagtcattgaccagaatgattattatcttcgtttttgttgatttgtttatgaaaatatacttagtgtaatacttttgggaatttcattgccttctagtgaatgtattgactgtgccaatacatgtttccagccagcgtctcttgccacacatgggcgtatcacaaacacaggcacattttctattacttgtgaggtcttttaatttttttctaaaggagaataatttcatctattagattcatccagagtaataattaggatgaggggttcttcacatagatttttgaagtagttactaccttcagaagaagattcaacccaggccaggtttgcatgtatgagctgagctcagagaatttctgtgtaaatattatctttaaggttctgtcttggttcatgtttttgtttttgtttttttttaagataggatctcattctgtcacccaggctggagtacagtggtgtgatcattgcccaccggaacctcgacctcccaggctcaggtgatcctcctgcctcagcctcccgagtagctgggaccacaggcgcgcaccaccaggcctggctaatttttaaaattatttgtagagacaggttctcagcatgtttcctgggctggtcttggcctcctgggctcaggcaatcctcttgcctcagtctcccaaagtgctgggattataggcatgagccaccccacccagcctggtttatgtctttatataaattagtctctactattctctataaatgcaggcttagtgtttttcaggaaagctactactgaaaaggacagaaagcattctgttccttcccttgttaagacacagttaaaattttcaagttgcctctcgttgaattttgccccagagtacttgcagagtaggcagcgcagagtaggcagccgtgtgcatatataaaaggattcaatgtgttagccatttgattcttggaaacctgctcatagtgctttttcaaaaatatcttagttgaagattctagaattctagggtacaaagtgaatttgaacaggatgttttaattttcatagaatcagcatggatccaaaaggatttaatattctgtgaaaaaaataaaaacaatacagtatactggaaggatctctcattcagagtttagttggagctctgtcatgcattagccagggctcctggtctgagttctgtgtatgttgttccagttattcatctgtagaaaatgaggttggaggaccctcctcctactctacaagtacagtcccctaggaaaaagacatctgccatcacactcttcatatccactaacgtgactctaaaggggcatacatatgtgagggtttttaaattataaacccttgagaatgagaacacaaaaggagaccacagcaaaaaaccttggtaggtagaaagcagaagaaccactgataaaagacttaacaaacccaagaaaactgactgctcaaagcagcaacaggagaaccagcaaccaccccaggatcccccagaagctcaggaactagcaatatgggaagtaggagcaaaggtggcaactaaaataaagggagattgaaagctgttaaaaagcagtcagatacccagacccatttccccatcctggcaagagctggagacttaataaccccagagatggcaaaacagaggctcctcaacctggggatacctggcatgaccacagtatttgaaaagatggggattacatatgccccagcctctttctcttctttcttagtttcaggatgtttatagtcaggactctaccattctggcaggagattcgagtggatttctctggagaatctggtcagaccaggagaaaagacccaaagatattgacactggagataccaataagagaaaaatgactgcaaacatgaaacaagaatatagtaagaaatgaacattcaggaaacaagagctcttcaaagttaaaaaatatgatagcagagatgatgattaaaggaaggttgagtaaagttgaggaaatctcttggaaagtagggcagataaatggcaagacggaaaactggatagaaaagatgagacagaggactgggaggtctcacatccaactcctgttctgtattctccagaaaggcagcacagagtacagaagggaggaatcatcaccgagagaatacctccccccaagcacatttggcatggaagaaggccagaagctgccacacctcctctgggaggatgaagttgagagaatacctaatgtatgtcttaggaggaaatgtcttggtgaaaggcgtagtgttgaattagaatcattgcatataaaactgagcaaacagaaaaacaagatgcataactttccacatttctcagcgacgactagtacttaacagcagcatcgtaatacaaagactgaagattgtcctaaccacagctatgatatgtgaccgatgggagactggggaatggaaggggatcgtgtggcaggggtggcagaaggaaggggataagtgggaggtcggtaggtaagactgaaaacagaaacatcacgaccagccgtagaggctgacagaggtgaatactgcatataaatgctgagatacttggccaaaagaagggcaagtggttcctttagaaaacagaaatgagaggagggcaactgctgtttttaaaattacatttaattacagttgactgtaaactgagtgctgcatataaacctataaaatcaataggaataggaacactggttaaaatctgccatttggctgacatttttattgatgggttcacatttttagctgcatcaaagcggtagtccagagtcctgtctccttctaccaagatgatagctaagagaaagacttacttggtaggcatctgataattgcacggttgatcacacataccagtctgatcgacttttttcctttacctccctagattatcctcttgacttgaaccacagtgaaaccttcctgcaaactacaacatttcttcctgaagacttcacctactttgcaaaccatacctgccctgaaagactcccttccatgagtgagtacagctctggcctgtcttcctctgcttttaaaatggataaaggggagggcactcttgatctctctgtctgcctgcagagagaatataaatacctccctgccattggaaacagggtttgtgaaagttgtgctcctggctcctcttcaaagcctgctgcaaggttgcctgtgttcttgggtgccattttctacctttcctactttttcactcttccctttgcccttgcctgtcctttgtaacttgggttctgtttgaacttcctagagaaagtatgaatacagtcattcatagcttaacaacgagggtactttctgagaagtacatcattaggtgattttattgttgggagaacctcctagagtaaaattccacaaatctagatggtgtagcctgcgacacccctaggctgtatggtatggcctattgctcctgggctgcaaacctgtgcagcatggtactatacagtaattgtagctcaatggtaagtatttgtgtatctaaacatagaaaaggtacagtaaaaaatgagatataaaagataaaaaatggtacagctgtgtagggcacttaccatgaacggagcctgcaggaatggaagttgctctggtgagtcagtgagtgagtgaacgtggagtgaatgtgaacgtgaaggcctgagacatgactctgcactactgtagactttatgaacactgaacactttggctgcaccaaatttattcagaaaatatttgtctgtctttaatggtagatgaaccttactattatacctttctactttctaaacttgtgaacttgtaaaaagttttaaaaaaaactgcagccttgaactcctgggctcaagcaaccctcttgcctcagcctcctgaggagctaggactacaagtgcctgttgtcaatgcctggctaattttaaaattattattattacttttttaagaaatggggtgttactatgttgcccaggctggtcttgaactcctggcctcaaacaaccctcccacctaggcctgggcaacacgctgcagtgtgccatgatcgtgccactacactccagcctgggcaacaaagcaagaccctgtttcaaaagggtaaaataatgatttaaaaatatagtataataaatatataaaccagtaacatagtttattatcattatctagtataatgtactctacataattgtatgtgctatacttttttatttttgagagggagttttgctcttgttgcccaggctggagtgcagtggtgccgtctccgctcactgcaacctctgcctcccaggttcaagtgattctcctgcctcagcctcccgagtagctgggattataggcatctgccaccacgcctggctaatttttgtatttttagtagagatgggaattcaccatgttggccaggctggtcttgaactcctgacctcaggtgatccgcccacctcagcctctcaaagtgctaggattacaggtgtgagccactgctcccagccttgtgatacacttttatatgactggcaatgcagtagatttgtttataccagcatcaccagaaacacttgagtaacacaacaatgctatggcagctatgtcatcactaggcagtaggaatttttcaactccattgtgatcttatgcaaccaccgtatatgccatccgtcactggtgaaaatgtcaaagcacatcactgtataggcagtcagctttgtctttttagtataaacctctcactgattgtagtgcttgatcttagaggtgggggtctcactatgttgcccaggctggtctccaacttcagggagcaatcgtcctgcctcagcctcctgagaagctgggactacaggcatgagccaccatgccttgcttggaagttattttcttaacaaagtgctagttaaaacaattcttagatctttttgttcttttttttgaatctcgtgtaagctaaaacaaggacagtaaactcttatacctttcctatacttttaggcttcttaatatggttccccacttctttttttaaaattgtttttttttaagaagtgagatcaagaaaaggaaaatcttacatttgcaaagttgacttttatgcacaaatatagtgaaaatagggaaaatgttagaaatagtcgtgcatggtatttgaacatattctcatccatatatgaataattaattataagtatgtaagttgtgttggaagccttactgtttcatttgcatgtctcaccacacatatataggttttccctttaaaacctgcatttgtctgcatctagatgtaagcttagtttgggaaggctgagatttgtgtatcagaaataggcgttgacaggcctaaaactaatgttattagttcattgtttcagtagcatttattgattgttactgtaccacttcctgacttaagtcagagatgaccagcattctgagttaggacataatcactcagggtcctgacccactggtgaatggattgagagaggtagtgtggctgcacttgcatcaggagcaaacctgacatgactctaagctcagctgcttttctccttcttctcagaaaagctcagctgcagccaggtgcaggggctcatagctataatcccagcactttgggaggccaaggtgggagaatcactggagctcaggagttcaagaccaacctgggcaacatagtgagaccctgtctctatttattaaaacatattaataaacaaaacaaaaaaaaaagaaggctgggcacagtggcccacgactgtaatcctaacattttgggtggcccaggtgggtggatcccttgaggtcaggagttcgagaccagcctggccaacaaggtgaaacctcatctctactaaaaatacaaaattagctgggtgtggtggcatatgcctgtaaccgcagctactcaggaggctgaggcaggagaattgcttgaacccagaggcagaggttgcagtgagctgagatcacaccactgcactccagcctgggcaacagagcgagactgtctcaaaaaaaaaaaaaaaaaaaaaaaagctcagctactgttttacttaaagttttcatttctacctggcccctgacagaagcagaactctaaagtcttaattccttgatttgcctcttcaccttgaaaatagtgaggaactgaaatacggtgagatggaaagcagaggaagggacttccatccttgctaaaaacaaattcagctgaaaaagcattgcgctctccagagactaaaaccccaggcatagggaaacctatcattttctgacctcttaatcccttttccccgtctctgttcagagggcccaatagacataaacatgagtgaaattggaatggattacattcatgaactcttctccaaagacccaaccatcaagctcggaggtcactggaagccttctgattgcatgcctcggtggaaggtagggtgtgaagtcacagccaaaatgctgagaagcccacctggggtttgcctttggtccgaatcaccatgggattagctaaccatgacattttgtcattttcatcctaccattccatgcaaatgtagaaacattttagaggaatgggtttccacaaggactctttttgtagatacagaaatttgcattattctgatgaccgagcaagaccctttggtcttcccaccaggaatattaacaaagcaaggggatgagggcgttggtggtctctaatgacccatttgcagaagtcatctacagagtcagtgcttcattcctgttctccattggttactacaagattagtggattaaaaagcaaagttacctggcttgacattgagatttagtttttttctgcctgaccatagtcagaagacatcagtagttttcgttaagctgtgaccccagctgaagtccattctttcaacaagtatctattaaaatgcgtattctgtgccagcctcgttaagtgctgctgatgcagcagatctggaacacatcagtatccagcccatcgctgggaaataaaaacagttgaataaccagcatttgtacattgcacattgtaaggggaaatactgttttgtgaagcttgttttaattgtaagtttatagatgtatttttgtcacagtgtagaatgtgtgttttcctatgagttatggcctagaataaattataggcctactatgtactataagatatggtatatgtaagaatcacattcatctaggtccaagggccaacttgccaacatagatctttgtttagagaaagctgaggacaagatagccagcctcccagaactcccatgggttggtcagcaattcatcaggggtgtcctgctaaggagtgaaagctgagagtcctaactgtgcttcttttgctgtaatccactccaggtggcgatccttatccccttccggaaccgccacgagcacctcccagtcctgttcagacacctgcttcccatgctccagcgccagcgcctgcagtttgcattttatgtggttgaacaagtgagtagtcctttcttttcctttcttttttctcttctgagacagcagtttaggttgctgcaagctaatccactgttggtgtgaagagccaataaaactgaaatcttaggatcgagttgcctgaggtttgaagggggagcagagagcaattctgtgctcctggtttgagatgtctgttgcccagtactgggcacacttgaatccaggagagagctttgttggctcatgaacaaaggcctcttgtattatggttttgttggtgcctgcaggctccagacccaggaagttccccttaagataaagagctgcagcaaggtacagcacagaggatgtggccttggagtcaagagacctcagtgcttgtcatgtctgctgttaatcaaccaagtggcctgggacatttgcaaacttctctaagcctgagggtttggttttgttttaatcttaaaaatattggtagggaaccagatatagaggtcacaaactgaagaagaccgcatggcaaattcagtctgtaaatctttttttttttggtcctgcatatattttatttgcctttagatggaacatgactgtcctactgtggttttctcttgccgggcctactttatatgtttacattactgacttggcttctgtaggcattttgaagtatgtgatccttgaactagaggtgctatatccatagataaacaaaaggttgacagatttccctgaatacactgatcgtcagtctgagggtcttttgcatgctcacctctctctatgggcacacttttgagtctcacagtctgagttgctgttaagtggtcaccctggagcttgccttatactggagtgagaaaaaagctgagcaccactgttcagcaaggctgggcatctgggaaatgctaacggtctatctgccggtcctaagttgggtattttgatagtggcaagggggagtcaatgtagctgtaacactaattaggctgttaactgatttgaactggtttcttcatgagccactgaattctttgtccataggcttgagtccctggcatgctcagtgactgttgtcttagttagatcttaaaaataaaacaagacaaaactaaaaaccactctttgtactagatttggtttatgaacagttagagattggttgatgtgctgaagagcaagtggtaaggagtagaaatggtagtgttgtctcttccctttgtggagcggggtactcttctaaatgctggtacacggttgcatttctgccttcagtagccttgggagagagaagcttgcgtttgctatcacttacatttttaaagaaattggggccagaggtccagtgactttttctttttcttttttttggagatggagtcttgctctgtcgcccaaactggagtacaatggtgcgatcttggctcactgcagcctccgcctcccgggttcaagctattctcctacctcagcctcccaagtagctgggattacaggcatgcgccactacgcctagctaatgtttttgtattttcagtagggatggggtttcaccatgttggccaggctggtctcgaactcctgatccgcccaccttggttttccaaagtgctgggattacaggcgtgagccactgtgcccatgccagaggtccagtgacttctgagccacactgtgagttgatttgtggtgttggacctggttacactagcccagtgatcttttccagttggttctaataaactcgtctttaggcacaggaaagacagcaaagattttccttcaagattcttttaaagataaagttctgtttcttttaggttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgtgagtatcatttcttcttaattaaagaggttaaatctgaaaggatggtgagcgatgtgaaaaggaaatctaattagctgcaacctagatgcccatcaactgatggatggataaacaaaatgtgtgtatccatacaattggagcactgtttggcaggagaaagcaatgaaatactgatacgtgccaaaacacggatgaacttcgaaaacgttacgttaaagaagccagacacaaaggttgtgtatcatatgattccaggtgtctgaaatgtccagaataagcaaatctatagtgacagaaagtagataaatggttataaggggctaaggaggataggaggagcagggggtgattgctaatgggtgcaaggctttgcgggggacagtgatgaaacatgttaatatagattgtggtcatggttgcacaattcagtgaataaactaaaaccattgaatgatatactctaaatgggccaattgtgtatgggtatgtcaattatatctcactaaagctattaaaaatcagtttgcaaaaattaattttgctaatttgatacattcatatggttcaggtcaggagcacagagagcactgtttttagtcctcaaatgagaaccttctagggaaaacagttaccctgtaacacacagatgattgatgtcccacatctcctcctaggcttccttataccgagttctttggcggagtgagtggcttaacagtggaacaatttcggaaaatcaatggctttcctaatgctttctggggttggggtggagaagatgacgacctctggaacaggtacctctgccgttctttcggtgtcttctagaaatgctaccttagactgcagaccaatactatccgataggaatataatgcaagccatgtgtgtaatttaacatgttctagtagctacagtttaaaaggttaaggaaaaaaatgaaattgaccagctgtgatggctcacacctgtaatcccagcactttggaaggccgaggtgggaggatcacttgagcccgggagttcgaggccacagagagctgtgccactgcactctagcttgggtgacagagtgagacctgtcttaaaaaatacacacacacacacacacacaccacacacatccaagtttttagaaaatatctttaatcttaatttaaaaatatcttaatatcttaaaaaacaaactgtatatcccaacaaagcagctattttcatttttctcctttgacatgcgaaaatcaacaaattataatttagcaattttttcttctaataaataatacgttcattataaaatacaaatgagtataaaaataaattacccacaacaataagtaacatgttaccatttcattgagtttattttgtgtttaaaaagtggcaagtgaacagtaatttaaaatctctgtgtgtcagtttttaaaatcacaaatctcaggattgtgaggattaaatgatgtaatgtgtatagagctctggcatatctgatatgtgataagctctcaataggtgttactgtttttattatatcaacattaaatactctgtaaacaggatcttaagtggctccatttaattcggttatatagatgtactgtaatttatgtaactatttcctggtgtatatttagaatcttttccattttccactatttagagtgtgatatagtagataattcttttgcctgttattcctatttaggaaaaattcctataagcgaatgtagtcattttaaggctctttttttttttaagctctgtcctttaatggatgcaaatagggtttttaaggcatattataactaagtgcccctcctgctaaaggttctaacaaaacttttcacttcaccagtgttctctgtactaaatgcccatttcattggaaccactccaaactgaagggtggaatattagtgatatgtctacatagatttagctgcgccatcacataaggcttgtactgtacaagcttgggtgaacaatcctgtgtgtgagtggaataaagtaatatttttatggagtaagtaaacagtaacctcataaggaacaaatgcaaaatactacctggtatctgtttcctttgtagcttggcttttgaaaagtatgtgtttgttgttaattacaaggactattttgctaataaaaattcaaatgataggctgagcactgtggctcacacctgtaatcccacctcttcacaaggcctaggcttgaggatcacttgagcccaggagttcaagaccagcctgggcaacagtgagaccttgtctctacaaaaaataaaaaaaattagcctgttgtggtggcacacgcctgtagtcccagctactcaggaggctgagatgggaggactaattgagcctgggagattgaggctgcactgaaccatgatcacctcactgtactccagcctgggcaacacagtggaccctgtctcttaaaaaaaaaaaaattagatgatacaagtgtctaagtattaatccccattttgattctattttattccctggaagtaaccatttctttccgtacttttcttttcttttttgagacagattttctttctgttacccaagctggtgcaattttgctcactgcaacctttgcctcccgggttcaagtgattctcctgtctcagcctcctgagtagctgggattacagacctgcaccaccacgcctggctaatttttttttttttttttaagtagagatggggtttcaccattttggccaggctggtctcgaactcctgacctcaaatgatctgcccacctcggcctcccaaagtgctgggattacaggcacgagccacctagcccagcctattttttccgttcacataaaaactttaattcagttaaaattgagttttaactcagtttttaagaaatgacacaatgagtcagttaagcgggtgagagcttttgctgtgtgtgatttccagggtaagcttgtaacatgtcttgtaggctttggtcactcctgggctattaccgttgtatctaaaagcctgttctcttggtcttggacagagtacagaatgcaggctattctgtgagccggccagagggtgacacaggaaagtacaagtccattcctcatcaccatcgaggagaagtccagtttcttggaaggttggtggaatttatctctgtctcttagaagtatcccctatactttcatgtccggatatcttagagcatattacagccccttctcctactccccaccccgaggccctgttctgacagctgtttgacagctgttgcatgtattctaactctgaggcagaacagtgtggggatcagaccgttggtgaacattttcaatagtaagattcttcgaaggaaatcacttgtcctatgtcttcagccttgtggtctccacagtagcctttggggaatttgggaagaaacagcttgggtgaaggtccctgaggtgacagagcagtggcgccctttccgcaggctcccgttccgaatggtgtcctgagcttctgtctgggtggctgcagttgctgtgttaccttttctttctttgtgtgtgtgtgtgtgtgtgtgtgtgtgtgtgtgtgtgtcttttctaaattgtggggaagactgtgctctagacaaccaattctaattgctgaaattctgttttcatgggagtaaaatggcactgaatacagagtatgaactttctcatctgttgtatttttaatgctttacctcccacttccccactctctgaccttgggcaagttacctcacattattaagccttggcttcctcatttgctagcaggggctggcgtgagcattaaatgaaataattaagtgaagcacctggcatgaaacacaggaggtgtttctgaccacagcactcagcctggcatagcagaattggccgtgcgcccaccttgtgctgcagaagtgctgccatgggttgcgtcctctgctgtgggacgccctgctccatcctctggctgcagaggcatggatcctcactcagagccacctcttctctgttccctccctaaacaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcattttttttaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttccccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttttttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaccttggtggtcatttctctttgtgtaggacagtttgggtccttgggggtctttcctttttcctttcctttcctacaggagttcaacttaaggcagctcagctgagctctgggtcttgctggggtaaatactgcctgacccgtgctgcaggtgaacgggctgagtaaaaagctacgcagtgtaacagaagcagtcctccactgtgctgcccaggcatgcccacgcttgggttttctttcaagaatcacccaggtggtaccaagaaagttgcataagacacttgagtgaggggacttgggggtgaagggggtggtgagggttgatggagtttgattccagaaggttctctgggatcagtgtagggtttatatgccagattctgctcagagattgtcatcatggcttctatgtgttgaatgtttgccactcacagtattaatagtgtcagatgccggggacataataatagagaaaataagacaggatcagtggactcattaaacttacggtccactggggggtatgattaaaattgtat

SEQ ID NO: 16118 - DNA, 52496 bp, Human
taaggtactttctttttttttttttgagacggagtctcactctgtcacccacgctggagtgcagtggtgtgatctcagctcactgcaacctccgcctcccgagttcaagtgattctcctgcctcagcttcccgagtagttgagactacaggcgcatgccaccacacctggctaatttttgtgattttagtagagacggggtttcaccatattggtcaggctattctcgaactcctgacctcaagtgatccgcctgcctcagcctcccaaagtgctgggattacaaagcatgagccaccgcacctggccgaggtactttctttctaacaccaaacccagaaggacattgctgcagttccaggcagcactggtgcagagcaggctttccttatatggggcagagagaagggcacagcctgctcctaatagggaaaggttgagctgatctgagcatgcccagtttatgctctccagactctccaagcacatgagtcttggcatctccccgagcacagcaagtaacaggcaggaggagtgttaagcctgaggctccatcttcagggaagaaaacatcccaactagagaagaagggacaccttcccctcctaacaaatgaatgagcgggcaagtgagtaaatgaatgagtgattctgattgggggggtgcagggatgtcccttcactcaccctcttgtccacagttgcaggggctctcattgctgacttcttgtctggcctggtacactggggtgctgacacatggggctctgtggagctgcccattgtggggaaggtgagtatgttgacctaaccatgtcctcaagaaggaggttgggctgtatggccttgagtgagtcccctttcttctctaagactgtttccctatctgaaagatgggaaccatcattgcagcctgtccctcacccctgtgctgcaagactagaacaggagtcccttgggattttggaagcaaaagcatcaggcttgggatggtccaagagtttagatatgtgcctgcctcatcagaacccctgaatttgggggtgtcttgcttttccattgtctcccctgctgcttcttgctgttttaactgcattttatcctgtattagtcacttttttggttttgacagaaaatctaaactggcttaggcaaacaagggtactgattcatgtaactgaagatttcagggttagagccaaattaaggaatggctgcatccagtaggaccgacagaccacattcttcaggcccagtcttcttccatctctatctctactttcccctcataaggtggccagtgtgctttctcaccgcccagagatccatccttccagctcccaagaaaagagaactgtccttctccttccaggagaacagcatttctccttccctgtagtttccgccaactgaagtcccacggctcactcccattggcccagattgggtcacgtgctgggccctcaggcagtcactggctagagggaggagatgctatgattggccaggcctggtcacgtgttctttctcagcccggggcgaggtcagccttgtcagaagagcctggactaaggaggggaggctgttaccccagcaggtgcagggggtccagagggtcccaccttttacttagagggacctcctcaactgccttggggtggggaggaagggcggaggttgtctccaagcccccttacagcacaggtagggagactgaggcccagaggcagacagtgccaacccaaagcccttccagggtcatttcggctcatctccccaaaggctggatggggtctgtgtctggcagtgggccaggtgggaatgttcaagcatcccgggtggaggaaacttaggatcaaaggcgggaggtgagcccagggtgaatgtgtttagggggctgtggagagcagctgaccaccttaggctgactgctggggctgtgtccccctcaactccaggctttcatccgacccttccgggagcaccacattgacccaacagctatcacacggcacgacttcatcgagaccaacggggacaactgcctggtgacactgctgccgctgctaaacatggcctacaagttccgcacccacagccctggtgagacacccagctagtggtgggctgggagggggccttgggggcagaggccgacccccaggagccttctggggcttatgtgtttggctccttatggtattttaaaagagttttcattcattgtcttcatgtaaaatcaggaaacctgacatgaagatggaggtttccagcttctcttgcacaatctgctctggcccccctgggtccatgttcccacctggcctcactgggtgggagctgagctgcagccactgcctttgacaggacgcgtctttccagtttaccaccgtccccactattccttgcttccctgcacccaacccaccttgttcatttgtgttacctgcctggcagggcttctggggttttgctaccgtggcctagtggaaaatgtctaggctgtgaaaacagggcctgcctatttttagagggactggtcccaaagtaagtgatttcaccactctgagcctcagttgccttatctgtcaggtggaggtaggttggggcccggtcctgttccagcaccttaacacccatttgttcttcaggcagcctccggtgggtagaggtggtgaggacgtgtagtgtagtgggtgctatggcaccctgcccatccccttccctgggggtgcacccagcccctgcttctgtgagtggtggctgctgacagctcccagcttctccagggatggaggggaggtcccacctgtctccttgggataaggctggagccagtgactgaaacgcctccgacgctagtccctttgcctctgagtgggtctaattctaaagagccgttaacacctcagagctccttgcaggaacagactgagacaggacgccacccaccccatctttgctctgctcttcccctgccgtgtcttgcttccctccctcccttcgaggttttttcctgaagaggctcccttgataaatcacatgcacaagaacctgtttcaggctccgcttctagggaacctgggtgaaggcatcattcccattttcctgatggggaaattaagcttcttagaggcagagtcaccgatccagcccatactgccaagaaatgtcggcagagatcggaacccagctccagctgactccggtctacattcccagccattgccatgcttatgccattatcctattacaccattacgcctgcttcctgagcaggaggaaagcctgaagcccagggcagcacctgagcttgcctgcggccctgcagggggtggaagagaatcctgggtgcttgcccagctcaggagccgcccaggagcaggtggtgagggccatttggggtgggttccccgtcccgagtgacagctgtgccggccccccctctccccaacctgcagaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggtgcggccaccagtggcgtggaatgggctttccccaccccagccactgcaccatcttcgaggtcaggagggcagagatcacagcaggaggtcacacagtccttgccctctgggaacagtctctcaggtcatgcatttattgagcacctactgtgtgccaggcactattctaggtgctgaggacacagtaaatgagactgacaaagccctctccctcgacttcatggcgttgtgattccagccacccatcatcccgtatttattgagcacctaccacatgccatggtgctttgggcgtaggctcctgcagcaaacaaaatagcatgaatcagctgggcgcagtggctcatgcctggaatcccagcactttgggaggccaaggcgggtggatcacttgaggtcaggagttggagaccagcctggccaacatggtgaaaccccatctctactaaaaatacgaaaaaaaattaattgggcttggtggcaggcacctgtaatcccagctactcgggaggctgaggcaagagaattgcttgaacctgggaggtggaggttgcagtaagctgaaatcgcaccactgcactccagcctaggtgacagagactgtctcaaaaaaaaaaaaaaaaaaaaaaccagaaaacacggatccttgcccttgtggcactcaccatctagtgagggagctggaacgaatgaataaaatgtgtagcgtggctaatggtgctaactgctatggaggaaaataaagcaggggtgggagaaggaagtgggggctttgcctcttaaatcgggtggtcagggaaggtgacacttgaacaaagaccccgaggagctgagggacaaagccgtgcagacctctgtgggaggcactctaggcagcaggaacagtaggtgcgaaggccctgaggctggcctttgcttgcttggtgtgtttccggaatggcaaagaggctcctgactggagttgaggcagagcaatggaagagggagaagcgggcagagcagtggaagagggaggagagaagggggcagagcaactgaagagggaggagagaagtgtgggagggccctgaagatagatgagcacagattagagcaaaggtaacaggaagcagcaggccagaggcaggaacatgcccagtgcagtggaggaagggaaaggaggcccacgtgccatgctcagttagcagccagtgcgaaagaggtgaggtgaactgggagtttctctggagccagctgggctgctttcaaggttaagtgtatcaggtgctgtcaagtctaactcaggcctaactctcagcttctccacatgtgcctttaggcaactcacaaacctccctggggaccgcttttctccttacaaaatagggctgcagccgcctccttcatatatcaccttcttagggccatagtgggaatggcaaatgcggtgtttggcatatagtaggtacttgataaattacagctactatttttttttaggtctttctggaaacagaactgagaaccacaaaaaaacattctttttcatgtcctcaatttgtgctccttggaaggcaggtggagggattagaattcaggctatttaggagatgggttaactacttaggcagggctgagttccaatcctggtttggccacctgctaattgggaaactcttctctaagcctcagtgtgctcatgtggaaaatgggactgatattagtatctacctcatggtgagctggaaggctgtaagattgtgagcaatatttattcagcacctactctgcgcctggctgtattctaagcactgaggatcagcagtgaaagaacatggtgttttgcattttggggataacgttccagttggggattggggggtgaacaaacacagaacaggaaaatagagaattaacgaagatggttacaggttatcataaaggctataaagaaatgaaagagggtggcctgtcatggtggttcacgcgtgtaatcccagcactttaggaagccaaggcgagaggattgcttgagcccaggagttcaagaccagcctatataagacaagaccccatctgcattaaaaaaattgtaaatagagccaggctcagtggttcatgcctgtaatcccagcagtttgggaggccgaggcgggtggatcacgaggtcaagagatcgagaccatcctggccaacatggtgaaacctagtctctactaaaaatacaaaacttagctgggcatggtggtgtgcacctgtagtctcagctactcggaggctgaggcaggagagtcacttgaacccgggaggtggaggttgcagtgagccgagatcgccccactgcactccagcctggccacagagtgagactctgtctcaaataaatagatagataaatgatagatagatagatagatagatagatagatagataaagggtaatgtgagaaacctggggtgctgcttaagtggatgatcagggaaggcttcctggcagaggtagcatttgagctgagtgataaggccaccacagtgcctggtatatagtaagtgctcaaatataagtaagtgcctggtatatagtaagaaagtagaggaatatgggggttggaggcctgagtggccccaggcccattggtgggaggcccccacttccagttccttggccggtccctgtgtcctatcctgtactgactcactcctcattgggcccctccagcccagtgaaggtcagctctcttccaatgtccccttgactactctctcccattcaaactcccgctgccatttctactgcaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacaggacagaaccacagcggaaaagcagggtcggtgctgctttggcagggtggtcatgaagggcctctgagctgagacctgggggaggagaggaggtcagacacgaaagaagtgagggaagaggcctcttgatgggacagcaagtacacaggccctgaggcaagaacaagcttggggccacgcacagtggctcacgccagtaatcccagcactttgggaggctgaggcggacagatcacctgaggtcaggagttctagaccagcctggccaacatggtgaaaccctgtctctactaaaatttacaaaaattagccaggcgtggtggcagacgactttatcccagctacttgggaggcagaggcaggagaatcatttgaacccgggaggtgaaggttgcagtgagccgagatcgagccattgcactcaaacctgggggataagagcgagacttcacttagaaaaaaaaaaaaagaacaagcttgggattttaagagatggtgaggcagccactgtggctggactagagtgagctaaggaaaaatggaagacaaggttgggaaaacatggatttggtatacagagactcataggctgaggtgagtggggacctgctggtcattttatttatttgtatttattactatgtttttagagacagggtcatgctctgtcacccaggctaaagtgcagaggtgaggtgtaatagctcacagcaaccttgaactcctggacacaaacgatcctcatgagtggctgggactagcacatgccgccacacctggcttggctatttttttttttttttaaagaaatggggtctcactatgttgtccaggttggtcttgaactcctggcctcaagtgatccgccttggccttccaaagtgctggaattttaggtatgagccactgcaccgggtcaggacattatagaccaattagtaacttgtttatttgttgaataagtaattataaggcatctcctatgaactaggtactgcgattctgtagtgaacgctacagacatagtcaatagctagtctaggctagatagtttctgcaatattagccagaaaaaagaaagcctgttggggacagggaaatgcctaaaggactccagagcagtcacagataatgacatttctgagtagctgggattacaggcgcccaccaccatgcccggctaattttcgtatttttagtagagatggggtttcagcatgttggccaggctggtctccaactcttgacttcaggtgatccacccaccttggcctcccaaagtgttgggattacaggcatgagccactgcgtccagccatgacatttattttttaaaacgtgacccataatgccattttcctttgccaactagacttttgatttgtgactatgcctgaggggaccacacaaggaagggtgttagaattcgacaactcataaatgacagaaatttaaagtaaacagctaaaataatcgtattagctcataaaacggaaaagtctacaggtgttctgaattaaggtttggcaggacccaggggctcacatgattcatcaaaacgtggtctctctaagctctgtttttctctttgagttgagacttactagaccagctcagcaatctcagtggaaagtgcattcccagtagttgcagtggaagtcccagggcaggctctcattggtctggactgggtcacgtgcccatccctgaaccaatcacattggccagtggggtgaaatgctctggttgcccagggctgaaaaatgtccatctggatttgcagggttgtgatcacctcttcctaaggcattactacaaaaagaagtcaatggtggatgggacaggcagctaaattctttagaggccataggagtagcctcaccactgtggtgttggtttccaggccccaccaatctgtgtcagttcccctggagccgacagaaaaaaaaccctcagcctgagtccagagaggtaaagtgactcccccaaggtcccacaggtagtaagggtagagcagccctcagactcagaccatttcacttctgaattctgggggctggaaaaaaatccttctcaaaaccagaaggtgcgctgcattgggtctgagagtgttggggccacttgtgagatcagggacttgcaaacaagtgcctatgagggccagacaggggaaaatgctacttaatattactgagcacttaactttgcaccagactgtgcagagagctctggcatgggtcctgtcaagcagtccctgcagctctgagaagtgagtactctttgcaccatttgcagatggggaaactgaggcacagaggtcatgtaatatgcccaaggtcacacagctggtaggtggcagaatcaggatttgagccagcgtctgacccaaagcccctgtgctttaacgctcccattgtggagagggaggtgagacaggtggcacgtgagaaatgtgtccactatgaggcaactgcagcatgcctgagaaagggccgctgacgctggggactgggatgacctggagacatcaggcctaaagggcagctgctactcacagcagctggttaaacaggagccagaaatctaaactttaaaaatgctggctccgtgtttaaaacgtactgtgggcaaaacaaaatgagtgcataggccaactgcctgcagcctccctcccagctgctgtgggatggcttggtttcaggtaggcatgtgctgctgtctggtggtggcacagggtagtggcatgcagggcaaacatgggtttccagctcaaccgggggagctgtagtgaacttgcatacccctgtgtgctcactgttctttagaaggggcctgggcacatacctttgggcgcctgcccccaactgaaactccatcaccccgccttttttttttcctggagacggggtcttgctctgtcacccaggctggaacacagtggcatgatctgcgctcactgcagactcaacctcccaggctcaagcaatcctcccatttcagcctcttgaatagcgggaacgacagacatgtgccaccacccccagctagtttctttttgtattttttgtagagatggggtttcaccatgttgcccaggctggtctcgaacgcctgagctcaagcgatcggcccacctcagccttcctaagtgttgggattacaggcatgaaccaccgcgcccagccaaccctcctttgataaaccaaaaatatttttcaagctacccacatatatatatgggtatatatatatatatatagcaatatatatattgctatataagcaataggtaatgcttgcataggtaaagaataagaatcacgccgggtacagtggctcatatcaaataatataaacagggctagagtatggataagctgaccctggacagtgggccaaatccagccacttgcttttctatagctcagaagcttttgtgggttgtttgtttgtttgtttgtttgtttgtttgttttttagagacagggtcttgctctgttgtccaggctggagtgcagtggcacaatcacagctcactgtaacctcagactcctgggctcaagtgatcctcccacctcagcctcctgagtagctaggactacagatggacaccaccacatccagctaattttttttttttttagagatggggtctcgctatgttgcccagggtagtctcaaactcctggcctcaagtgatcctcccacctcaacctcctgaagcactgggattacaggtgtgagccaccatgtcagccacgagcattttttaaatggctgggggagggggaacaatatttcctaacacagaaaattcaaattccagtttgtaaagctgaattggcacacagccatgcccctcatttacatattgtccgaggctgcttttgcactgcagtggcagaattgagtcgttgcatcggagaccacgtggtccacacagcctaaaatatttacgatctggccctttacagagaaaagttaccaacctctccctagtctagaatgaagggtaaattgctccccattcatgttccctcaggtactcagttcccctccttagaggccatcattttgacaagacacttgcaatgccttatgtaggcagaggggtatgtctgccccactccttttcacacaatatgtaggatattatgcacacagttctgcaccttgccttttttcacttaatatattttggagatagtgttatcattaatgttcacaaaccattattattttttacagctgcatagtgttccaccttcaggatggaatggacttgacttttttttttttttttttttgagacaaagtcttgctctattacctgggctagagtgcagtggtgcaatcccagctcactacagcctctgcctcctgggctcaagctatcctctctcagcctcccatcccaagtagttgggactacaggtgcatgccaccatgctgagctaatttttttttattatttttagagacgggggtcttgctttgttgcccagactcgtctcaaactcctgtgctcaagcaatcctcctgcctcagactcccaaactgctgggattacaggcttgaaccacgagtgtgttttaaattttgatagtgcataccaaattgtcttccagaggccatgccggtttaagttcacaagttttcagagtccctgtttcctcacacccttgccaacacagcgtgttatcaaatgttttgttctttgccaatctgataggtggttttaatttgcattcctcttactgtatttcattgattctaagatgtcactgattctaagatgcatcctgatttcagaagttcacatgtaaaaatgtggctgggtgtggtagctcacgcctgtaatcccagcactttgggcggatcacgaggtcaggaattcaagaccagcctggccaacatagtgaaaccccgtctctaccaaaaatacaaaaaaaataattagctgggtgtggtggcgggtgcctgtaatcccagctacttgggaggctgaggcaggagaattgcttgaacccaggaggcggaggttgcagtgaactgagatcgcgccactgaactccagcctgggcgacacagcgagactctgtctcaaaaaaaaaacaaaaaaaaagtaaaaacgtatagcttcaaatcactgaaatacaatatgttttgtgagattgggtatcttactgtgagtttaaaatgcatttgcatttcctcatctgttcatgtccttttcctatttttcttggaagggagggtagcattggttaagagtgtagggttcaaatcccagttctgccacttacaagcttgtgactttgggcaagttacttaaccgttctgtgtctcagtttcctcacctgcaaaatgggaataataatggtacctacctcataggataggtgtgaagattaaatacattattatatgcaaaataccatgttcctggaatatggcaaatgctcaataaatatttgctgtaactgtcatctttgagttattttttcttaatgagtttcaagggctctttatacgttaaggaaacatcctttttgtccccccacctccctgccccaaaccccagttttcattcctttttccttgaccacagaagtaacatataatacaaaattaagacattacaaaaattgtatcagaagaagccaatggaaacaacttagatgtccattgatagagtgagttaatgaagtacaccaagaccccctgcccacccatccccaccgctttttgactgtatatttcggaaactacatcagacattaaataagatgtctcagcgccatggctagacacacctcagggagccatgactccacataaatgccatagaatttcactagcaaatgcatcacacatcctgtttgtttgtttgtttgtttgtttgtttgtttttagatggagtttcgctttgttgcccaacctggagtgcaatgctgcagcaacctctgcctcccaggttcaagtgattctcctgcctcagcctcccgggtagctgggattacaggcatgagccaccatgctcggctaatttttctattttcagtagagatggggtttcaccatgttggccaggctggtctcgaattcctgacctcaggtgatccaccggccttggcctccctaagtgctgggattacaggtgtgagccaccatgcccggcctcatcacacactctgttaaccacacatcccttctcctctctgtcttctgcaagtccacagtccttcctgtcgacagtttgtcagctttactttctgcagcttatgctacaaaaactgtagcacgaggttgggggggttccttaactataaataggaaattgaaggttgtggataacattatataatttttgttttttcaccttttgaatatactttttcaaactactcatgccttttacatcccagagattccaaaccagccctagtgttttcccacttgaaaagagagttcacgaatggacattgtggatctgtcaggtctacatgcctctcaaccgaaccactgcgtcagcttcctgtatctattaggtatgctttttggtggtaggtaacaaaaacctacctttaagaacaacttaagcaacaggcacattatctcatgtcttcagatgtctgcagttgggcagccctgcaattccttcagcagctcagccacatcacccaggattctaattctaaccattacaacctcatattgtaggaaggaggaaaggggacaaaaataggctttttcttcagcttttttgtttgagacagtctcgctctgtcgctcagactggagtgcaatggcacgatcttggctcactgcaacctctgcctcccaggttcaagcgattctcgtgcctcagcctcccgggtagctggtattacaggcctgagccaccaagctcggctaatttttgtattttcagtagagacggggttttgccattgtggccagggtggtctcgaaatcttgacctcaggtgatccgcccgcctcggcctcccaaagtgttgggattacaggtgtgaaccagggcgcccaaccttctcttcagcttttatgaggggagggaaagtttccaaacacccaccttgccatgtggggacatggcgactggaatggcggtaaacatgcccaatacaccttctctctgggttccctgctaccaatattgctgctgcccaattgggtgtcctcgccctgtctcctcatggcagcacgatgcactttgtaaaaaggcaaacctgcccacatttagctcaaaacctcccaggctccacctccctcatcacgggagagccagcgggtgacacagggtaaagagaactggattccaaaactgattttactccttccttgttgtgtgaccttggaaaagccatctaactcctctaagtctcagttttctcatctcacaaatggaaatggtaacagctactttgcaaggttcattgaggattaggtaataatagcagctaatacttatattgcacttagtgccaagccctcttctaaattctctagttctattaaccattttaatcttccccaaaatccgataaaacaagactcttatcccatcagctgagtttatcagctcaagcgcagagcggtgatcaggcgcaggcgccggaaggaatcctgctctggggaccggctgtgacgtccaggaatggggcagaaactcttcgagggagcgtgtgcgcgggacgtactacaactcccatcaggcactgcgccaacgctagactacaacaaccagcatgcctcgggctgtcccgcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggtgagtccaccttaggaacccaaatgcttccacttgctactgatgctttacagtgaccccaagtccagggcaagtattttctgtgctccccaaagcaaacttgtatcacgtgatacacgaaaagtcaagttgcttcacctgtagccagtgctggcactttgagagctaattatagctgaatttgatgtggttggaggaatcgaggaaggcttccctgaggggatggtgctggatctgagaactgaagagtgggaacagcacaggcaaagcccctgaagtgggagagggcatgtgttccagggggcttgcaaagggccagtgtcgccgcagaggtacagaaagtctcagaggcgcaggctgtgccaaggctatggtgaggcaagtggggtacctagggtgcagattttttttttttttttgagactgaatctctctctgttgcccaggctggaatgcaatggtgcaatctcagctcactgcaacctctgcctcccgggttcgctcgattttcctgcctcagcctcccgagtagctgggattacaggtgcgtgctaccacgccccgctaatttttgtatttttagtagagacgaggtttcaccatgttgaccaggctggtctggaactcctgacctcaggtgatctgcccacctcggcctcccaaagtgctgggattacaggtgtgagccaccatgccctgccctagggtgcagattttaaggagtcactcacctgcagcgctgtgcaagtgcggagtcaggacctgagtgaaagccccgttaaatctgaccaccccatcctcgtccctgccctgggtgcagagcctggtgcacagggtgtccaggcatcctgctttgccctggagagccctggtttccacttgtcctggtgagattataataagtccccttttaatctgatgtgtgtcctcattaggtgataattctatggtcgctcaacttgtaaagtttgtattttatccagagggaatggggagccactgaaggctttagctggagggtgttttgagcagatgttggtctatatggagaatgggccataggggagagaatggaagctgctggggtcttccaagtgggagataaaggcagcttgccctgagtggagaagtgaacggagtggagagatgcagagtaggcactgctatcagacaaaggtgatgaattggatgtgctgggtgagggcttccagcttccttgtccctctatgtttagagtcctggtccttctgccagtattttgctctgtgaccttaagccagtcccttcacctctctcagcctcagtgtctacatccatataagggcttctcagacaatttataataaaggaggagtaccttcttgggtttatttatttgcaaaaatatttcccaagggcctttgcacaagctgttccctctacctcctcattgttacggtctctgctgaaatatgaccaccttaggaggcccttcctgaccatcctctgctgctcttgtcttggtttatctctaccctatcagaattatagtttcctgtttatttacttgctgtctacgactagaatgtaagtccctgaaagcagggatttgcttcttcagagatgtctatccatccccagcgcctagcacagtgtctggtacatagtaggtgcttaatgtttgtttgtttggttgaatgaatgaatgaacgaatgaatgaatgaatgaatgaatgaattgggtagatggttagcaaatgctttccctgccaccttaatgcccctaaatcatttagctgcacccactccaagccttctctggccggggagcatcaatcctaggagccagatcatctgacctggagggtgatgattcaaaaaatttgaacctggaggttaaaattctgcctgtctctgccacttaacagctgagtttagataaatcgcttgatctctctcggctgcatttttcacattaattctgaccttgcggagatgtggtgaggatctagataggaactagacaggaaaaagccccaagcgaattcggcgcttttgtttgaagctatattttctttttctttcacaatcgcgccttcccaagcctagtcacccctgcccttctcactaagcacatcacaacctccctcgcacccgatgtgtggggacttgcaggttgctgggccctcgagcacgcagatatttcctttctctaaaagggaaggaaaagagccttccaggccacgggtcgtgcaggtctccggggcgggcgtcagcggcggcgtatgtgcgtgcgcgcgcgcctgcgcatcagggccgggggacgggtaaggggggggtgaagaaggggccggccttcaagcaacagcgacgcaagatggcagccaccacgggctcgggtgagcgggggcgccgggcccggccggccgagggggcatgggcttgggccgggggccggggaccctcaaagcctcctgcagcggagccagggtccccgcgccgcctctgtctgctgggctccgcggcagccaccggcgcggcctgaccgggggaggaggagcaggcggtggccggaagcacgggcggggggctgaggggcctgtgggcggcgcggcgaggccctgaggctcccccgggaggcgtgagggccctctgtgctgtctgggggagccggagtgggcgaggagcgagctccgaggcactcctgaggataccggggctggcgactcttaaggggcgatctagaggtcccctagaggaggcgccccacagcggatggaagtcccatactgggtgccaggggtgcggctgagaggggccttgggatgtctggaggggacatcagagaagcccttcaggctggatggaagaaacgggatcctgagggggtgacttgagaggatcccctatcggttgagggaacggctccggcgttagttttagagatggggttagctgaggaaatagctatgttgactagaaaggaggagccttggagcagctgcttttggggagaatgaagggggtctccgcatgataagtgagaggagggaaaaggattcagatgccagagggacctaatagcggtgatagtgaaatgaccccatcattaccagtctcctgttcgaggatacagatggattgcttcaagttaggtttcaggggacaaggtccgagtggggcagttggtggaagcctctgatattggatgagggagaacagatgaattgggagccccgaggatgtctctttgggagtggggattcaactgagggaagcccctgaaatgagggagtggaaaaggtcgggttccggagatgtttcctgtaaaggagaaaagtctcctctttttgaattgagtgagggaagcatatcctagaagtgtctcttctgtggagacgctcactctcatcgactcctttaataattgggacagatatgtgggttcagctcagaagttccccactggctgatgggagtagggaggtgaatagatgaaatgggaactcttgggtgaggctgcaccctcaggtgcctggcagtgaagttggccaaggaggttctctcagatggggtgaaaatgggttacctctctgatggaggaagcaaacagggccacagtgttccccactgtggggctgcagggacaccagcctgagtacagcaatcattggcatatttaaggccacagcagcggcagtgttgggaaggaattggtgatccatgggaaatagggtgaggggaattctttataaatgttgctactctgcggtctcaaggagccatacttgcctgatggttggggtgggaataaaagaaattgaatgtgggggatctgactgaagtgacccaccacaagctgctgccttttgagtttaaaacagtggggtcttcttgcagaatagcggagaccatgaatccttttactcgattttggtttcagctggaacagtgctgagtcaattcatttaccatgacgctgccccaggcactcccagaagagagattctgagtcaggccagactgctgggtaaaacttctcaccagaataacactcctaccgggtcgtaataaacgaaggggcccagtgtgctggtggtagccagcaataaggtgctgttgcagctcagccctgcttgcagtcactcggttggctacctacaatctgggttaacagctgcccggttctaacttctccagaccctgacagttaaaaagtgagtgcttcataaatggctatggtgatcagataaaatgtcagctgctgtctagtggaatacaagagcacttggcatggtttagataacataggacaggctttgaggtgccctaaaatggacttcccaaaattcttttgtctgtttattcaacagatatttactgagggcctattatgtcccatcgtggatagcaaacaaaatggacatagtctgtatccttcgggagcttccattcaagtcagggagagaaggctgttaaggagtaaataagacaatttcagatagcagtaagtgctatggaggaaattgtgtgatgtgatagtgtctggagaggtggtcaggaaagtgacatttcagctgagtcaaataatggaaagagctaaccctacagtgtcacaggcaggagagagagtgggctgttagtgcaaaggccctgtggtgggactctgcttggcatgttgaaataacaggataaaaggccttcatgtgcaagcaaggcttgttaaggagatgagttggagagacatggctttggatttgagatggtatgaggggaagccatcaaacaagtgtctggtatgaagtaggcattcagtaaatatttgttgaatgaatgaataagagtcttaaaaagaggagtatgataagatctgaccttcgtccctaggcagtgaaaagagtgcagggtgctaagagtaaagcagaccttacttggggtaaactaaaatgagtgtacaggcctctctgctttctaaccctgagaagtcttccaggtgtggtcagggcccagaggccttccttagtcaggtttagagtgaggctcttgattaatctgtgcctccggttgccaggaaacagctgtgaagcctttgagttcctgtaagggctgaacttagttttttatggtcactgctttcagcatttggctacaccaccttcccacttcctttggttctgcaatgtgtgatatctacatatgtcttagagggtggaactgtgaaaagcccaccacagatcctcagaatccccatgttatgacgggtgacttcctcctgccttggccaggattgcagcacatcaaatagtggcccttggttgccaggcccttcctctcactcagcagcccacgagcttccctgacatttaatcagaaaatgagtgccagaggggtaagccctggtggggcatgattttaaatttgcatacatcggagtggcctcatatgcacattcagcttataaaaacttaaccatgtgggcagcagagattagtcttcccttccattcaggagtcttccccagagagagctggaaatggatgaaaactcacagtcccttagttcttctcagttcctgtatgtctcactgtgtgagcatcttatgccaattgtaattaagtgccttttgtacaacatgggccctacattcaaagaacagcttcatattgtgctcagccaaagaaatagcagcctgctccagtgatggaggggaaactggctttgttgggctagtgcaagcttttttttttttttttttttgagacggagtttcgccctgtcacctggctggagtgcagtggcgtgatcttggctcactgtaacctctgcttcccaggttcaagcgattctcctgcctcagcctcctgagtagctgggatcacaggcacgcgccaccacgcctggctaatttttgtatttttagtagagacagggtttcaccatgttggtcagtctggtctcaaactcctgacctcatgatccgcccgtctcagcctcccaaagtcctgggattacaggcgtaagtcaccgtgccgggctgcaagctattattttcttaagggattaccaaggttaattttgatgatcatgattttcccccttcatgttaactgaaaaccactctatttcccccaccacattctcttttctcttcatatctctatccctcccacctccccacaaattgtagctctgcagtaatttggtaaaagtagaatacaaaatatgaagtcaggaatcctctgcttaattttgaaggggcacagtgaagttcagagcagcacatttggcaaagtaaatgtttgaatactattactgttgtattgtggatagtgctttagagtgtcccatagacttcgacttacctgtgatgttgtctcatctaactctccacagcctggtcaccagccaggggcagtatccacccacattactgagggaggagccaaaagccaagggagactggtgatgctcggactagagcccaggcatttttaactcctgttccctcaccagcctgcaggaaatggaaaaggcatggatttagggatatgttcttcctaagtcttggagtgtttaatcttggagagagaaagggctttagtaagaagtgtctactgctacccgtttcaggaaccctttttatagcatctctggccactgtttgtcctcttctgggttatgtgctgtccaaggagagtgaggtccttttttcaggaagctcttgcttatattttatactgaataactcacacctcttgggcttggagccccatcatggcatgtacaaagtagttcctcatccttatttacatgcaagccatcagacttctttttaagttgcactcttgggtttactaagtgctagacactgtattaactacattatctcacttgtcacaacagcccattgaggcaggtatcgattgtgaaggtgaggaaacaggccaggagaggagtgactagcctgaggtgcagagcctgggtgctctgggatggtgttgcttcaggacacgtgctcttggccggatgatcgttcttccagcccccatttcttattctctgaggtaggcctcgcaagcatcttcagccattggcatgtctgttatttctgccttggctgattagcttattcatgggtagatggcagtgacctctcaagtagtagtctttcctcatcttcacatccaccctgtcacaagtccagtaggtgtaaccccaaactaaatgccaaatcctcctttctgtctccactcttgtcatcctaatctaaccagaaccgtctttctcttgcctggaagatggaaaaagcctcttgctttcagtcttgccctttccattttctatacaggagacagaatgatctttcacagacgtaaaatagaaactgccactccccttcagcaagcccttcccactgctcttattacagaataacccatcccttttccatggcccacaaggccctgccgccttgacttcatgtggtgtcacacacctctgatcttgctctgtccccagatcttcatgggcctgactgctgttcttcaggtcgcagctacccagaaaggccgtccctgagcactccattcaatagttttttagtcattgtcacagcttcttgttttgttctgtttctctaaagcacttaaccttacctgaagtgttgtttcgttgcatattttctatgccttttcactagggcaagattctatctcaacttctgttgtgtccctagcaccagcacagttctggacaaaatagtaggtactcagtaaatatttgtgaatgttgcagtgagttaattcagaatctctttgatgtagccaaatggatacatttgacaatttgtggagaaacaatgtatccgatagggcagaagcaaaagtggctattcagcctttcaaaaaactgaaactcttatccttatttggtggtatttatagaggtacttgatcgtagaattaaccatcctccccttctccagttgtcctgactcatttcccacatcttgtttccccctttgtcaaagaaaatctgatgcttggtcttggtcactgaccctagcagcagaacacagggtcttgcattctgtcactagctgttgtcacgtggctggactgtaaagaatgacagcttgctactaattctttccctagaattcccctagagcaatggatctcaaactagtatacctcagagtcctggagggcttgtcagattcttaggcccaaccttggagtttcagattcaggaattctgggctgaagacctgagaatgtacatttctagcgagtttgcgatgaggtctggggactaacttggagaaccattgctctagagaaggagaagaacagatctcctgggcaggctaactagacagccagactacacttgggcggttgctcagaaataaaagttacttgcttatggctctatgtccagttttcagggacgttgaatcccagtgcatcaccttccatacctcctcattttctgaagtgggagcagcatcagattcctagctcagttcactgtcttccctgaatgggcaaccaaaccatttttaactagcagctttcttttcaggagaaacctctgaggttctaccttttttttgtttttttttttgttgttgttgttgttgttgttgttgtggtttttggttttgaaacagagtttcactcttgttgcccaggctggagtgcaatggtgctatcttggctcaccgcaacctctgcctcccaggttcaggttcaagtgattctcctgcctcagccccctgagtagctcggattacaggcatgcgccaccacacccagctaattttgtatttttagtggagacggggtttctccatcttggtcaggctgttctcgaactcccgacctcaggtgatccacccatctctgcctcccaaagtgttgggattacaggtgtgagccaccacgcccagccagctctaccattttaattcaagacctaggccagggttttccaagattgacatgctgtggtagctgctgcttggtggccatgattttcccaaaagatgttttaaacgacttcagaatcctttttgtaccacaaatatattaatatgttgctgtgtttcagattactgcattaaatgttttactgtggcatggtgtaaagctctatcaaatattcatgctttttcaacctggttgccatattttctttgtaatatcctgcaactgctgtcttttcagtttatatttagctaagagaataaccggctgacttttgatactgacacaggtccaggaaaaagccttctggaaagaataattctgaaataataggaacaaatattttcttcaaaaagtcttggattactgtgatattttagcaccttgatgaagtttttttttttagcattttcataattcactttttaatagtcatagtctatttgattatacttatcattagctatagattttcctagtgtacttcctagctattatagagcctgtagttctcttggttttgcaagattataagagtccttttgtttgtttgttttttgtttttttgtttttttgttttttgttttttttgacgagtctctgttgcccaggctgggctgcagtggcatgatcgcagctcactgaaacctccacctcccgggttcaagtgattgtcatgcctcagcctcccaattagctgggattgcaggcatgtgccaccacaactggctaatttttgtatttttaatagagatggggtttcaccatgttggccaggctggtctcaaactcccacctcggcctctcaaagtgctgagattacaggtgtgagccactgcgcctggcctgtaagagtccatttttatgtcttccatattgtcacttgatgctgtttctccagctgcctttttggtgtcagattcacacagaaatattgggaatcctaaaattttatgttgattcaattgattaaagtgctagaggaccaaaacatatgttagagtattcttgggttttctcatctgttgtgcttctgttctttggcatatgtacgtttaattttttaatatattcactaaaatgttttgtttaatgtaccgtgattttgaatttaaactctatttaggataggatgagcttttcgcttgtcactgatacatcctgaagtctgcaggatctctgaattccaaccatatttggacttatgtccctggagtagaccctgaattctataactagggtgtgattaggccatttggaattaaatgctcttttgttttgtagaaaatattgatgtaactttgtatgcagtttttaaatggtttgaaatattagtaacttgctttcatacatactttatgaaacaaagttcattttatagtgaagaattctttgacttatgtgatttgggtgagaaaccagttttcccttattttaaaaaaaatggtaagttttcctaaaattctcatttattaaaaataaaactaggctgggtgtggtggctcatgcctgtaatcccagcactttgggaggctgaggcaggtggatcacttgaggtcaggagtctgagaccagcctggccaacatggtgaaaccccgtctctactaaacatatgagaattaactgggtgtcgtggcgcgtgcctgtaatcccagccactcgggaggctgaggcgggagaatcgcttgaacccagaaggtgaaggttgaagtgagccgagattgcgccattgcactccagcctgggtgacagagtgagactccatctctaaaaataaattagaaatggttaccaaattttacttatctcaaaataaaaaaccttaggtatgttaattttttttttttttttttttttgtgccagagtctcactgtcgccctggctggagtgcagtggcgcaatctcggctcactgcaggctccgccccctggggttcacgccattctcttgcctcagcctcccgagtagctgggactacaggcagccgccaccttgcccggctaattttttgtatttttagtagagacggggtttcaccgtgttagccaggatggtctcgatctcctgacctcgtgatccgcccgcctcggcctcccaaagtgctgggattataggcgtgagccaccgcgcccagccaaggtatgttaattatatggcaacagtgtccaatattttggacccagtagattagagtttacaataggaaatactgccttttttttttttttttttgagacggagtctggccctattgccaggctggagtgcagtggcgcgatctcggctcactgtaacctccgcctcccaggttcaagcaattctcctgcctcagcctctcgagtagctgggattacaggcgcgcgccaccacgcccagctaatttttgtatttttagtagagacagggtttcaccacgttggccaggatgatctcgatctcctgacctcgtgatccgcctgtctcagccttccaaagtgctgggattacaggcatgagccaccacgcctggcctgatactgccatttcttcaaccagcaaacatttattgatattgagtatcattatatgccagacagcataccagattctggggaggcgggattgaatgagtcacagctctgacttgagaaacttagagagtgagtcagacaataaaaaaggaagaaaatcaaatgtaaagaaaacataccacacatgcctgtgtggaagtaaaggtgtttgggaccgggaccggggtctctgagagggcctctcctgactgcctggcttctaattaagctttatagcttttaaaattattatagtcaggccgggtgcaatggctgatgcctgtaatcccagcaccttgggaggccaaggcgggcagatcacttgaggccaggagtttgagaccagcctagccaacatggtaaaaccccgtctctactgaaaatgcaaaaattagctgggcgtggtggcaggcgcctgtaatcccagctacttgggaggctgaggtgcaagaaacacttcaacacaggagaccgaggttgcagcgagccaaaatcacaccactgcactccagcctgggtaacagagtgggactctgcctcttaatatataactgttcttaggctttaaaattcatactaagcccctttaataatccttataatgttagactcccagataatggtgctgtgaatgtttctctcttgtattttcaaaaataaaccagattagaattttgtgacattgagcgttgttcattctgaaatactgttcctagctaatacctagtcattcattaattctttcaataagtatttgggtgcttactctagagggcaaaacaccctgacacattggagattcagcagtgaacaaaacagataaagttttactctcatggagcttatgttcagatgggagacagacaagaaacaaccaataaagtgaaaatgaatatatttacaatgtcgagtggcaatgagtactatgaagaaaaataaggcaagataagggaatggacagttagacccttggttgaggacaagggaaccagtcagccattcacagctctgggacagagaattccagggtgagggactcacaaatacaaaggcgggatgtaaggatgcctcttcagaaacttagagaaggactggtgtagctggaggaggatgggggagcaaggcagagtggcacaaaatgatgttggcgaagcaggtggggctctctcggccaggtgacaagtttgggtggattgcgggtgcaacgggaggccaagagtaggcttctggtaggagagcgagggcacctagtttacctttaagaggatcgtcggccgagcacggtggctcacacctgtaatcccagcactttgggaagctgaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgcaggcctataagaagtttgatgccacatgttcggtcacagtgtttgctctaggcaaatgcttctggctctatatcctgagacgttagcagtagcacaccccaaagctgatcattacctaggagacttggatatgccttatctcttgccctactctgagccttttgcagctccccccgattacccttaaggtaaagtccagtagtaacatggctccaacctcttcatcttttgtcagatttcagagaaggctgtgagccctcaaaggctaagtaacagtgtcctctggtaggttctgtttctcgtgctttgatatggttttatttcattgccctttgtgtatatcttgtttccacactgacaccttagactgtgttagggagaccccagtttttattttgttcatagcccctagattgtctagcaaagtgctggataggtattggataactatcacactgagagaaggtgtgtgtgcctatatgttactgataatttatgtatagggaaattttgacaagcaggtaaaaagccaagcaaactttttttcactgtggtcctgaaatgtgtaaaatttttttttttttttttttttttttgcttataaatgtgaagtccagttctatacacattaaacatcatgagaattgcttgaacctaggaggcagaggttgcagtgagctgagattgcgtcattgcactccagcctagggaacaagagcgagactttgtctcaaaaaaaaaaaaaaaaaaagttctttgaggtcttcaatgattttgagagtataaagcattcttgagagcaaaaggtttgagaactgctgttcaaatgaaataaatgtttattgtaattgttcagtagatagcagttatagatatttatatgtatatcacaactcctagttgcaatacagatagatattggccagtccaaagtttttcatttattaaactgtttctggtgctggctttacaacttgagtcagaatcaaattgtcctataatgcaggaacaaaagaaagctgacctttccctctgtgggtctcaattcctgttccaaatcctagcctaaaataaattgacctgacttatttctttggttcagttgtatgtgtgggctttgcacacttgtttttaagtaatcgaatatctaatccaatagaaatgtatgttggaagtataggattaattactaatatattttgccctacttcacaagtaaaaattaaatatcagaaaattataacttgaattcactgttttgaaactaatagcaacaagcttgtgatatttgaatgttaggatttcctaatcagatctgattgttaggtgaaaaggtaacctttcagccatagagaagttctttgcttaagtttgcaagaggaatagtcctactataaatagtccagctgacatttaaatacctgacataagaaactaacacatttttttgtcttgccaaaaagagcaactcaaaatagaggtcacttgtgtaatacagcttccattcagtaatgaagggcttaactgtagaagctgttatactttgccatttatttgacagtcttaacacttttttttttttggagatggagtcttgctctgtcactcaggctggagtgcagtggtgcaacctcagctcactgcaacctctgcctccagggttcaagcaatttttctgcctcagcctcccgagtagctgggactacaggtgcacaccaccacgcccggctaattttgtatttttagtagagacggagtttcatcatactagccaggctgatcttgaactcttgacctcatgatccacccacctcggcctcccaaagtgctggaattacaggtgtgagccaccgcgccccgtctttttttttttttttttttaaatagagacaggttcttgctctgttgcccaggctggaatgcagtggcgtgatcatagctcactacagacttgaccttccaggctcaagcagtcctcctgtctcagcctcctaagcagctgggactacaggtgtgcaccaccacacccagctaatttatttattattttttgtttatttttggtttttgagacagggtctcactctgtcgcccaggctggagtgcagtggtgcagtctcgcctcactgcaacctccgccttcctggctcaagtgaccctcccctctcagcctcctgagtaactaggactacaggtgggcaccaccatgcccagctaattcttgtatttttttgtagacatgagatttctccatgttgcccaggctgatctcgaactcctggcctcagacgattgtcttggcctctcaaagtgctgggattacaggtgtgagctgccatacccagctgaccaagttttagtaacattaaaatcattgtccattaaaagttagtcacttaaggaatgccgttaagtgagattcctactcagagaagaacccttgatccttattgagatgaagtgctggacaaccaaagccctaaagaagctgagggagcttggcttatggattcctaggggaaggagccttctggacagcaggaatgacagtcgcacaggccctgggtaggtccttgcgtgggggtgcagttgaaatggttcctaattggttttttgttatgcaaataacatgggattgttgtaaaaaaatcaggaaatagagaaagtagggggaatcatccataattcttttacccagagataacagctgttaacatcttgttctgtatccttaccaactctataaagctccttaagatgtcacttatcatctatatgagtttgctagtgctgtcataacaaaataccatagactgggtggggcttaaacaacaaatttctcacagctctagagaccagaagcccaagatcaaggtgtcagcaggttttgtcacattctgaggtactgggagttaggacttaagtatataaatttgaggggaacacagttcagcccagcccatagcacgatctgtgaacaagtacctcagtcatcagccttcctatcaatatgattcttttgatgttcatttttattagtgcaggcttgtaaattaaccagtagtaatgtagtgacttttcccccgctagcctaattaggattattaaagatttagattgaaccctttctgaacaatagttgtgttgtctggctttttgcctataatgtcaccactatctttcagttttatgtttgctacaggagacttaatccagtatagctgaataatccagttggctgctgtgcagatgaaaatgccagtgttttccaaacaagcagttcaagtatgcttgcaggttttgctgtttcctttcaaataccatatgtagtactatttaatatttttcttgtaatcaactgactcttttgcttacatttattttaaaggaaacttttaccattattataaatgggaagttagtatattacttaccctaaataagttattcttaaacataaatacgtgactgtaaaacgaagtgttcaatcacataccaccgaaagtcctctaacataccactaccaactctgtccttcagttgcttggaccaaaaacctgggagctgtagttgactcttgtctctcacacctcacaggcaacctgatagcaaatctccacagctcagacctctgaaatgcctagaattacgccactcctcactactttcctgctatcaccctggtccaaacgggtattatcttttgctaggattattgcagtagcctcctagctgcttctgcccttgctcccttcactctcatcctcacacagcagtctgagggatcctattaaaaacaagacagatcatgtcactcagtaacagttggcatccttaatctcctcttgctctctcatcttcctcacttggtttgagctaaattggcctccttgctgtcctttgacaccctaagcagcctctattttagggcctttgcacttgtttgctctgtctcaaagactttctcctcagctatccataaatcatgccctctcaccttctttaggtctttagttatgacacctgattgcaataacacttttcctttatccctccatttaaaagtatagcccctcccgtattactccctcctccggaacaccaggatctgtcatactgtataatttacatattcatttttgtccattatatgtcttctactagaatgtaagctgcaggcatttttgttttattcactgcttgttcttcagtgcttagaaaagtccccgatgtatactaagtactcaaatatttattccaattgaattaatggcgtgtgtcctacactttgggaaatacatatactggcaacacctcccacaatctggggtccctccagtgagcctctcttcacagtcacatggttagtcctgtttgtctctgagagtctggccaattgagagctcagcattcaaggcagagaacttgaaacttgactggatcctgagttttttccagagaaaatagtgcatatgccagggaaaatggaggaaggagagacagtcaggattggttgggagtgcaaccctaggagagatgatttgttccccaagcacagaaggaaagtccatctctctctcctcccatagccccctcccttgtctggccccagtacctaggttctgttctggaagacacctagaaatggctcaagcctcagcctgaacccggtactgtggcttgaacctgtgaggtgttttcatgcgttgctttcaagagctacttgccaggctttgggatttttggaaaacaattgagaaccagctattcccttttagcttttttgtaagttaaaagagaaactatcacttaaataattgaaaaacaatagaatattttatccttggtgccttcagttgactcttagttgattaagaggataccatttttatttcccatatccatggtgactattcctcctaaaggttgtttgagagtcatgccaacaaataagcgtagtcttagcctcttgtcttccaaggtacttttgttagcacctgatattgatggttttcatctcatactagttgaccccaattcatagacatttagacatgtaagccccttaggaggtttgtccaaggggtaggggtggggtatctttctaagtttggttatctagccctagtcacttcacctgtcagagaaccatgtgccccttccctctggttgtgctggttgatactgatagctttataagtagcaagtttgaggtgtgataactttccgtgatttttttgcatgttagcatcttgattcccagggagagataatgagcagctagctctaggcttacaagttcccctggagttgctggtatcttgaatttctttccatttattttaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagagtaagcgtcgagctacggctataaatgtcaatgtcttaaattcactgtgcctccttttaaaaaatattagccttatcacggaaaaaaagctcaccaatggtatattttctgaaatgtggctattcttttttgaccagtttcagtttatatatttgaacctcctctgatgctgtttaacccctctaaatggtaagcaaaaacctgtttagactcatagtgtgaatttatatgacaatgtagacagtgaggtgtgaagtcattgcaccatcagatgtcgttcagaacaatctctgggctaaccaaataactaggccctaggtatagccagcattcctgaagccagtctccaaattaactctggaaagccttcccagttgtggtttttcttcactgtctcccaggtctgccgtgcacctgtatcctagttccttgggccattcagcaaaggtccctggcaagcctgtcagctcctggtctattccaggcactactagacccagaggcctttgcaaagaagacgaagacaatgaggatggggaaaagtggcctctttcagaccttcctgatttgtgagagttcccagtcttcataatgccagccaaccgttttttgaggacacatagtaaaccctcaagaaatgtctcttaactctcacaagaccccattgttaggtgcaattgcattccatttcacagatgaggagacagactcagaggagtcagatctcttgcccaaagtcacatagctggtaacccccaaaccagatctgactccagagcctgtgctcttaaccactgtgctgtggtgtctcccttttgtttacattttgagttttcatctgttaccattatagaagatactaatcaagtagtaacttgatgtaggagtcaagaaattgatttccatactgtgacacacacttcagacaagcagtaagggcctctgcctgaatgtagcaagacctgtcctgtgtctgcttgtgtttaaggatgatgacaacattcattcttttgattgtgtgcaggactctgcactagcactgtgagagcagaaagacatgtagggcgtggcccgggctggaacagggacaagtgacatgttcgttaagtgttaggacactaatgctcatttcagatggtcatcaacactcatggtgaatgattggctttgccatttaatgttgcttcttaagtcattttgtgaccctatagttttgtggagttttaaaaatatatacatttgatctgtttttactcatttctttatcctttttttcctgtgaaaaccagaattttctgcgtctgctaaataccggggaaaacccaatctagaaatcctgtttctccatggagataattttctttgctgtctctgaaggtccatcatatgctgacatcttcttcactgcatgtcttctcttcctaagaatgatttcggtttcttgaggatgagaactgtgcttccctccttacttcccagaatacctagaaatgactcagaatggggtactcagtagatttgttaatcaacttactgatttacaggttctaaaatactgagaattgaaccaatgtacaacattgcgatacactaaataccactgaattgtacactttcaaaaaaacacacaaaacaatgcatcagtaaattctgctgaaaatattctgtctgcctaaaacagcttgggctaccctgaatttcagtttatctctttccaaaagaggctttggaagttgtaatgcgtagctacggtatgccaggagtcctccatgtatttgtttttagtaacagctttattgggatagaattcacccttttaaatgtacagttcggtggtcttacattcagagttgtgcatccgtcactaatttcagaacgttttcatcacctcaaaaaggaacccatacccatcggtaggcaccccccattctccctcccacatcccccatttcccatctttgacaatcatcagtctactttctagctcaatgaatttgctttttctgaacatctattataaatggaattctacagtatgtggccttttgtgactggcttcctttactcagcataattttttcaaggttcaagcatattgtagcatctatcaatacttttattcttcttatggctgaataatattccattgtacagatacgccatattttgtttttccatttgttgatgaacatttgggttgtttctaccttttggctattataaataatgcttctaggaacatttatatacaggtttgtatgtggacatatattttctttttatttttttatctacacctgctggaatagatggacatagttgtttttagctacctaatttttcctcctttgaagatggacatatattatatataattatatattatataatgcattatatattatataatgcattatatattatataatgcatatgttatatatattatatatactgtatatttatataacatatatgatatgtaatatatattacatataattatatataagatatataattatataatatatttttatttaaataaaagcaaatcctccaagcctatatatattatatatataacatacataatatattttatatatattttattattattattattattattattatttttttttttttttttttgagttggagtctcgctctgtctcccaggctggagtgcagtggcgcaatctcggctcactgcaacctccacctcccggattcaagcaattctctgcctcagcctcccgagtagctgggattacaggtacccgccaccacgcccagctaattttgtatttttagtagagacggggtttcaccatcttagccaggctggtcttgaactcctgacctcatgatctacccacctcggcctcccaaagtgctggaattacaggtgtgagccatcgcgccctgccggagatacatttttgaattcccctgggtgtatacctaggagtggaattgctggatcatatggtaactgtgtttaacatttggaggaaatgccaaactgtttcccaaagtggctgcaccattttacattcctactagcaatgcccgaaagttcccatttctccacattctcaccaacacttgttattgtcttttcacccttgtagtttttattatcctggttccccaaggtcagaaactaagtcataaaaggaactatctgtgtgtagatgcttcctgtgaccaatctttcatgattagcacatgagctatttgctgtgtaactcgaatatccacataattattaaagcatctaaatagagcacttgagtaactcatctccctattaggtttttgttattgttttactcaaaagaacattttccatcaaaatttcaaaggtctataccatgtgatccaggaattcttctaggaatttactttccaatttctcttgaatgtattgcccaaaggcagtgtacaaaattatttcatgcagcattgtcagtagtagcaaaatattggaaacaacatcattgtctttgagtataccatattatgtcctgtttagctgttgaacaatgagacagatttatgtgtgctgaaatggaatgatctccatgatattgtgaaaaagtaaattataaaacaggagacagagtatgctgccagttggagtggggggccttgggtgcagaggaagagctcatgcatacactgcttctgtgtgcttagaatacctctggaggaatgggaaagaagctgctgacagtggttgtcttcttcagaagggagctggctggctagggctggagtggaaaggaaacttactttttaccatatacccttctgtactctttgaatgttttagtcatatgtgtgtgctgtttgaatagtgcccccaccttttttgtttgtttgtttatttaaagaaaagcaaatcctccaaacctaaaaacaaagcttctgagccaactgctccttgcacaattctggcaaatgtctagctgtccacagcgttagacatggaatatttctactttgaccacagaagtactaacaatagtcaagttatatagagcagagtttctcagacgtggcatgtagggctggttcttttctttgtcatgagagtgctaggtatgtgcgttgtaggctgtttagcagcatccctggcctctactcactagaagccagcagtacccccgtctccattgcagcaaccataaatgtgtctaggcaacgcttgatcctcccttccccttcccagcagaggggcaaaaatggccctcatcgaggagcactgttgagcctctggggttctccaaaatagtgttttttctgtttttttgagatggagtcttattctgttgcccagggtggagtgcagtggcgtgatttcagctcacggcagtctctgtctcccgggttcaagcgattctcctgcctcagcctccctagtcgctggggttataggcacataccaccacacccggctaatttttatatttttagtagagacaggtttttgccgtgttggccaggctggtctcagactcctgacctcaggtgatccgcccaccttggtctctcaaagtgctgggattacaggcatgagcccaccacacccggccaagtgttttatgtgtggattagagcctggatgtgtgtttataccctggagtactggtacccatgcttcagaggaactgaacataattacaggggtgtaggaagtaaaagaaaagtgatcctttctctgattcattatgctcaccatcgaatgaaacttaagttggtgtgtggtgtggttctacccacttttgctgtgggtatgcaaacgtaaatatatatctttttaagaaaaatgggatcttcctatgcataatgttttacaacttaattttttttcacctaatagatggtggacatctttctatatcagtgcatattgactgatctcttttttaaaagctttgaggcggggcgtggtaactcacgcctgtaattccagcactttgggaggccaaggcgggcagatcacctgaggtcaggagttcaagaccagcctggccaatatggcgaaacccggtcgctactaaaaaagtataaaaattagctgggcgcggtggcagatgcctgactcaggaggctgaggcaggagaatcacttgaacctgggaggtagaggttgcagtaagccgagatcgcgccactgcttgcaacaagagcgagactccatctcaaaaaaaaaaaaaaaaaagccttaagttatatgactgattaatgaatatgaatatattcttgtaaaaatttttaatgacaaaagcccaggtgtggtgattcacgcctgtaatcccagcgctttgggaggccgaggcaggtgaatcacttgaggtcaggagtcgagaccagcctggccaacatgttgaaaccccatctctactaaaaatacaaaaattagctgggcgtagtgatgcacgcctgtagtcccagctactcaagaggctgaggagggagaatcgcttgaacccaggaggcagaggtttcagtgggccaagatcataccactggactccaacctgggtgacagagtgagactcttgtctcaaaaaaaattttttttccaacaatacagagtatatagaataagaggttaacttagtcccgctttaactctgtgtcagtcaggaaaagagaaatcataccagctaatttttttcccagctttattgagatgtaattgataaataaaagctgtatatatccaaggtatacagtgtgatgatttgatatacattgtgtaatgattaccacaaccaaattaatcaacgcatccatcaccacgtgtagctaccttgtgtgtctgtggtaaggacacttaagatctactcttttaccaaatttcaagtaaacaatccagtattattaactgtagtcaccatgctttacattagattcccagaacttactcataactgaaagtttgtgccctttgaccagtatctccccttacaccctggtccctgtcaaccactgttctgttctctgcttctgtgagttctacttttagattccatgtataattgagatcatacactttttgtctttctgtgtctggctgatttcacttagcataatgtccttcaggctcatctatgttgtcatgactagcaagatttctttttttttttttttttgagacagagtctcgcactgttgcccaggctggagtgcagtggcgccatctcggctcactgcagcccccgcctcccaggttcaagcaattctccgactggcaggatttcttatttatggctgaataatatttcattgtgtgatatatgccatattttctctaggacatttaagttgtttccatatattggctattgtgaataactgcaatgagtgtggaagtgcagatgatctctttgagatactgatttaatttcctttggattgatacccaatactaggcaacagagataatttaatataggaagttgatcaaatagatgttggactaaaaaatcaaagaaggcacaatatgagaacacagagatactgctgcagaaacagtaaccaccctctgggtttgggaggccagcagaggaagcttgggctgtcagaacctggcacttggggaaaaggtgccccctctgctgctgctggcacctgcggggcaggggcaagcctggttgggggagtgcaaaagacactgaagcccagaaccagctcttgctgccgaggtaaggggctcatactggggtgatacctaaaggaacagcaagcaaatgtgaagggtcaaatgcctcctactttttattttctattaggatcatgtggttaatttgaccattcagtccttaagaatatttgagtgccacccaaatattctacaacctaactagagaagtgaaaacttactattgcctagagatgggccccgtgctcactcagaaagataccatgaatggtgggaagagggagagtctctgtacaaaggataattgtgtctcgtcgctgtgcagagaggtgcctgctgctgctggctaggaaactccaagcccacttctctccactctgctttggatgctggggctgggactctgcacactacacttttcctttgtcagctggcttcctctgaaggttccaccagtcagggacacaagagagagcctgaaaggcatggggaagggaaaagggatttgctgtatccagtttgcctgtttgttctgtctgtaccaccctggtaacagcccttcatcctggcatcagcagtgtgtttcaacctccagctttctggggacattcacaaaaccagcctcatcacatcccgccaagccccctccttggaggttctagcagcagccaggcagcaccccttcctcagagttctgagttcaactcttcagacctcttccttagcctccaaccctggtaaactcaaccctggtaaactccagcttatccccccctcccttaagagtttccatcctgcttcatttcgttattacatctgtgttagcttagattccctttgaacattttcagtccactgacgcctgtttaagcaatgtcttatattaaattctgttataaaacctagtgtggagtcttttttcctgatttatccctaactgccatatccccactcttctccccaacagttactgtgatctgcattctaacatagcatgtacccacattgtacattaaacgtaatttgtatataactatgtaagattggaactgaatagcaggtgactggttgacctaatgtttcctttttgtatgtttagattttgtaattttccttgcatatttttgtaattaatacctttttccttttctcatatctcatacttttttttttttttttttgagatagggtctcattctgtcacccaggctgaagtgcagtgacacaatcacagctcactgtagccttgacctcctgggatcaagtaatcctcctgcctcagcctcccaagtagccaagaccacaggcgcaccaccacacctggctaatttttttttactttttgtagagacagggtctcactttgttgcccaggctggtcttgaactcctgggctcacgcagtcctcctgtcttggcctcccaaagtgctgagattacaggcgtgggccaccgtgcctagcctagctcatacatttttaaaacaaattttattttctaatacttacaggcttatagaaaagttgcaaaggtagtacttcctgtgctaccttttccctgttgctagcatcttatgttattatggtacatttgtcacaaccaataaaccaacgttgatacattattattagctaaagtccatactttattcaggtgttcttagtttttacttatatctgttttttgttccagaatcccatccaagataccacattacacttagtcatcatatctctggctcctcgtggcaatgacatttctcaggtttttcttgtttttgatgcccttggctgttttgaggagtactggtcaggtattttgtagactgtctctctattggaatttgtcttttttttttttttttttaatgattagactggggttatctcatatgtatgcatttggcccaggaaaaatttataatctccaggctctgggcctgtagtgcctaatggacaaagtagcctgtgtgcacacaaatatacccagaattggaagaaagtgtatgtctgcttttataggctatacatatcctacaatgtatcgtctatacctggtgccatgttttgccagtctttcgtatgtgtgtgtgtgcccaaggagtgtccctcggcctttgagaaggctacgaagtctccgggttatatgaatatgccatgttcatatagtcccttgcaaggagacatgtagattgtagttatttttgctattgcagacagtgcttcacattttgtgcacaagtttgcgtctctctgaaggaaattgctaggaaggggcctgctggtctgagcatgcccatttcacatgttgatgagcactgccaaacggctccacaaagcatgagccatatcaacaaagtggaaagtgtttgtttcatgatcaaataatgaatcttaagagcagtatttctcacagacgcagaatgttccagcaattctccttcaggcacatttcctttgctgaaacctttttagcaggtccctggagcactcatgaacaaaataaaaaaaccagaaaccctgtaaccctggttcctattaaagtctagcttggggcttttttttttttttttgacaaagtgtcgcaatgtcacccaggctggagtggagtggtgcagtctcggctcactgcaacttccacctcccaggtttaagcagttcacctgtctcagccccccggttagctgggactacaggcacctgccaatatgcctggctaatttttgtatttttagtagagacagggtttcatcatgttggccagatgggtctcgaactcctgacctcaggttatccacccacctcggcccccccagatgccgagattacaggcgtcatccaccgcacccagccttagcttggggttttttgttttttgttttttgtttttgagatggagtctcgcactgtcgcccaggctggagtgcagtggcgcaatctcggctcactgcaagctccacctcccgggttcgtgccattctcctgcctcagcctcacaagtagctgggactataggcgcccaccaccacacccggctaatgttttgtatttttagtagagacagggtttcaccgtgttagccaggatggtctcgatctactgaccttgtgatccgcctgtctcggcttcccgaagtgctgggattacaggcgtgagccagctcacccggccttaggttggggcttttaaatgacccttcaggtgtgtgtctgtgatgacttgaggcttttttttttactgtcttccagtgaaattaccagatgaatatcagtggtgagaaatttgattccttaaaatgtaaggaatttcattcttgaattgtgtgacaaaaccagggagcatgatttttgctccattcaggatctattcagtcaacactgagtatatagttgttgatggagactatgataggttctgaggatggatctgttatattctccataaatctgtatgtgagtcatgcctttgtttgcttcctacttgttctgtttactgggttttttttttctttgaggaaacaccttaattgcaatgaggtgtttattttataatataaaagtgtgaagagaaacattcaacaaacatttgagtaccaattcagttgagggcccctgtcaaggcccccaccctcctttttctgtgtttagtgagggtgtctgatgcataactgagcctcagttgggaggggctgaggggatcgggaacacttccaaggggaagcagctggggtgagagccccaaggtggagagaacttggcaaggttgaagaggaatggtgggcaggggagggagaagagtaaaagaagaggcagttagggctgcccgggtcagtctgggaactttggcttcctcttcaggtcactaggagccatcagagggttaagccagcagagacagcttcctgtttttaagacgttggtctggctgctgtgccgggagcaagagagaaagagacttgggggagttcagaagaggtgacggtggtggaggaaagtggatggatatggggtctctttcagaggtagaacagtggggtctctttcagaggtagaacagtgggaccttctgaccactggcaggtagagggtaagggagaggggaattgggttgcctgctagtttttgctttagctaactgggtagatgctgatgtcattcactgaggaggaagagggcaggttgagggtaggtagaaattcacagttttggtttggttgtagtttgggatccctgtggacaagaaaagtttccatgggtatattatgaatgccttctgaatcaagggtttaaatcacatcctctgatttattctccccaaagaccactagatgccgctgtttacacgggagcaattatgcagtacaagactcctttcctgaggagagggcacggatgccggagagggtactgatgccggagaaggcactgatgcctgacaggggaacccacagagaggggagcccctgcctttgagggggttactctttactgggagacatcacccttcagtgtggtcttcagacacatgtgatagcagtgtgacttcatatgggatagaaagctagggactaggtagtgtttgagctgggtcttcagggttgcaaggcatttcaggtgggggcaggacgctccaagcagaaggaacagccgggcaacagagcgcatctccctgcttatggggtagatggtacagtgaagaggttattggcatagggggttggacttttcagtgtttctcaacaaaggcacagttagccttttaaagaaggacggtttttggctgggtacggtggctcatgcctgtaatcccagcactttgggaggccgaagagggcagatcagctgaggtcaggagttcgagaccagcctgaccaacatggagaaaccctgtctctactaaaaatacaaaattacccggccatggtggcacatgcctgtaatcccagctactcaggagacaggagagtcacttgaacccgggaggcggaggttgcggtgagccgagatcgcaccattgcactccagcctgggcaacaagagcaaaactctgtctcaaaaaaaaagactgcttttccctgtgctgcctcacccattgaatgccagtaatctctcaggtcagactaccaaaaaaaaaaaaaaagactgcagggagggatggaacaccccagttgaaatcccttacccagtgcctaaccccggagtgatggagaagggggaagcagctctgagtctgcacccctccctcgtcttgtcttaattttgaggttctctaaagcagtgacctgttctgtgctttaataccacatagtgttatttaactgattggctgatgatcctggtgagtggacatttaactcggcttcctagaatagagaatgcctcttaccattccccagagaaggactgcaaagtagagaaattaacataaaaacaggtccctctgattagacttaatactaaaaacttcactggtactagcttaaatgctccatcttctttgtattcccccaaggcccggaagtcatataaactagtgtaggaactagtatagaactgctgacctaccacagaacaagtagactccatgctggaagcagatgtaccagttctacagtcagggataaatggggtttcacaagctctacctttttgaatgctttgtttgtaattgcgtgacatctccgtactctttttttccagacaatttatgaaaaccgaatatacagccttaaaatagaatgtggacctaaatacccagaagcacccccctttgtaagatttgtaacaaaaattaatatgaatggagtaaatagttctaatggagtggtaagttgttttctctgtcccacttgttccttggagttgacagttgctttgtacttaacatcaggagcttttagactgggcccaattcctaggttctttggttatttgttgataaactgtatcactgtgcataggagcacagatttgggatggggcctgtttcccaattatatctggcgatcactcatatagcacttaccctgggctagttctgtgctggtcgctttgaaatatgagctctttcctcatgccaccccagtgaggtagagatgaggaaactgaggcacagacgtggaagatctttcccagggctacacctttacccccctgggccttatttgtgaaccactggcatgtaatatttttttcctttaatggccttgcttttttatttttactaccataaatgaaaaacctgtctcagttgtcataactgggcaataatggcaacagtaaatattacaaaaacagagcaatgttaataaatcttgactccatgtgtcatttgccaaaagctttgagcctttgaggcctgctctcctgttcaaagaggagatcagcaagtgttgaagggatgctacacatgttaacgtcacgccaagccttcgtctttgagatactcagaagactggaaaattgaaaagagatgagctttgttacagtgtgtttagtgtttaatcctgaatctgagttccacctaaagtcctgagcccagagctcaacctgtgctttggggaatttattttgggaaatgctgccttaacctgagaggtgctggctctgtggcaggcccttgtcactggagcaggtgtcctggccaccctttgccttggctgtccgtactgccctgcatgcacatctgtccccctgacctgggcgcagtgaagaggacaggtcctgagcccggcagccgccagcccagcagcggccattattgaagagccaagtagggctgggttgagtctcacccaagtgtcagtaccaccgtttccttatcccagatagtaatggttcagggcacaaaagggaaaggcaggctgactggagggagggactctagcaggtaggtattccgcatgtaaggtattaggattagcagcaggttcagcttaaaaagtacatcttactccagtttgcaccttagcttaaccccggcatatagctattttgtttgagagtctgagagtaatttgcttttgtttgccttgttgtaggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggtttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaacaggctgtacttttcttcctcttggcatattagggacagaatttaatgttttagatgctttgggattcaaattgacatcctaaagcaggggtcggcaaactttctaaaagggcctaaattagtaaatatatagactttgcaggccaagaggcaaaatctaaggacattgtgtaagtacttatattctgagagaaaacagatttcccaaatttttaattggtgaaattcaaagtggaattcagtttatttataatgctactggcccactaacgtgaggactggagttcttttaggagataacatgttgtttaactgggactcattagtgttccctgtcatcaagcctcttgcaaatgttcatctgtaaaaataattcttcatgctaaaagccatacagaatcagtcagtgggctagatttggcccatggatcatagtttgccaacccctgtcctaaagatggtaggtttttgttttgttttgttttgagacagagttttgctcttgttgcccaggctggagtgcaatggcgcgatctcagctcactgcaacctccacttcccagattcaagcaattctgctttagcctcccgaatagctgggattacaggcacccgccaccacacccagctaattttttgtagttttggtagagatgggggtttcactatggtgcccaggctggtcttgaactcctgacctcaggtgatccacccaccttggcttcccaaagtgctggaattacaggcgtgagccaccgtgcccagcccaagatggtagtttaaaaaagcgttcttcctttgatttaagtagcctcacaggtcttgagctattaagcctccactagaagccatttattggctggacttagtagtctattcagagaaaaaaaaaaatcatcggattgtcacatgtatttctgatgtttaaaaaaaatttttttttgatctgatgattaactatttgtctaccatctactgcatatgcagtgggaacgtgtctagtttttacccagagtttgaacttcctgctgtagtcccaactacatacaggtacgatcttggtgccctgtggcaggagcaggctattccctctggctgttggggccagctcaggtgtgagaagagctggctgtaaggaaagggccaggttcttcccaacaggccaccctccagaaagccctgcccagatttctttggatggtctttggagtcctctgcagggactggtgcccttcagttctgaaagtacatacattgggccagggaaagctgtgggttcttcatcctcagtcagccctcccaagggaggagaggagaggttccaaaattatttcaggccagatatggtggcccactcctgtaatcctaacactgggaggccaaggcaggaggatcacttgagcccaggagtttgagaccagcctgagcaacatagtgagacccctgtcgctataaaaagttaaaaaattagccagtgtagccgggcgcggtggcttatgcctgtaatcacagcatgttgggaggccgaggcgggcagatcacgaggtcaggagatcgagaccatcttggctaacacggtgaaaccctgtctctactaacaatataaaagattagccgggtgtggtggcaggtgctgaggcaggagaatggcatgaacccgggaggcagagtttgcagtgagccgagattgcgccactgcactccagcctgggcgacagagcgagactgtctcaaaaaaaaaaaaaaaaaggttagtagtgcacgcctgtagtccctgctagtcaggaggctgaggtgggaggatcacttgaatctgagaggtcgaggctgcagtgagccatgatggtgccactgcatccagcctgggcgacagacggaaaccctgtctctaaaaaataaaatggccgggcgcggtggctcacacccgtaatcccagcactttgggaggctgaggcgggtggatcacgaggtcaggagatcgagaccatcctggctaacacagtgaaaccccatctctactaaa

SEQ ID NO: 16119 - DNA, 52496 bp, Human; identical to SEQ ID NO: 16118

SEQ ID NO: 16120 - DNA, 15069 bp, Human
tagctagtgttttcaaagttcatctgtgttgtagcatatatcagtatttcattccttttatggataaataatattccattgtgaactacagtatttttttttttttttttgagacggagtttcaatcttgttgctgaggctggagtgcactggttcaatttcggctcactgcaacctctgcctcccaggttaaagtgattctcctgcctcagcctcccaagtggctgagattacaggtatgcaccaccatgcccagctaattttgcaatttttagtagagaaagggtttcaccatgttggtcaggctggtcttgaactccttacctcaggtgatccactcacctcagcttcccaaagtgctgggattacagatgtgagccactgcgcccggcctacagtacgattttgagctccaaaatgattgtctccttcgcaatcatctgctaaacacagacataattaaaaccaattaaacaaacacaaggaaggtgtgaggtgaaatagtcgaaacgtgtgtccccacacatccaaggcagtcctttccacatctggggactggtacccagggtggcgcctagtggtacctgagatgattttagaaaatatactgggctgggtgtggtggctcacgcctgtaatcccagcactttgggaggccaaggtgggaggatcacctgatgtcaggagttcaagaccagcctagccaatatggtgaaaccccatctctactaaaaatactaaaaaaattagccgggtttagtggtgcacgcctgtaatcccagctactcgagaggctgagccagaagaatcgctcgaaccaaggaggtagaggttgcagtgagccgagattgtgccactgcactctagcctggacgacagagtgagactctgtctcaaaaaagaaaaggaaaaaaaaaaaagaaagccaatttaaagaaaatagtaagtgatatttggtgataagaagacttgagaaacgaagttgctaattgaatgactagtgattggaaaataccaactcagaccgggtgcagtggctcatgcctatcatcccagcactttgggaggccgaggtgggcggatcacttgaggtcaggagtttgagaccagcctggccaacatggtgaaaccccatctctacttaaaatacaaaaacttaactgggcatggtggcaggcggctgtaatcccagctgctcaggaatcccaattactcatgaagctcaggcaggagaatcgcttgaacccgggaggcagaggttgcagtgagccaagatcatgccactgcactccagcctgggcgacagagcaagacccagtctcaaaaaaaaaaaaaaagaaaagaaaagaaaagagaaaagaaaataccagctccaagactgcaatttgtcacacttactgtaaggccacggtgtgatttttatctatgtttgatgtggttgcttcaagtactatgctcaccactgaacacttggcttcattaatagacaaaaaccaaattttaaatttgtcccagttttcccaattttgggaagagaggccaaatgttagaccacacacaattccagcggatttcaggccaacaaagccttgatgtgtctagcccacttagcttattaacggactaaaactgcatttgtaattaattccatttcatacagaagccggaagtctctacctgaggctgaaataagaaagggatcctgtcacagaaatactagacacagtaatccacacaaggttaacaaaacagtgggaaatatggaaacaaatacctaatgccccgcctggattcgttcttttaaggttggggcgacagtaggaaaaccacgtgtcacttgcccaagcattcagccttaaagggaatttctccctcagggtctccaggaggcggggaggcggtggctcctccggccccgcccccccaccagcagagggcccgctcaccaccccgtaggccccgcccctgcgtctctgcccgccccgtggcgcccgagtgcactgaagatggcggctgctgtaggacggttgctccgagcgtcggtgagtggctgtcggctggggacaggcgtggagacactggtggctccgggaacgtgcttctcagacaggaccccgcgcttctgggcatgagggccattcgcccttcttggagggtttccgcgggtaacggacccagaggcctccctccgggaaggttccatgcgcctgcgcagaaccgcccttccccactccatcctcgcggtctcttccccgagtccctcctctttcggcgtccccggtccccaggcccatctccacttaaggtcctggccctgattctgccaccgaccctgtgatcttgggcaagcgccttcgcctttctcagactgtgtacttaagatggaaagaatgatgcctacatcaaggcgttgctgtgaacagccccttaaatactggataaaaacgcgcaaagtgctaaaaaactcacaaaggctttccctcccaatcccactcccgcgtgtttctgctgctgtttcctgcttaactgtgggcaatgcgtcgtgctcttttggtacacggctttctctggtggggttcaacacagcccctttcgttctcctgagtcattttgaacattaaagttgagcaaaccggcagagtgcggtggctcacgcctgtaatcctagcactttgggaggccgaggcgggcagatcacttgagcccaggagtttgagaccagcctggacaataatagtgagaccttgtctctaaaaaaaaaaatagccgggcatggtggtcagtgctcctggggaggctaaggtgggaggatcacttgagcccaggaggtcgagactgcagcgagccgagatcgcgccactgcactctagcctgggtaaaagagcgagactctgtttcaaaaaaaaaaaaaaaaagttgagtaaacatgtcccttgagcctttaacagactcccagaggctgaatttggctcttcttgtttacttgtcgctggtgctggaggggccttgtttttctaaggaaaaccttgaaatggtagaacatactcagcagatagtgctgggaaaagcctgcacaagtcccctggcttctgaaccctgtgttgctttaagcgcatggagtttctgattttttttttttttttttttgagacggagttgtcgcccaggttagagtgcaatggcgcgatctcggctctgcaacctctgcctcccgggttcaagcaattctcctgcctcagcctcccaagcagctggaattacaggtgcccgccaccgccgcctggctaagttttgtgtttttagtagagatggagtttcaccatcttggccaggctggtctcgaactcctgacctggtgatcaacccgtcttggcctcccaaagtgctgggattacaggtgtgagcaaccgcgcccagccggtctttgtgttcttatagttcctctccaccttccagtctcctaggagaaggaagcagaagggagtgttaagaacatgcagatccaatccatgctcttagagtttggggtttgctatttggttcacaggaacagggacagctgaaaccaccgttggcacgatgccctttcagccttcagtcaccagtccaggaaaactttctaataaaaagtttctctttccaggttgcccgacatgtgagtgccattccttggggcatttctgccactgcagccctcaggcctgctgcatgtggaagaacgagcttgacaaatttattgtgttctggttccagtcaagcaaaattattcagcaccagtaagtgttatgtcatgtcttggctggagccaggtaaaggaaaaatgaaccatcgtctctggacaggggctctgaaccctggccaaacgttagagtcacctgggagctttcaggaacacagcactgcccccgtcccaccccagacaagttagtctgtggggtgagaccaggatgtgccgggtgattctaacgtgcagccagggttgagaatcactgaggcaaactgcccttgtcacatttccatgttggttgtcagagtttctaatccactgtgttgaggagggtgttactgggagctcagatgccttctgagtctagtgtgtctgaagagctgtgagtggtgggcagcctgtgggggacctgagagggcagctgctctaagattcaaacctgtgtaatggccccagctggccacttaggaaccagacctgcctaatggtatctgtaatctgagtgaaatttagctgtttcttgagatttacactcccttctctaggatatgggctttgctaagatcagcctcagataatgagtggtatttgaaaataccttgtctagatttgactagcctttgaaaaagcccgtatttaatatgtaatggtttgtggggatatactttagtaaagcctttgtttgtgggcaaaatgttctaagagctttcgcaattttactaccctggagcttcaaaatatttctagtagtgatgtgataccacaggcttaaaactttactccactggtttcgaatcctcatccccagcagcgcctcctgtttctgttcatggcggtgtcaggcattttgacattggaactactctgtcgctcattcctgggtagaagcaagtccttttcagttttgacacatctcttgcatccattcctttctgttctttctgccccatacctcccctcaatacgtctaagatcactgaaatcgaggctgggcacagtggctcacacctgtaatcccagcactttgagaggccaaggcaggcgaattacttgaggtcaggagttcaagaccatcctggccaacctggtgaaatcccgtctctactaaaaatacttaaaaaaaataagccgggtgtggtggtgtgctactggaatcccagctacttgggaggctgaggcaggagaattgcttgaacctgggaggcggaggttgcagtgagccgagaccatgccactacactccagcctaggtgacagagcgaaactctgtctcaaaaaaaaaaaaaatcactgaaaccacctcctaacatgtctcccccttcctcctgctcctctttccctcctgccggactaatcttcctaaaaacccccatctcagccaggcactgtggctcacgcctgtaatcccagcactttgggaggccgaggctggcagatcacgaggtcaggagatcgagaccatcctggctaacacggtgaaaccccatctctactaaaaatacaaaaaattagccgggcggggtggcgggcgcctgtggtcccagctactcgggaggctgaggccggagaatggcgtgaacccaggaggcagagcttgcagtgagctgagatcgtgccactgcactccagcctgggcgaacagagcgagactccgcccttgactctgttatctttcctgctaagaagacccagcagcctagtatttaaggactgttgcaacatggccttcaaccattcctgcctgctgcctgctcttcactccgtacccttagacactctctgttctcattagactgccacacgctgctccacacacatgtcctgtcttccttcctgctgtttcctacatgccatctgccccatcccatctagacttgacaaaatctgaaccatatttaaaatccatctctagtctcatgtcttccttaattctatccctactttgtcttcctctttttagtttctgtagcacttggaattgaatttgtgcacaatctaaaactatagaaggagaaattacagttggccctctgtatctggattctgcatctgtggttggttgaatcgaaaatattgggagggaaaaatggatggttgtgtctatactgaacacaaagtcttttttcttgtcattccctaaacaatacagcttaacgactatttacgtagcatttacgtcgtattaggtattatgagtaatctagagatgatttaagtatactggagggtgtgtgtggattatatgcaaatcaccactttatgtaagagacttgagcatctgtagatttcgatatcctagaaccaatccccccacaggtggcaaaggatgactgtgcctaagatgtacagttgaaccgaatgttttgatttatactaagcactttatactactaattaattatgagaagtttaaataaaatcataggtgcttgacatagcaaatgatgaactccatatgagtgtgggttttttttcaggttcctcatgccatgcacctgctgtcacccagcatgcaccctattttaagggtacagccgttgtcaatggagagttcaaagacctaagccttgatgactttaaggggaaatatttggtgcttttcttctatcctttggatttgtaagtgtaatttctatgatgctttcgtgtcattctgagagcaagcacatatcctgttcccgcactgaattgtctatccctagatacccttgtgaaaggaaggattctttctgaccctttatcactgatggccttgttgattacagctgggatctgtagcttgtttacaagtgataaacttcgggggtgggataggacagctttctttatagtacacctctgtgctctggagcactgcttccctaagccagtctatgaaaaagttttcactggtctggggaaaaatgagaaaagtaggcataataaaatgatttttttcaaaaagcaactttattgaactgtaatttttttttcttaaaatatgtgttccctttccccattttttgatacaattcctaaaaataaaaaggtgaggggaggtagtagtacttttgccagcacaacactatagtccagtgaggatggtaaaccattttgccttttttacccttagcaagttgaactagttgttagaccactaattgttaaaatccttgtttttaaatgctctaatgagaatttctatcctttttttccagcacctttgtgtgtcctacagaaattgttgcttttagtgacaaagctaacgaatttcacgacgtgaactgtgaagttgtcgcagtctcagtggattcccactttagccatcttgcctggataaatacaccaagaaaggtatggcattgtacccctagcttttgctcttataaacttgcttggaagaatctaaatttctagctatgctgctggactatcaagatcaaattacgcaagggttgggttttttttgttttttttttttgagacggagcttcactcttgttgcccaggctggagtgcaatggcacaatctcagctcactgcaacctccgccacctgggttcaagcgattctcctacctcagcttcccgagtagctgggattacaggcatgtgtcaccacccctggctaattttgtatttttagtagagacggggtgtctccatgttggtcacgctggtctcgaactcctgacctcaggtgatccgcccaccttggcctcccaaagtgccggaattacaggcatgagccaccacacctggcctactcaaggtattttttttattattactcttccatgtctatgtttgagaaaattagcctttaaaagaatgctttaagaattagaaaaagcagccgggcgtgatggctcacgcctgtaatcccagcactttgagaggccgagacaggtggatcacaaagtcaggagatcgagaccatcctggctaacacggtgaaaccccatctctactaaaaataaaaaaaattagccaagtgtggtggtgggcgcctgtagtcccagctactcgggaggctgaggcaggagaatcgcttgaacccaggaggcggtggttgccatgagccaagatcgcaccactgcactccagcctgggcgacagagcgagactccatctcaaaataaataaataaataaataaaataataaagaattagaaaaagcatctgtagtcccagctactcaggagactggggtaggatgattgcatgagcccaggagtttgaggctgctgtgagctgtgattgcatcactgcattccagcctggtgacagcgagactctgtgtcttaaaaaaaaaattggaaaaggtctatagtattagccgggtgtaaatcttccttctgctcctttctagctgtgacctggaacaagttacttaggtttttcttgcctcagtttcctcattttgatagtgtcttctccagggtggtttcgaggaggcagtaggttaatagagtaagcagtgcttggcccgttgttgaattactgttacctatcgccgttactgttggtctcaaacattgtggtacgtggtcaagaatgttgtgaggccacacattctaacagtcatgtttgcattttgattagaatggtggtttgggccacatgaacatcgcactcttgtcagacttaactaagcagatttcccgagactacggtgtgctgttagaaggttctggtcttgcactaaggtaagatcctgtttctgatgaacttaagattatttttcatgtttagtatcattctgcttcttaggggatttatgtagaccttggtaaagcatttttaaaaccagaagatcctggctgggcatggtggctcatgcctgtaatcgtagcactttgggaggccaaggcgggaagatcacttgagttcagaagttcaagaccagcctgggcaacatagtgagacctcatccctattatattaaaaagaattaaaatttataataatcaatccttaattttagtctttaataaacactgataaaatgcctcctgcaagggttggcggtctctcagaaatgctgagacatgcatgtcccctccaccaccttgggtctctttctgaagaaggctggctgcgtcttgaggccacactgctccatactccctaactatgtgggagccacttccatggggacacacacctgacattgaagccatcagactctgcagaaggggggactagcagggtaagaggtagtctcttggaatggtgaccatcttcagccctggaaccaaacaatccttggtttgagtttttcttttttttaactcagctacttaatagctgtgtgactttgggcaactgatttgatttaaccttgttgagccccagttttcccataactaaaatgaggtggtacgtcacaggtgggtgtgaggattaaatagtgacacagctagagtttttagcatagttactggcagcagttgttaggatttctgccccagaacatcatttctatctgtattcagtcccttattaaacctttattcctttgagtgtgaaaagctttcagtcctcagcagccccacattcaaacataaccttcctgggagggatgagaacttgggtcttagaattggcatcttgaagtctgctgagaataggagtgaaggagggatagggcagaacttgacctccaggaaggaagagaggggatccccctttgatgtgctgtgcctcacagttttgctgggggctggtcagcttaaagccagctcacctggccgggcgcggtggctcaggcctgtaatgccagcactttgggaggccgaggcaggtggatcacgaggtcaagagatcgagaccatcctggtcaacatggtgaaaccccgtctctactaaaaatacaaaaaattagctgggcgtggtggtgggcgcctgtagtcccagctactcgggaggctgaggcaggagaatggcgtgaacctgggaggtggagcttgcagtgagctgagatcgcaccactgcactccagcctgggcgacagagcaagactctgtctcaaaagcaaacaaacaaacaaacaaacaaagccagctcacctgcctgtcttgtaggtgacctctggcctgctctttcttgggttacaccttgggttttagcgctgagtggcatcttagagtttgggcctttttttcctctctttttttttttttcttttcttttcgagacggtgtcttgctttatcgcccaggctggagtgcagtggcgtgatctcggctcactgcaacctccacctcccgggttcaagcagttctcctgcctcagcctcccgagtagctgggattacaggcacacgccaccacgcccggccaatttttgtattcttagtagagatggggtttcatcgtgttggccaggctggtctcaaaactcttgacttcgtgatctgcctgcctcggcctctcaaaagtgctgggattacaggcatgagccaccgcacctggcagaccatttttttttttttaaactttaaagagattatcaaacgaatgcctaggtctttcagaattgtcaatggccagagaaagggtactggctatttttctcctacggtccctttccctatgagaactcactaattttgcagttacctctgtacccgttttaatattgagattaacaagagagagaagctgagtctggcttataagataaagacttttgggagtctatgggccctgctctgtcccagctctgcctcaccttctattggtggacttcagctggctgcaccctctgggaacagtttcacctcaaaccccaggctcccagtgcctgacccagggagggagaagcatcttttatcctgagttttctctaacctgccttttccatgagtgattgatacctgaaatttccacatccttttaagacagactgttaaaacctgtaggttaaataaccggacacagtgacacacacctatagtcacgctacttgggagtctgaggtgggaggatcagttgagccagaagttcgaggctgcagcctgctgtgatcacacctgagaagagcactgcactccagcgtgggcaatacagtgagaccctatatttaaaccaaacaaccaaaaaaacttctaggctaaacatatctgcatctgtcacagtaacaccaacacagaagataaacacagaccactgtggtagcgtggttcatctcattacatgctgctacatgattaaaagtgatgggcatggttttctgttttgcatagacttagagcctgtacattctttctatgaagatttttcccgtgggatttccccccatttacccaataattcattcataataaacagttgttgaacctagataaaatacacctctgtctcttcccatttgcctataagtttcttgccaagatgtgatacagcagctcaaagaatgcttgccaagtcactaatagtctttgctctctctagttcagtgactttccgatactgtgtaacattcagggcactatgtgaacttgtaagtgtgaccatactgcatgttttatggtgacctggtccagtactgcctttgttaaagcatctgtcatcagtaagagatgataagttttttgcacaacagtgaaaaccccacctttaagcatatgattacgcttaataaatattttattaaaaggagaattaaagacctaaaagggaagaagttagactgttctagttctggtactgttgaggcactgatgaggataaatgatcatgcagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacggtaggtttttttccccaaaagcagtgaggtccatgttctctcagcctcgagagctattgacctgaaatatccacaaaagggagcccactcttgaagcaagcgtgcagatgatatgcaaatgggtgaagctgctgtggggtagagggggtggggtggggagccaggaaccaattatcagagacaggcaggcctttttttttttttttgagacggagtcttgctctcgcccaggctggagtgcagtggcgctctctcagctcactgcaagctccgcctcctgggttcacgccattgtcctgcctcagcctcctgagtagctgggactacagggcgcccaccaccacggctaattttttgaattttagtagagacggggtttcaccgtgttagccaggatggtctggatctcctgacctcgtgatccacccgccttggcctcccaaagtgctgggattaccggcgtgagccaccgtgcccggcctagagacaggcaggccttaatgaaactttcatctttatgttttaaaggaaatctttaaaagtttaaagaactttaggttaaaaattgggagattgccactcacttttgggactattattatggtaaagtcacagttacctaattaagcttttgtattttcagatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagtaactgttggatcagcttattttgggctctcctttccttctcagattatcaacaaacatttattgagcatttacctcaggggccacaaagagaataagatgctggttccgcactcaaggaactcggtttaggggcaagacagatagggaaacattttctcgttgtttcagtaaatccttgagtgcctaccccgcaccaggtgctgttttccaggcacaagagcgaacaacggacaaacccctgcttttaagctcttacattctagaggggaaacacctcatacatgtagtaaaagtagagtgtttggaaggaaaataatgtggagtgaaactgctgaagcggagttgtaggtgttctagatggggttgtcaaggaaggccttaagggagagcctctctggatcaattttctcattgtaaaatgaggacaataattgtacttatctcagggttttgatgagcatcgagggagagaaaacgcgtagaaagtgagagtattacggggataagagacttctaggcagagggcagggaaaacacaaaggccgtgaggcaagagtgggctcagagcggatgcagatttactaggaggccggtgactatggctgtggtgggggtcccagagtgccttttggccaggccaaggactttaggttctgttctggggtggggaatgtcaggaaggatttgaaaagaagagtgacatcaacttgttctaagagaatcactctggctcctttgttaagacgacatagcagtccaaagtggggaagcaggccagcgggctggctttgtgacatcctggagggtagagacaacagaatagaacagcacgctacatactgcactggtgcttagatggatttctgcggcataagggtagaagtggagggggcaccttactcaactcggagggtcagggaaggcttcctggaagaggagataaacccctggaggttaagaaaagtgagctaggcaaactgagcaaatacagaagcagagtcatacaggcctgaaggacgccatgagccaatttcctgttcctggaggcgcagggcaagggaaggaattggcccgctggaggttaatggccaatactgagcacttctgagggctcagtgctgtgttagggatgttttatctcctttgatcagaaacaaaaccctgagataggtacaattgttatcctcattttgcggatgggaaaatagacttcgagatactgacttggcgagggtcacacaactagatgatgtgctgggtcccccagtcctggactccggaggccccctgaacgacctaggcacacttgtggcttccgtgaatttaagtgcacacagcccccgcctggccctgtgctggggaagggcaggtgggaggaggaagggaaggcaggtttttctttacaaatggtacctatttggtagtcaacaaaaggaactggatttgccccaacactggaagaaaaaaaaaaacaacctgttgggctgagggatagtgcactgtgcccagggccctatacttggtttgatgctctggtgttactctcttgaaattctcagtaacatgaataaggggcaccgcatttgacattttccctgggctgagaccatgatgcagccggcctgactgcgcaacaccatgcacactggaattcgtgggccatcggagggattttcgagggtaatgaccaggggtagggcgcggcagaagcgcagggtgaggttgcggacggcctcactcacaacctttccgggtcttcgcattaggtactgtgatgacgggttccgatagtgaccccttggggcctggagacggcccggctccccaaaggtgcggagcagggcaagcagggttgggaggacgtggcccgtgggagagctgcgctcgccggaacagtgggcgcgcaagggccccgaggcgctgtgacacgggacgtcgggcgcgcgggcctggggcgggaactgcgggtgcg

SEQ ID NO: 16121 - DNA, 79835 bp, Human; identical to SEQ ID NO: 12456

SEQ ID NO: 16122 - DNA, 14706 bp, Human
ggcttatgtggtctctgtggtcccttctagctatgatacattctaggatttgcaatgagtaatttcagaaactactcattggaggggaaaacaactcctgatttcctaaaccacctcatagtttgtaaaacactttccaattccttatgcttttcattctcctggcaaccctggaaggggccagggcaaggtctgtgtgcccatttgaaactaagggtgagaagcatcctcaggagctgtgatttgaggctgcaccactcattttgattatgctggtacaccagtttgctttcaaatgtgagtatgcataaaaataacctggaagcttggtgaggtggcagtcacctggagtaccagctatgctggaggctgaggcgggaggatctcttgagcccaggggtttgagactaccctgggcaacatagtgagacctcgtctatataaaataaataggaaaaaaaaaataagatactggcttttctaattccctaagtgtcaaaaaaaaaaaaagaaaaagaataacaaatatcacctggaaaggggacatggcattgttaaaatgcagattcttgggcacctagagattttaaattggcagggccagggtgggcccaaaattagcaagtgaccacgtggttctgaagccagtggcctaaggaccacccttgcagaaccgtggtctccttgtcacagtctaggcagcctctggcttagcctctgtttctttcataacctttctcagcgcctgctctgggccagaccagtgttgggaggagtcgctactgagctcctagattggcaggggaggcagatggagaaaaggagtgtgtgtggtcagcattggagcagaggcagcagtgggcaatagaggaagtgagtaaatccttgggagggctccctagaagtgatgtgttttctttttttgttttagagacaggatctcgctctgtcgcccaggctggtgtgcagtggcatgatcatagctcactgcagcctcgacttctcgggctcaagcaatcctcccacctcagcctcccaagtagctgggactacgggcacacgccaccatgcctggctaatttttgtattttttgtagagatgggtcttcaccatgttgatcaggctggtctcgaactcctgggctcatgcgatccaccccgccagctgattacagggattccggtggtgagccaccgcgcccagacgccacttcatcgtattgtaaacgtctgttacctttctgttcccctgtctactggactgtgagctccttagggccacgaattgaggatggggcacagagcaagctctccaaacgtttgttgaatgagtgagggaatgaatgagttcaagcagatgctatacgttggctgttggagattttggctaaaatgggacttgcaggaaagcccgacgtccccctcgccatttccaggcaccgctcttcagcttgggctctgggtgagcgggatagggctgggtgcaggattaggataatgtcatgggtgaggcaagttgaggatggaagaggtggctgatggctgggctgtggaactgatgatcctgaaaagaagaggggacagtctctggaaatctaagctgaggctgttgggggctacaggttgagggtcacgtgcagaagagaggctctgttctgaacctgcactatagaaaggtcagtgggatgcgggagcgtcggggcggggcggggcctatgttccggtgtccccacgcctccagcaggggacgcccgggctgggggcggggagtcacaccgcgcctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtacggaccccagggacgccgcgccgacagcgccgcctgtgccccccgcgcagacccgggagggcgccgtgtttggcctggaggcggcagggggcgggggaggggttgactgaggcgcccaggctgggcggtgcagagccggggttgggcctccgggccccgccctggggtgcggggtgacctcgggccggtccctgtttgctgctctgtgctctgcgcctcagcttcctcaccggagcctccccagcgtcggactcagtgataataatagcccacgtgtattcaactggcgtttactgcatgccaggcctttgggcgacttcaagccagctaaaactcacaaccccgctgtgagctgtgttgtcactgtgcccatctgacggaggaggaactgaggcccagagagggaaagtgacttgcccctggtcacacggctgcaggtggtggggctgggatttgaactgaggcctgctggcttcagctcagaatttgcatctcggtagtgagcacagctgctaggggaagtgaaggcggggcggaggaaagtcctggggcctaaccgttggtgagccattgaggagaccctccttcctgcctcgatgctgactgccaggtgcaggcctggccggccaggcctctggggacagccctcctggctgggaggccttctctgcaggggcggggcagctggaccagctgctgatcccctccctctgcctgtccttccatctgccaccctccaccctcccaggccctggttgccatggaacctcattaatcaggcaggccgacccctgagtctctgtagaaggactaggtgggctgggcctctgggagctggagaggaggcccccagtgccaggagagaaaatgtctcagggagatcctttaataaagccctccctgatcgctgagctcaagacgaattcagactggagggcccagaagaggcggctgaattccagtgggagaagggattggaggcgtagaagcctggagctgggaactgtggggcacagggcagggtgtggagaccagtttgactggcgcagcctatgggtgaaggtggggctctggtgtgcaggcggggtctggccaggcaggatggggtctcagcagggaacttggagcaagtgggaggggtgaggcaggactcaggacaaggaggtagaagctgcctaactgctgatgggggtgtgggtggcagctggtccctgaggcatcctgaggaggctcccccaacccccttggccccatgcccagtgctgccttccggaatcaccacaatgctaataataataacaatagcagccaccattgttttgaggatgtcttgtgtgccaggctctgtgccaagcgctttacttaattaactcatttaaccccatcagcagcagtccctttttacagattgggaagctgaggcctagagatgttagaatcttcccatgtcattctgctcttgagtggggagagcagtctgcgtttcctctgaggttgacctctgggatgccttgctttctggggatgctgatacaggttgaagaaagggcaagaagggcttttaggggccctccctcttaatgagtgggtgggagggggttgtaccaggggtgggccaggtggcctgtctcctgtactccaggggcctgttcctgtgggtaccacttgggacctgggcaagcatcttccattcagctgtgtgacaagcattatagaaggctcaggtctgcggaaatctaacaacctgagggtcttgtcctcaaagatctgaacaggattatgggttctaggatcaaagggagggacaggggcaaagaaaaatgccctccactccacctgtcaggggcaggctcattggcctgggcattccattcattcaacagttgttgagttagtgaatgcccaggaggcactaggcccagagacaaggagccctggcccccagtgtacttaagggccaggaggctggcaccattctggaactgaagtccagaaagtccacaggtttggcttttggcctctctgcactggcatttgtctggcacagtccttgaaataagctacaggcttagcttctataccagcaggcattctgtatacaaggctctgcaattcagccattcctcttggccctgcctgtccacttccacaaactcaagtattataactataatacatgtttaatgtagaaaacttaacttttttatttatttatttattttttttttggagacagggtctcattctgttacccaggctggagtgcagtggcgtgattgcggctcactgcaacctctgcctcccaagttcaagctattctgtgcctcagcctcccgagtagctgggattacaggcgtgtaccaccatgcccagccaatttttgtatttttagtagagagagggtcttgccatgttgcccaggctggtcttgaactcctgagttcagacaatctgactgtctcagcctctcaaagtgctgggattacaggtgtgagtcaccatgcccagctgaaaacttaactcttaactcttttttttttttttttttttgagatgaagtctcgctctgtcacctaggttggagtacagtggcgccatctcggctcaccgcaacctctacctcctgggttcaagcgattcttctgcctcagcctcccgagtagctgggactacagacgtgcaccaccatacccggctaatttttgtatttttggtagagatgaggtttcaccatattggtcaggctggtcttgaactcctgacctcaagtgatctgcccgcctcggcctcccaaagtgccaggattacaggcgtgagccactgcgcctggccaaaaacttaactcttaagaaactagaaagttgacggcaggatcccagccctattcatttttttcctttttttccctaaggctatttttgtttgtggtggttgtgacagtttttgttttttaaagttttaaaaattgtagtttttcctgtatcattcacaccattcagatatggcactggtctcccacagtccttccagaggctgccccgaaatgtattctataataatataaactgaaccagagaaaagtttcatgagctttttaatccaaaagggatcatataaatatatcgccctgtgacagtgttttgcttgtctgtatgtgtgaggggattcttgtcaacctgcctcggtccttgacagctgcgtggtgttcaaggggctaaacaaagcacagctttcgtgacccccttcatggatgggtgttcgagtcatccagattttttcagcagtgaatgtcttcacccctgcgtttcggggcccctctgccagtgtttatctagggagaagtggcagaaatggcatccactcaagcctttgttttagggcgtggcactgacctgccttcaggggtggacaagggtggggatcccagggagaaggcaaggggtgcagatggcagaagcatgctagggtttgggccccaggggcgagtatggagggggatacattctggctgggttctggggaggtggggcacgtggcgggtatgagtgtgggctctgtaccagccaactagggtgcaagtcctgggtccacctctcactgtgtggcctctctcaggtggaggccatcatagcacctgccaaaaggtggccggagggttgcaggggaagcagttgagtacacagtgcttagagcacaacagctcttctttcccctgggtgccttcaaaagtcagtgaatgtgcacaagagggagtggttcatcagcatggggggggttcattcagcaaacatttgttgatgccaggctccatggcagacactatagattctcaagtgattcagacacctctgagggtgagatagatacatctgcagaaatgtgtagggagagacagaatgtggcaaaaggttgggtttgaggcagttcagagggagaagaggtgacacctcctagctgatgcgtaaggtttctgcccacagaggtagagggagcaggcgtgaagtggggagggtgggagggatgcaagggcagtctagatttctgggaaaacgtgactcgggttcctctagagaagcagtggcagatgagagtacaaaggcaatggggagctggaggaaggccttaagcaggggcggcggcatggtaaggtttgtaggaggactggctgcagcagaggcagggagaccagtgtggagtctgctcagcagcccactgggaaggtggtgatcgccgtggtgatgagcagttcttggtagctgcatgtgaggagggtgacaggtcaggaactctagctcaggaaaccctgtggatggtggaggggaagatcagtctggttttggtccgggtacttttgagcagcctgtgagacctccaggacagtcccaatcctggagtgtctgaactaagccagagtgcttagagcttgggttcttcctcagaccgtcttgggtacaaatcctgactctaccacttcctgggcctccctgggctttagttgccttatctggaaaatggggccatttttatacagccagtccgttgaatggaatgaactaatggatgcaaggaacttgatgagcaccagctgctaccatgcgtatagattagtcaaaaaccagagagaaggtgatttagccaagggacctatgtaatcagtggcttagctgggcatggtggctgactagtcccagcacgactacagtgaaggctgagatgggagaattgcttgagcctaggagtttgagaccagtctgggcaacatagggagaccccatctctacgagaaatagaaaagttagctggtcttggagggatgcgcctgtggtcccagctgtttggaaggctgaggtgggaggattgcttgagcccaggaagtctaggctgcagagagttgtgatcataccactgcactccagcatagtcaacagagcgataccctgtctaaaaaagaaaaaaaaatagtgccttaaaacaacaaacatttattatatagtttttgtgggtcaggaattcagggaagacttatccagctctggcttggggtctctggagattcagccagtgtttgggttctggctgctaacagaagttgtgactaagtgttgctgttgggaggaggccatggtttcttgcccatcattagggctacttgagtgcccatatgatatggcagagtaagtgacccaatacagagcaaggaggaagctccagcgcctctgacccagtctcaaaagtgacaggccatcccttccaccacattccattcattcatccccagaagcaagttaccaggtctggctcataaggggagaattaggctatatcttttgaaggagaaggatcagaaagtttgcggatgtgttttaaatccaccgctagaccccagagaagtggtgaaaatggaatgtcctgtgtggtaggactgtgactctcaggctatgtcccctctgatctccctcagtcacacactcaggcatcctgctagagaaactgaggcgagggtagcccagaggcacccagccttaagccaggtctcttctggcctcactcctggttactgggcatcctcccgttttcgccacaggtgaagcggaggctggacctggaaactgaccatcagtacctggccgagagcagtgggccagctcggggcagaggccgccatccaggaaaaggtacctatggagcttgggctgggcagaccccctgtgaccaggcccaggttagggatgtgaacagacaaacatgcttgcaagctaacgtctggcttgtcgggcttgagccaggcctctgaggaccctgatgggcagttggagtggccacctggcttggtttctccaggccctgaggggtgaggagttccccagccagaagaagaatgctgtggttggcctcgccaaggggaaggagctggctgtcccccagcccccatcatcctgctgccctgcactgccagagtggcaggcctggctggaggtgggggtggatgctgaagggccctgtcttgcctgaccacacccccacaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgtaggtaccggccacacaggagggcaggcacacctgcccatgccagcctggaggagctggtagtaatacccactgtggctgcctgcatccccatcttatagctggggaaacgggctcagagaggagaggtagcttccctgagatgatagatggtaaaaagcacacaaatcttacatatccacctcagttgcagctttacttttttcttttttagatggagtttcactctgtcacccaggctggagtgcagtggtgtaatctcagctcactgtaacctctacctcccaggttcaggtgcttctcctgcctcagcctcctgaatagctggggatacaggcgcctgccaccatgcccagctactttttgtatttgtagtagaaatggggtttcaccatgttggccagtctggtctcgaactcctgatctcaggtgatctgcctgcctcagcctcccaaagtgctgggattacaggcatgagccactgcgccccgcgcagctttatatatttattcatctgggttgccaccattcagatcaagataagagcattttcaacaccctagaaggttctcttgtgcccctttccagtcattgccaacccctcacaccgccaggtcaccactatcctggcttctcatgccctcggtgagatctgtctggcatagatattttattcttgttttattttccccctctcgccttcgcgccagtcatcatgctactaccctttctttgatacacctgccgtttcattttttggtagatcgttccattctgcatcttttgtggttttttgggtggaggggggtggtttgagacagggtgttgctctgtcgcccaggctggagtatggaggcacaaatacagctcactgcagcctcaacctcctgggctcaagctccgtacctgtagctaggactacaagtacatgccaccatgtctggctaatgtctttgattttgtgtagaggcagagtctcactgtgttgcccaggctggtctcaaactcctgaggctcaagcaatcctctggcctcagccccccaaagtgctgggattataggtataagccaccaagcccagcctttttttttttttcatttgacagcatgtcttggaaatgcatgtgtgtgtgcatgtgtaatatttcgtggcatgtcagtcccatcatttgtttatcccgccctggttgagggacatgtaggtgtttatattcgggccagacttcaagcccatgacactctgatttggagcccagctgaggagccagacccagacagaagcaagggcttgcctaggcctcacagaacagaggcaacagcagactctgtcctgaggcccagggctcctggccagaggggccaatcgctgttaaccctaccctccctggtgcctccccacaggggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgatatccttggattggccgtagggtgtggaaggcaggcttagcaggcaggggctccacccaagtgggactagagaggcttggatttaagagagagctctgattttggttgcaagtcctggctcagcattttctcactgttgtgacactggataaattgcttaacctcttggcctcagttttatctataaaaggggaataataatatccaattctgaaattgtacagattaaaaaagaaaagtggctaggtgcggtggttcatgcctgtaatcctagtgcttcaagaggctgaggtgggaggatcacttgagcccaggagtttgaggctgcagtgagctctggttgagccacatcactccagcctgggtgacatagcgagaccctgcctctaaaaaataaattcccagcaccaggcctggagttgtgttgaacattttacatggaatcgttcccggtagccattattaccttgggattcaatgggtagagtgatttcattatacagatgtggaacttgaaactcaggcgtgaggtaggttttgagtgggtaggaggttgggaggacaggagtgactaggcaggtgtgagccctgccttgtgagctgttggagtgagtgaccccctagaagtcaaaggtcatgtggtccttgactctgccaaccctggcctacgtgacgtgtcaggaccttcgtagcattgcagaccctgcagagcagatggttatggtgatcaaagcccctcctgagacccagctccaagccgtggactcttcggaggtgagatctgggaactccgggcccaactgggctgggctgggctgggctggtggtcacctgggcctcagtttaccctgcctgctgcttccacccagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtttgggccgggttttgggactctgttgggaacatttcggggcgggagaggccaaggttgctggggaaatgcccattctccacttcccttctccctgtccgtgcccgatttgatttgagcctcataactcgaagaaaggtcagcttcctcgctgttttggtcctaactcaaaagcagatccagtaaaggtttttgttgtagaaagccaagaatgctattcagtgctgcccgaagtgcagagtaatgagtggcctctcctttccccagccccagaggccactctgctcagtttgctgtcttccttccagacgtttctggacattagtaaacatgtaacaaatacagtgggctggttctgtgtcaggtatttaacagttctggggacacgggtgttacctcctttcatggtgctctcagggtctgaaagaggagatctgcataaatgagaaaatcgggaaaggcgttctggaatgggtggtgcttaagctgagcgctgtaaaataagtaggagttaaccagaggaagaaaataccaagcagaggacacgatgggcaaaggccttgggcaggagggagcgggatagaggaccggagagaaagcagtgtggctgcggtcctgaggtgagggtcagagtggtgctcctggagtggggcgttcagtcttaagctttattcaggggccaaggagtcactggagaccgaagtgacacctcctctttcgcatcttaaaagctccccccggctgctgtgtggagaacgggttgaagggagggccagagtcacggaggggaggggaaagggctgcgcttagtgccagagagggcgggcgtcgggatgcctgggattcggccgcacggacctgtgggcttcctctgcgccagcccccgttgtaagcacttgacattgaatgagtcccaacaattgcatagggtgtctgccagtaccatttttgtagatgaggatacagacgccccaaaaggtgaagtcctggtgggttttacccacttgtgtcaccctgacctcggcactggcttggtcatcctgtccctctgggtaggcccgcagcccctaggttctgctcccgacaggccgtcgcgggaccggagccctcgggcgcctccccctccgccgtggccgcggaagcgcggaggcccgcggcgctggagttggaccttgaggcgagggaacccggcgtccgcgggggcggggcgggggcggggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgtgagtgggcgcgggctctgctcgcggtgtctccctacccgagtctctgttagtctcaccctccggggttgttcgggccccgccgctgtttctgggtctcttcccctctctctggccctgctgttttctcttgacctttctgcccttgtgtgacctgttctgtctctccatgtctcctcttgtccctgctccagtgtcactgcccctgctgcctcccacccctcagcccaccccatttgtgtgtctggtgttggcggggggctggcgacaatcacagcagcggtcaccccactctgtggcagctccaggctgggctgactggggaaggggagcctggaaacgcaagggcccctcactcctgactctagtgccgcccccagagttcttcaggccccactccagggcagcagagtcctacagttggtaagggctgctcagagtcaccctcccatggggccatgggtggccctgcggccaccatgggcaccagccacggccctgagccctttctccaccgttcaccgctgtgctcggctctgtcc

SEQ ID NO: 16123 - DNA, 6848 bp, Human
  misc_feature (1)...(6848): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaagaaattgagagggaggactcgatacgccttgagggcttcttgggtctgcgcttggctccctgcttcctcccgactccgaagttgcaagcttgcaacaaggaagtcgtgcagccgccattgtcgggctgcccggggcaggggaggcggctgcagctgcttatgtaagtttttggctttgcgggaagcccggctccctgcactgtaacgcggcttagcgcgcccgcagtttggagagcaattaggaaggggcagccttattatgaaggtggtgttggggctacgtcttttcctacacctgcctacacagatgctggcaacagctgtcttccagttttgactcacctgaactgagcaattggacatctcaatggcaaggggggcggggcggggaggaggcggctttggacacacatggtctctcttccaggtctcatacatcttgagagagagaggggagaggggcgagtggccaagtacacactagccaaaacaacaacaacacattgatatgttgtcatagctagtctaaggccactcctctctctggtcccatgcacttttatcccacaagccctaggacgagttagtgacaacagtagtaagtgtcacagtgtaaggtttttgctgggctgcctagcctctggatgattacaggcctgggtgcttctagggaatagagaggcagaaacacgtagaatgatcaagtcagaatcatcttttggaaatgttgcctaacctcaaacttcagatgagacatcccgcttctacgctgggtagctcggtgtgttcacttttctttagaaggagcttattatgggtttcaaggtgttggtctccaggttggagtcttgttccatggtttttgtgtaagactgttacagcccagtcctttgctcctaccacaccaaacaacttatctgtgtggtcactgttcagtagaggaaactttttgtttttcaggatatgggtctgcaggatggagttcttccggtaagagttaaaactcacaaaaaagctgaaattctttcacccttattgtagggatagaggtaaaaacacctggatttatcaaatacaatcttaaaaacaaacgtgtatgctattaatacatcacacaggtgcagaaagaaaaagcaatcattgttccctctcctcccatgttacctgttgggtttatgtacttctatagctttatttgtaaggtatatacttctataggtttgtatgagccgagagaaaaatgtagagggctaacatacccagcgggaaatgggataggtgtagggggcacggtgcacttgtttttttctatatctgtgtagccatcaatctctgtacaaatatggacatgagcttagtgtgtgaggagaaatcccttaatggttctccaacccctccttccagttcctagggcacagcccctttatgcccgagtgctacagcccttatctgttctagtccatatctgttcagaactgcacttgatgtaccagctacctacctgccactctccccaacctgaaaatgcacaaaagagggaacaagaaagtttatttttaaaaaatcaattcttggtttaggatttgggatacaggaagatcctacctcattcttgtttatcctttcctctgtaggtctggcgtgctcctgatcagagttactctgatctgaagattttggcgttcaaggcattaagataatagcctgagttgttcatggtaactataactttggatattaaatcttgatgaaaatgacttggcatttgctttaaaatatatataccaattctgattgtgcatgaacacttctatttgtctgggggaaaatattagccgaataaaagtaaaacaatgtttttaaaaaggaaacatagagaatgctttaagatgaccagttttttaacatgatgacagagatctttcatgccagttccaaatttttgcttataaaatactctcagcacttatcaagtacttacatctggtgttgatggcacttttatctggatgcaggtagattggcatctagagagaacaaagccacttcccaaatgtcatctcattctcttaaggtcagattaaaccttgaccttcatttagaagtggcccaaaagtgctgtggaaaatctagaacacaacactcaatgggatattttggcagtaatgttcctctctagttctgcaatagtaatttgttccttctgtcaaggaggtataacataattattttgctgaatcctccatagagtagatggaataagagtaggtgcaacagagaggactagaggattgttcccttgaacctgtttcttaaaacttgagtttgagttatttgattatctctagtcaggaaacactggttttgcagccagattgtctgcatttaagtcccagctcttcactaaatagctatagaatattgggcagatttctaactttgtctctaaaataaggatagtgatacgtactcatgaggttacctgaatattaaattaattaaaacatgtaaagcacatagaacaatgcctgggatataactaggcaaatacttagtaaattgaagatgaacaggagtaacaatatggagatccttgagttgggatcagtcttttctacccatattcaaagaccactcttaacattgactttctgaaattgttaggttccatagattgaccaggaaatgaaaatgtgactgtgttctctatatggaaaagtactatttataattactaaacttttttttttttgtaggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatcattcctcttttcattttttcatagcaaccttccacatacctagatttctaccaaaatgtattttgtatgctagcttcatcctggctttacagagttgaagttaaacatgtgatattaacctcctttgaaaccacatagtcatggtggtaacccccaaaaagaaaggttaattttcagcagtctatgtgatgcaaatatttatcatttagcctattttgcatgagaaatgtatttgtgttatttctgccactggtactgggtttacacgtgtgttagggcacctgtttcctttatatatttttggtggcagcagaatcctatcacggcagctctcctgtctgctgggtcctggtcagtaacactgcctctctacacctggctggatttggtagtcctctgcatagtggagccatcgtgttagagtcttcaagttacctccaacaccctagggagttaattctgaaatgtggttactctgaatctgtaatgtaagaggaaggtcaaggctaagtgtcaacattactaccttttcattacttacaaatcattgacttttttctgtttttacagagaatgctacaaacttg

SEQ ID NO: 16124 - DNA, 34548 bp, Human
  misc_feature (1)...(34548): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgagaactgcttgaacccgggaggcggaggttgcagacttgagaccatgccactgcactccagcctgggtgacagagcaagtctccttttcaaaagaaaaatgaagattccctttcattttttaaaaaaattaaatcagagtaactgctgaattttatcaatggctttccacatttgataaacaatatattgttaaaaccataccggcttttctcctttaagctattagaactctaacgcttttggttcaaggctttaagctcttaccagttaatatagagatacttttcggagtgttaacactttaaagctatcaacagccatttctcctcagtctggctgatggtgcagaaaatcagaggagccataaggattcaagtagagcctcaagggcacaaacaggttcagatgggagaagacccactggctcttacctgcccgcagatcgcaggcgcaggagaaaataagacaactgcactttccccttttggaccctgctccgctggtttgcagcctggaaaaactcttcctcccctttcatcctgctccctcaatctctgctcgtgaaaatcctacccatttttaaacgctcaaattaaataccaccttctcccactgagtcttcccagatcccctagatgtccctccaaatccctactccttaatgccacatcgtatagtgtgaaaccccaccgcggcaggaatcacttaactgtcccgtgtagaatcaccgtttatttctctctgtatctccagcgcctggcagtgtgcctggcatacagtgggtgctccttccatgctgaaagaaagactgacagacgggaggtgtgcccctctccatccgtctggcccttcccgccagggccttgcagggcggactccacctcggcagagggcatcccagacccctctccagccccggaagccggattgcctgccatgggaagactacacttcccagcgatcccagggaaaagcgaaaaccttttggctttgacagccgccgccacaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggcgccagggacggacgtgggccagtgcgagcccagagggcccgaaggccggggcccaccatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacggtaaggtggtcaggccagcccttagccctccgcctgcatgagcagaggggagacaggatggggatgcctcaagctagcccctgctcaaatgggctggtggggacagcaggagggacccctccccagccattccccgggggtcacgtggttgttggcagaagtgttcccaagctccccattccctcctcgtctcccctggctgcctagttccccttgctcctcatctgacacatacgccgtctggaaggatttgaggcaagacagacacatcagctggggaccctgacctggaggaagggtccgccacaggggcactataacaggtgtcagccccctctgacagtggcccagtccgagtctcccaaatcccaccactctagaggttggccacccaaccttgtcccctcctctgattcccaccattgttcccagtacctccaggaccaaggaatcctggcagcagttgaataagcaccttgctcccaccatctgggctgccactggtacggcaaagtgaggttgtcgaggcccccctgactgcactccgcccggaagccctggacaggctcctgccgtcccctcctcctccccttctccctctcgcggtctacactccagcccctcccccaccccacacctccccaggccagaggggaactgaactgagcctggtgaaagaacaaatggtaggaaaggagccagagctcccttttaagagtgggactccttccatggcgggggagaggggagttacagagaaaacactgttatgccctccccatccttcctgacaatctccaaggtaccttcaaggtggctggtggaggtggcaccctctgcacctctgtgggtgagcagccctccatgtggggtgctgtggctgacctctgtgtgcatctgccgcctctgtggggcagtccgggcccgggcagccctgtggttctgtgtatgctggtgcgtgtcaccttgaatctgatcctgcacatctgtgagccacctccggatctgtgtctgggaagtctgtccttgggagggtctgtgaaggtgggagtgtgtttggggtgggcggaggggacagccacactttcctgaacttctcagacagctggatctgggagaaacacaaacccccacctcccaattactttacagaagccagccttcctaggtgcgtgctccccagccctacctctcagctagtcgaaagcctggtcttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtaatcccagctactcaggaggctgaggcaggagaatcgcttgaacctgggaggcggaggttgcagtgagacaagatcgcaccattgccctccagcctgggcaacaagagcaaaactctgtctcagaaaaaataaaaacaaaaacaaaaacggggtatccattgctgtacttccctgatcccctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcatcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcggaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaccagcctggccaacgtggtgaaaccccatctctacgaaaaatgcaaaaattatctgggcatggtggcaggcgcctataatcccagctactcgggaggctgaggtaggagaattgcttgaacccaggagacagaggttgcagtgagccgagatcacgccattgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatggtcttgaaggatggacaggagtggcaggctattcccagggggcagatggcaccatactatcccactgtactgtaattgcacgttacacgtatgtccatgtctgctccttcccaccctacccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttggactttggccttcagatataagggaaaatctgaatttattggggcaggggaatgacatgaagaaagcaatctttcaggaagagacatctgaattttaaaaagagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcgtaactcctgggctcaagtgatcctcctgcctcaggctcctgagtaacttggattacaggcacatgccaccagccccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagaccctgtctccaaaaaagaaaaaaaaaaaaaaaggtctttatcactcacagtgtctagcagaagaaatggggttgaaaggttaaaccactggccaggtagaaggccagtaagttaagacctgtttcatccttgttcttcctactgtgccatttgtcttggggaagaagaagttatcacaagcatccctcttccattctcccattacacctgcttatatctccattactacacttgtaatgtattacaactgtttttgtgtttgtttctctcataaaacttcaagctctggccaggcgcagtggctcacgcctgtaatcccagcactttgggaggctgaggcaggaggatcatctgaggccaggagttcaagaccagcctgaccaatatggtgaaaccctgtctctactaaaaatacaaaaattagccaggcgtggtggcaggcgcttgtaatcccagctgctcgggaggctgagacaggagaattgcttgaacccaggaggcagaggttgcagtgagctgagattgcaccactgcactccagagcgagactctgtctcaaacaaacaaaacttcaagctcttaaggacaatgtctttttaattttatttatttattttgcagtatcctctctttgtgttataataatctataacaataccaagctcagaacatacacctaaaaaacattgagtgaatgaatacataagctgcaagcctctaaacagaactgttgacaggcagttgtaaatgcagaactgtagctcttagagaaagtatttttattcttttaaacgaaagggccaggttcagcagctcacgcctgtaatcccagcactcaggtgaggccgaggcgggtggatcacctgaggctgggaattggagaccagcctgcccaacatggtgaaaccccatctctactaaaaattcaaaaattagccaggtgtggtgctgcatgcctgtaaacccagctactcaggaggctgaggcaggagaatcgcttgagcccgtgaggtggaggttgcagtgagccgagattgcgccactgcactccagcctgggtgacagagtgagaccctgtctctaaataaataataaataaataaaaggatgttatctcattttgatattatgagcatcactgaccaaacataggataataaggtaactgttaggagtgaaatttggtgatagtcaattcagtttaacagatatttgttgagtacttgcctactgtgtgtagaagagaaaaataatgccatagtcttagcccttggacagctcacaatctgatgtgagacatagacataatacctaaatattacacaaaaccaaatgcatttggtacaaatagtgaaacagtggatcttggaagtgcacagagagaagcagctacttctgacatggtattaggcacagcttgctggaaaaggagggttttgttttgtttttgtttttgagagggagtctcgcccagggatccacccgcctcagcctcccaaagtgctgggattataggcgtgagccaccgcgcccagccaaaacggaggtatttgaaagaggagaaagctttgcaatatggagagtggtgaggaggagcacttcatgaagaaaagcgtgaactgtggtgagaagccagaaggcatggtggggatgccatggggctgacaggactttgggttttattctgcaaacagtaaggaatccttgtaggtatacgagaagagggatgatatcgtctaattttagttccaggaaaacagcttcagtgtgcagaataacttggagagtctagcatcatgactctagacatgcaaacaaggatctcaggatacgggggcctgaaagaggatggtggcagtgagggtagaaaggaggaatcagcattcatccatcgtttaaccagttattctctgcgcttgatgagatgtatggggtgagagagagggaagaggagatgatggctttatttaacctctctgactttttgtcagggaacaaagcaacaggggaaagcttttgaagcacaatatagtttttttgtttgtttgtttgttttgagatggagtttcgctgtgtcacccaggctggagtgcagtggcgcgatctcagctcactgcaacctccacctcctggttcaagtgattctcctgcctcagcttctcaagtagctgggattacaggtgcccgccaccacccccagctattttttttggtatttttagtagagatgggggtttcaccatgttggccaggctggtttcaaactcctgacctcaagtgaccgcccgcctcagcctcccaaagtcttaggattacaggtatgagccaccgcacccagccaggaagtacaatatagtttaccaaagtttatgtttattattctgctttaattataagggataggtattagcatatctatttcagggataaggaaactgagacccagagagactaagtgtcttgtccaaagtgattctgttaagaagaacagagtaggggttcaaataccggggcctttccttcctgtgttctacgatctgggacatgcctttgagatgctagtgggtcatcctcgtggaagtattcagccaccagctgacagtgggaatctggagagaagttagaactggacaggcagacaggactcatccacagagaggccaagttaaaaaatagacttgttctttgagggaacagagagggaaaggagaaaaatgattaggaaaagaatattaggtatagacaagggagcaagagaaaatgatcagagcagtagaaaactatgagggctcagagtctcagaaaccaagaaggaccaggtggtttttctttttttcctctccttccctgcttggcagggttctgtaaagggacctcagcggtgagggagaaggctgggagcagtcaacactctagatccccgcccttcctgtcaccaagccatccccatccccccgccccaaatctcctgagcatcccaggataactttgcttttattgtttttatacagtggacttctgggttatatttttttaaaaaagagtttttgcaataaaaaggttgaaaaccatcgagctcaaagaaccaccctccaaattagacaaagccagcaagaccccggctccataagttgcctacccagtccctgccaccacaactggctttcctggattgggcctcgggttgcacacaagcccttgctggagcactcatcctgtcattccaaacctctcctctactccccagaccagtaaagaagagtttagctgggagtgagggggcattgagaaagactgtgctctctctaaaagcactaaggtggaaggtcaggaacccttcttgggcctctccaataaagggctgggcagaaaattccagttgaaaatccagaaagaggccaggcacagtggctcacacctgtaatcccagcactttgggaggccgaggcaggcagatcacctgaggtcaggagttcaagaccagcatggccaacgtggtgaaaccctgtctctaccaaaaatacaaaaattagctgggcatggtggcacgtgcctgtaatcccagctaatcaggaggctgaggcaggagaatcgcttgaacccaggaggcggaggttgcagtgagccaacatcatgccactgcactccagcctgggcgacagggggaagactccatctcaaaaaaagaaaatccaggaagagaaacacctcccagggaagcccccatacctaatgactaacttctgtctctcctgggagccttctctttcaggtgcctgggcaggggagagttctgggaaggaaccagaacattttctgagttctggagctgccctgagattctcctggcaggatgcgacagcacctgagtacatccttagtaccgcagccttgggtactatagccaggtgtttcccaaaataggagagctgggctgtgctggggagaatgaggaaatcagcagaactggggggattctgacgtgggggagctgggactcctaggtccttttcctcaaagcaaactggccaagctctgcctcctcccatgccaacttatcctctgtcaccatatttcctgagctgctgtcactctggggccaccctctctgctgcgcactgtaggctgggtgtcctcttgcttggtctttcaaggtcagtgaatctcatcacttagccttttttctttttttttcttgagacagggtctcactctgttgcccaggctggagtgcggtggcgcgatctcggctccctgcaacctccacctcctgggttcaagcaattctccagcgtcggcctgccaagtagctaggactacgggcacgcacaaccacacccggctaatttatatatatattttggtagagacggggtttcactatgtggccagaatggtctcaaactccttgacctcaagtgatccgcccacctcagcctcccaaagtgctgggactacaggcgtgagtcactgtgcctggccctaccacttactcttttccaaggcctgtggaggttttgacaggtaggacaaggagtgagttctagcatctcccaatggcttgaataaacaagcccatgtgctgagcgtgacacaggtgccatggtcagcttcattttcaactgaggacagagcaagagaagattcaagccactgtaacctgtgggtgggacaaggttaaataacaggaaggacttactgtctgaccatgaaaaacaggtggcgaatagctgctgtgataccttgtggagcatgggttttccaggtgggttccgcagaggctaaaggtgctgaagagatgcctcaagagccagcacaggcaggggagggaagcagaggaaatcaaacctccccttcaaacagaacacctctgtctttttctctcttgtacactaggatcctgcatacaattggaaaaggggaaaaggattccgctgctttattttttatttttatttatttatttatttttgagacggagtctcactctgtcgcccaggctggagtgcagtggtgcgatctgggctcactgcaagctccgcctcctgggttcacgccattctcctgcttcagcctcccaagtagctgggactacaggcgcctgccatcacgcccggctaattttttgtattttttagtggagacggggtttcaccgtgttagccaggatggtctcgatctcctgactttgtgatccgtccgcctcggcctcccaaagtgctgggattacaggcgtgagccactgcgcgcggctgattctgctgctttagaaaaaaaaaagtttgaaaattactgtcataaactcttggaccatcgacatccatcattctattggagtaggaggcactggcaaatattagttgagccgggttacaggctgcggagaaatggggcatcccatccaaagggggaaaggtatactagataaggtttggggcgacccagccacattgggactccttgaaaaaccagccagaggtggggtaagtggcgccagggagcctgcttgctcccaggtaccaatggccagctacagccaggagaggcaagtggaaggcagaggaactagctgggaaaaggagtccatttgcacagggctggctgatttgttcaaggtgggaggaacctggacaggacccagtcgctggactctgagacaggagctgtgtgctctgttggccataagcccctccccgctgctgactttaggctcctcttgtccttccttgcccccttttctcagccttgggtaagctcaggtctggaaatcacttaggaaaagcagatgaagctgactcacaaggttctgggactaaggaggcctggagtcactataactgctctaagaaccacaggaccctgggtggatattcaccaacatggtgaaaccccgtctgtactaaaaatgcaaaaattagctgggcgtagtggcgggtgcctgtaatcccagctactcgggaggctgaggcaggagccaagattgcaccactgcactacagcctgggtgacagagtgagaacccacctcaaaaaaaaaaaaaaaagaataggaagagtccatagggtcataggaattaactgcagggaatgaggcagttgctgtcaattaaaaaaaaaatcattacggagcatctactcagggctaggtaacaattaggtaataagcaatacaaatgctccctacccttggtggagctcatagtctgtgggacaggcagacattaaatacatgattaaaagtgtgagtggtagacaaagaagcacaggtgctactgaggatttgcaagaggaagaacctaatcttatctgggcgtcaggacaagacctttgaagaaaggatatttaaagtgtaatgtgaacatgagaacagggaaagaatgctgcagacaaatatatgcaaagatgcacaagtgagagatcatcgtgctttcgggaaacttcacaagaagcctggtgaggaaagggaactggcaagagatgttcacggggttgacctatggttggtgccttcagggtcaaggaccccaggatttaattcagatagtttgtgtcagttatctgatgctgggtaacagactactccaaaatttagtggcccaaacaagaatcattttttcaggattccgtgtgttggcttgtaatttttctacagatcttacctgggctcacccatgtggctgcattcagctggtacgtcagctgggggctggactaacccaggcctgttgggcctctggttctgtgaagtctttcatttggaaggaggcaagactgagctacttcacacagaatctgaggacagcgttccaagagggcaattcccaatgcacaagtgcttatcaagcctctccttgcatcatttgctgatatcctgttgcccacagccagtcacatggctaagcccagaatcactgtcagaggggatcccacaagggcatgtatggggggcagggtggttcattagtataacaatctatcacatacttcctctccaaatgggagagacgggaaggtcaaggagatgaaagaccacacttaaggcttggtcagaaccaacggattcttgtcctagctttgtggcatgtgtaagatgggtgaagttgcttactcactctaggtctcactttccttctctgtaaaatggaaggcttctaaatctcaactttagctgaaagccttgttatgcaagaatataggcgtcttccctctttagccatgaggcccacacagaagaaaatagacttcctattgaataggaagaagaattggagctagagcccccactccagaggcttttgcaaaagtgctatgaccttggggtagtaccaataaagggtgtggattcttaataatgagagatggttcagaattggaaagagtctccatctctccaggccactaaacagatgccccttgaaggcgtttttcatccagaagaatctgagctatcgctgtctgctggtgagagctgaggccaagaaaggtgggatttggggaacaaagagcttaccctaagcttgccagctccatacctgcctcatcacccaagatctactgctgagaactgcaggggaacatgcagagtgaaacctgggcaggtgtgcctttccctgtggggcttgttagcacttcccatgaagctgccttccctctgaggcccccagggacacgtttgtttgttaaatgattgacattgacctagttctgaccccaggctgcagctccctgggcatctgtctcctgggtctgcctgaccccaggggacaaagacgatgactcccggatcacaggctgcgtaaatacaggcaggtgtcatgccaggggccaggtgagaggaaggcaggtctaagctagagccacacctataacctaaaacacccatggtttgggagccactgagagatccctccatcccccaccacccaaaaaacagggtagattagctctttcaccttttctttccttcaaccattcattcattcaagaaacattattgctaggcaccgtgataccttagtagaacactaaagacattttaatagttttaaattcgatatgaggggaggtgagattcagtgtataattacagagtgacaagttctatggaagattttattttattttgagacaaggtatcactctgtcacccaggctggagtgcaatggcacgatctcagctcactgcaacctccgccttctgggttcaagtgattctcgtgcttcagcctcccaagtagctgggattacaggtgtgcgccaccatgcctggctcattttttcgtgtttttaatagagacagagtttcaccatgttggccaggctggtcttgaactcttgacttcaaatgatctgcccgccttggcctcccaaattgttgggattacaggcgtgagccaccgcgcctggcctggaagcatttaagtaagaaaatataacctggtctctctccctaaggaagtcccttgagctcagatggcaggatgtgtaggggataagtagataaacctgcaagtggagaggaggatggtccaggcagagtgaagctgatacaacagcctttgcgagagggaccatggctggtgtggggaactgagatatctgaggtcagtgtggctggcagcagagctttatgggttttttggttggttttgttttgttttgttttgttttgtttttgagacagaatcttgctctgttgcccagacgggagtgcagtggcgccatctcatctcactgcaatctccaccttccaggttcaaacgattctcctgcctcagccttccgagtcgctgggattacaggtgcctgccaccacacccagctaatttttgtatttttgtagagatggggtttcaccatgttgcccaggctggtctggaactcctgacctcaggtgatccaaccgcctcagcctcccaaagtgctgggattacaggcgtgagccaccgcacccggccagctttacgtttttaatagcaaaggaaaactgtttacataggagggttaacagtcaaatttgcactttgaaaagatcactctggctgcagtgcacaaaacagattggacaggtcaagagaagatgtgccaaaagcagctgggaaactactgtgatattccagggtgagctgatgatagcttggcctagggacagcaaaagaaataaggaatgaatacattcaagagacttgtaaggagcttaattggacaggacttgttgatgcactggatagagaggtgaagaagaggaaggtgttaggatatgtctgatactgctgacctacagaacagatgggtgatgctgccatccactagtattaaggacactgggaggccgccacccgaatgggaaagatgcgtttggtcaacttgggaaaacccggaattgaccccttttttttttttgagacggtcttgttctgtcacccaggctggagtgcagtggcacaatcatggttcactgcaacctcaaactcctgggctcaagcgatcctttcacctcagcctcctgagtagcagggaccactggtgcccatcaccatgcctggctaattttaaaaattttgtttgtagacatggaggtgtgtgggagggggtctcactatgttgtccaggctggtctcgaactcctggcctcaagtgatcctctcgccttggcctcccaaagtgctgggattacaggtgtcagcccctgcacccagcccttgaggtatctttgaggcacttgggtgcgtgcgtcgggagctcaaaggagaggaaaaagctggagttaggagcttagacatcaccaggatctaggtagatggcttagtgggagagggtcgttagagaggaagagggccaaagctcaagccttgagaaaggagcctgccaaggagacagagaacacaggacctgagaagatgaaggctgacttgaaaaacaccttcagtgtttggtgacatgaagtcaccggtaactgtagtaagggctgttttatagtggaggaatggaggcgaaacccagttttagaatgggttgaggaatgcgtgggaggtgaagaaatggagacagcctggctgagcgctttggttgtgaagggagaggagagaggggactggaggcggatgtgagattaaggaagttttttgttttgtttttgttttaatgaagagatgagcatctgtaaatgtcaacaggaagaattcagatttggtggagatggggccagggtggggtggctgtatctatgtgagggaaaagggccaaggaagaggtgggtgcctgggaagggaggagggacttgactccccagcacaggtggcagctcatgaggagcctggaaggggcagccgcaggcaggttggtgtggttggctgtgggagatgagggcagtctcatcccctggcccagttcagtgacccgagaggggaacccagctgctggggttcggcggctgcagcccctccaccgctgcctctgcccaggccgccctgaactgccctgtttcataatgagcaagcagtgcctcagccttgcctcgggcccgtcctgttaagagccccccccatccccccgcttggaatggagcaggggtggggaaaaggctgccgggactggccagggctcccattcgaagcgctgaaggacaggaccagaattacttctctcgggcgggagcacaccgcagagggcagacgggtcgacatttgctcgggagagaagcccaactgtttattctggttttcttttgtgtgtgtgtgtaaggtggagaggggaggcagagagcagtggggacctgaaatcgtagtattggggtgggtgagagggatgggagtggagggggacgttccttcctgggctcggcctggccccctttggggtggcagggggaaaggctggggctggaaggacagcaagagcgcccagggcctcagggctggggtgggagtaccctgcagagagctccctcctgcctcgcaggagaggaagggggaggcagggaggggcagggacagcaggagcccccaggtcaaagctccactccagtgtaaagcagtagccatatttgcttagaacttgccggatgttccctcccttgcacaggccacagagacttgttgtggaggagatcctctttctttggggtccagtgatagcagggagccctgtaatatgaggccagccccccatgctgggagctgagtcctgagaatggggaagagggttcgtggggagagggtgggtgaagaagccttcttaatcattaacctggttgatttcatctgaactgctgagcctcccagctctattgattttctctgaaagcacagcatctggagctggtggctgcccagagaccggggagagagaccacgggtagaggtaggggaagaggggcagggaggggaatggaaaccaggccaggagtggggggctgggaaggagggaggagacaaggtctgagggccgggagattgtcagaggagtctttggggatgtgaggaggccaggaggtctaagcaggcactgggggagggcacagtcagcacagccacagaggcaccacggagagcaggaaggagccagagaggatctggcagagaggacgaaactgaagtccagagaagcacagtgatctgctcaaggtgacagggtcagggcctgcaccaaaactgaggtcagttgatttcactggactgaggagagaagatacagaaatgaaggcccctggggcagaggagaacctgaggtgatggaaagtcggcaagaggcgagatgcaacttacaaattaccatttttctgagggtggggcctttcctttttttgcctgtgaggatatagtagactttcaaaaaatggctctggtctgactgaaggtggggtcaggccatcaaaggaggaagaaagggccaaggagaagtgatgctagaggccgggcatggtagctcacgcctcagcactttgggaggccgaggcaggtggatcacctgaggtcaggagttcgagaccagcctggccaacgtggtgaaacctcgtctctactaaaaatacaaaaattagccctgcgtggtagcgcacacttgtaatcccagctactcaggagactgagacaggagaatcacttgaacccaggaggcggagatggcagtgagccgagatcgcgccattgcactccagcctgggtaacaagagcgaaactccatctcaaaaaaaagaagtgatgctagaaagagctggacagaagggaacaccaagacacctgtccatcttcacttagccaaatccagggccctgacaagatgggttttcaccaggacattttatggggctcctggctccccactatttctgacagtaggattcctaggtctgtgtcacctgtgagacagaaggggagccacattctggtggcagggacagaaccacacgcatggacactgatgtgccatcctggtccccacaggtcccctgaccagtacagctcctagaataggtcttctctgagctggaggggataagccagactgcttcctgggagaattgaaaaggagcagggggccctgaagacagaatcagtcaggtacacagtgagcaggggtgatgtgacggtagagagacatgggaacagagacagcacacacaccacatagctctgagatgacgcacaaaatgttatgactccatagactgaagcagacacagcgtttcttttcttttctttttttttttgagacggagtgttgctctcgtccaggccggagtgcagtggtgtaatttcggctcactgcaacctccgcctcctgggttcaagtgattctcctgcctcagcctcccaagtagctgggattataggcgtgcgtcaccacacccggctaatctttgtatttttagtagagatgggattttactacattcaccaggctggtcttgaactcctgacctcaagtgatccacccgccttagcctctcaaagtgttgggattacagttgtgagccactgtgctggcctcagacacagcatttctaaggccatgttgagggtgccaaaggaaaccaagatattttaccccagaatatactactttgacgtattttgagtcggctgtcagagggccagcacacagaagtggccctgcaaatctggcttttgagggagatttgcatctgcagagaatctgcattgatgcaacctggctttctctgaggccctccctggtccaaatctaggaaagattaactgaaagtctgacatgtttaaaggtctgaaagacacatacatcacctgttttctctgaggggtgttacctatgaggtttcattcatataaaaagaccacttttactggcctggcctccgtttatccctcccataactatttttgccaaagtccaagtcccttttttttttgttgttgagacagggtctctgtcgcccaggctggagtgcagtggcatggtctcagttcactgcaacctccacctcccagggtcaagtgagtctcatgcctcagcctcctgagtagctgggactacaggcatgtgccaccatgtccagctaatttttgtatttttagtagagacagagtttcgtcctgttggccaggctggtctcaaactcctcacctcaggtgatccacctgcctcagcctcccatagtgctgggattacaggggtaagccactgcaccttgcccaagctcccattctttctgtaacctcaagatggtataaaatcatcaaccatctggctatctctttgacttcctatatttttttgactcccttgcatattagttcttctactaatctgccttttttcagttggtttttcagcagacctgcagagggcacaggggaagtgttcctttggcccctgcagcaccacaggaccccaggtcctgtctgtggtcgtggtggtaacgggtgccagcctggaccagtcctgcatcgtggagcttcactctggacattctaaggggcagactgtggctggggcgtgagggataataaaggtggtgtgaccgaagcctcctgtctatactgtcttttctctcccctttctctgacagctcaacatcctggtggatacaggcagcagtaactttgcagtgggtgctgccccccaccccttcctgcatcgctactaccagaggcagctgtgagtcctggggagagcccgggggaagtaccttttccaaggatccagggctaagaagggtcaggggaggggtacagagagaaagagttgatcctcagattttcttcttgccagggaaggggaagggcgaaaaaaagacagtgaccaggagagacagggtgaagtgggtggtgagaggagctataccatgggaaagggtgaattgagaggtagccaggaagtgcttcagtgctgagacagggcagcctcctgtgggagggaaaggaagaagagcccatagctcacagaacaatcttagggggcccattttctctgcctgaatggggagacgaaaaccccacatcccctcggtgtctctcagttctctaacaccagctaagtctaagctgaacaggcctcagtgacggctccccttgctgtgttcttacccaggggccactctaggtggctttgcatagtccaaggacatgaaggaaagggtctttcataaacccctctgcctagaccagtatcagaactgaaagctgaaatatctcctccatgcaccacccagggtgccaccagttggattcagcttactggtgaaaggggggttgaagaggactggtgaaagtgggggactggtgaaaggggggttgaagtgggctttaagataagaggcagtgaggggtaatctggaagcccccttagcataaaagcaggaagaagaagggatgagaggacaccaatatctgagacatcagtgtgtgcaaacgtgagtagaggcttaaatcctatccttggacttgtaggcagctgcaaaacgcaccttccctgtttcctctaatgtcccaatctaaaagaagcagtcagggaggagggtgcaggtaggatcgatgaaagggcattcactccagttcctcgttccagttccatcactgcccccaccacacacagaagccctggttagtggtgtgattaaacacaggtggggctgccacatgttgagcacgtttcacagaagtggtgtgtaataccaacctgcttttctgagatgcttgaacaaaccccttctctagaacttgctgtagaggttccacattcaccctgcctggcactttctctaccactcggatggtaccactaggttccaaggcagtaagagagtcaatggttccttttctcggggagcttgacggagccagagggcggaagagatgcccactagctgtccctgcagcagcagcagcagcaggcacaatgcacaaagcccaggcttgttcttcacagggcctgagctcaagatctaggaatatgagcaatagataggagagcaagcctcaccaatggttcccttcatctatctgcaagcccactttacactctgttctgggtggtgagtctagggatgttttgctgagcagcctgaaagcagactctaggattcccctgagatgagataaggtggtgtttgggagtaagtttaacttagatccttataccagttgtggttatgcatccacagatctctgccttctttccacaggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccagggtgagaggaacagggcttggccctacacactctatgcacactgcactatacagagaaggaattaggagagagaaggggaattagcagaaggagggcaacaatcagtttaaaggattatttaacaggggtatagggtggcagtctaaattttagccctatagagggcagaaccatagtgacagaagctgtgataggtacaagaataggctgtgctttctatgtactcttaagatctttttttttttgagacggagtttcactcttgttgcccaagctggagtgcaatggtgcaatcttggctcactgcaacctccacctcctcggttcaagcgattttcctgcctcagcctcccgagtagctgggattataggcgcccaccatgacgcccggctaattttttctatttttagtagaaatggggtttcatcatgttagccaggctggtctcgaactcctgaccgcaggtgatccgctcacctcggccttcctaagtgctgggattacaggcatgaaccaccgcgaccagccactctaagatctttaataaaggcccccataaatttgaagcaggttaggcatagggggatcaaagatatatgaacctggccaggcgtggtggctcacacctgtaatcccagcactttgggaggccaaggcgagcggatgacctgaggtcagaagttcaagaccagcctgaccaacatggtgaaaccccatctaccccatctctactgaaaacacagaaattagccgggcatgttggcgcatgcctataatcccagctactcaggaggctgaggcacgagaatcacttgaacccaggaggtgaaggttgcagtgagccgagatcgtaacattgcactccagcttgggcaacaagagcaaaactctgtctcaaaaaaaaaaaaaagatctatgaatctgtgaacctatcaatactgtcctgtttgcattgccagggctcctgctaacccttcctctgccaaatctcagtgccttaagatggtctttcccaaggagcatcccccaagccttcaaatttgccttccagtttagacaggaagctggcctctgcctttagggccgtatgaggactcactccttgtctctttctgccaaagcctgacgactccctggagcctttctttgactctctggtaaagcagacccacgttcccaacctcttctccctgcagctttgtggtgctggcttccccctcaaccagtctgaagtgctggcctctgtcggagggagcatggtgagtaggtcctcagagaggggaggtcctggcattgagggagagatgggtgccatcctctccccttcctgaaagctacaccacagttttggctccgatacttagaatcaggaggaacctctttatattccctacccttactttatttttccattcttttcttttttgcgttattccagaaaggaatcaaggcacctatggtaaacttggaaaggaaggcaattaggaaaatttcaaaggaaatgaaaataagacctgttgaattaaaattattcagtttgatggtcagaaggcagagatataagaagtttgtctatttattaattaattagaacaatggtgaatggttctccaataagcagagaaaataaaacttataatataaacaaataaccattcattcaacatttattgtggcagtttagatttaaataactttatatcaagggctgtatgattctgaaacaaataattaaaaatcccggaaagtcttttctcctgaacacatttaagaaactagaaatcactttgggtatgatttgtttagaagcaggaagatgaaaagggtagcctgtagaagaccttgccaccccaagaaatcactgatcttattgcttggtccttgggggactcactctccttctgtgccaggacacgggtacctgcctctttttttccctagatcattggaggtatcgaccactcgctgtacacaggcagtctctggtatacacccatccggcgggagtggtattatgaggtgatcattgtgcgggtggagatcaatggacaggatctgaaaatggactgcaaggaggtaagaaaaccaagggagagcctgggaacataagggggtaggcagtacaatgtgaaggaagactctggttatcatgttgggaggatgaggcagaggtaataggacctgcagaaagggttggaagttgagcctagaacagtcaggggcttaatggtcacacagcaggatctgcggtttggggcctagggactggtagtgaaaaaaaaaacatggaactagttctgatgtctggactctagtcactgccttgcttcgtagccttgggcaagtcttttgtgagacagggtgatagaatgaagagtcttgtctttggagtcaggaagacccagatctgaatctagctctgatttgtactagctatgtacccttaggccagttactattctgtgtctcagtttccttatctgcaaaacaggtaaaaacaactttctcagaatatcagagataatgtgtaaagtgtttatctctgtggttggcagtactcaataaaaggtaactaaatcatttatgtcttccttccctagattcttatgtatgttaaattagaatagatataaatgtactaagaaaagttaaaagcggccgggcgtggctgtaatcccagcactctgggaggccaaggcgggggcagatcatttgaggtcagaaattcgagaccagcctggtcaacatggtgaaaccccatctctactaaaaatagccaggcgtggtggcaggcacctgtagtcccagctacttgggaggctgaggcaaaagaatggtttgaatccaggaggcagaggttagagtgagccgagatcacgccactgtactccagcctgggtgacagagctaatactccatctcaaaaaaaaaaaaaaaaaaaaaaaagaaaagaaaagttaaaagcactaaacaaggtatttttattttcaagtttggagactacctgcccacccaagattaacaagaataaacatttaccaagtgccttctctctgctgggcacgattctaagtgctttacattgctgatttatttaatccttacaataaccctttgaggtaggtgctatttttatcctcactttagagatgaaggaactgaggcacagaggttaacttgtccaagcaggtacacttaggaggtgccaaagccaagatgccaacccagctggggccccagcagtaaccccctactgcccagagcccagcatcaaaaaccttttgactcttttaactctctcttttccctcttagtacaactatgacaagagcattgtggacagtggcaccaccaaccttcgtttgcccaagaaagtgtttgaagctgcagtcaaatccatcaaggcagcctcctccgtgagtggactaaggatgggggtaaaagagatggtacagtgtcagagggaggcggtgagagtcacattcttcagcaacagccaagatgtctgcacttagacccttctactcagagctcttaaaacactcttcccctagccaggcgtggtggctcacgcctgtaatcccagcactttgggaggccaaggtgggcagatcactaggtcaggagttcaagaccagcctgaccaacagggtgaaatcccatctctactaaaagtacaaaaattagctgggtgtggtggcgcacgcctgtaatcctagctactcagggggctgagacaggagaatcactttaactcaggacggtggaggttgcggtgagccatgattgcgccactgcactccagcctgggcaacagagtgagacactgtttcaaaaaaaaaaaaaaaactcttcccctttatggctgtcactttgctcatcacacaatcccccggtacaaaagtttgacatcacactccctctctcttcctgtaatcctctggttggtttacccctccccactttagatatttcactggaaaagcaaatgaagggcccagttaatgtatctgaacatgggaggggcgagatgataaagaggcttttcctcattgttatccccttcttgccaacacagacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcaggtatgtcccagcctgagtcagggggatctctcttaaaagtacacactgggagacagtgagcaggtatggcttgccagaacttggaagacaaaacagatgagtagtgtccagcagtaaaggggtctcagaaaacccgttagagctcagggatggtaaagggaagggcatagatgcctacaaggcagagatggggtgaaggagagtgaggaagacactcaccctgtgattgcttacccctagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatggtgagagtgccagggctgagggtttggggtcagtctctccatattttccttgtcaaacaacagttagtatacctgggtccctgtcagtttaggggagggtagtaacagttgcctcaaacccaagtcaacagttgtgcaaaagctagtgtcaatgctcgtcctttttttgtactgcctgccataatgaccactgcctggattggtaacctctgttggaaacccagagcagcaagagttacctgggtaccttgggaagctcttgatgcaagggtagcagactgagtctatagtgaccctgtcagctgccacatggtgaggctgaatgctacttcagaaaggtggcagggttttgcagttggatttcagcagcagaaagttaagtttactagatttggcttttggtcaagggggtggcttttggtcaactcagaactactgacttttagttatcactcctaccagctgggtatacaaggaagggctgctgctcccagtgacttgggaagggagacaggcctctacctggtgctggcttcccagcctgctcctaaatatctcctgggaaggagattagataacttctgcatgggctaatttcaaggcctcactatcaggaagttctttttgttaactcctctatgacaatgagagctgtccattcacatttgccctctccccagtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagtattcttcttttcttagtttcagaagtactggcatcacacgcaggttaccttggcgtgtgtccctgtggtaccctggcagagaagagaccaagcttgtttccctgctggccaaagtcagtaggagaggatgcacagtttgctatttgctttagagacagggactgtataaacaagcctaacattggtgcaaagattgcctcttgaattaaaaaaaaaaactagattgactatttatacaaatgggggcggctggaaagaggagaaggagagggagtacaaagacagggaatagtgggatcaaagctaggaaaggcagaaacacaaccactcaccagtcctagttttagacctcatctccaagatagcatcccatctcagaagatgggtgttgttttcaatgttttcttttctgtggttgcagcctgaccaaaagtgagatgggaagggcttatctagccaaagagctcttttttagctctcttaaatgaagtgcccactaagaagttccacttaacacatgaatttctgccatattaatttcattgtctctatctgaaccaccctttattctacatatgataggcagcactgaaatatcctaaccccctaagctccaggtgccctgtgggagagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagtcaataaacctgggcaagtgaggcaagagaaatgaggaagaatccatctgtgaggtgacaggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtacatggaggaattgggacctggttatgttgttattctcggactgtgaattttggtgatgtaaaacagaatattctgtaaacctaatgtctgtataaataatgagcgttaacacagtaaaatattcaataagaagtcaaactactagggttacttttttttcctcaatcagagtctcattttatccatttggagtagagtggctaaaacaatactgaggcttctggaggctttcggtaagcaaggcatctggttggacagtgggtgagcaccaggctttaaatctgcatacatgagccttaaggaaatggactagaggctgagccaaaccaaagcagaatggccttagagcaacagcaggttcctaggtggtttttatattgtatttgaaaacagccctgggcagggatatcataatttcaaggccaaactaaacatcatcttccctacaatctgcatcccccaaaggaattgcaagatgagggggaacagactgtttctgcataatatacatagtttcatttacgaacattggaatacagactttctatacacacattacctatataataaaaatgtacatggcatgagtatatgtcactgtataaatatagagttttagaaatcttgaacccgcgcttcctgttcacatcagtttctcttcttcttcctccccagtcaggtccgtcatttaagagttggacaaaagggacaagtgtcatttgtgttggtctgggcccagaatttgatacactggaaagaaagaaagacacacctcaggtttatctggaaaaacaaagggaaggaaggagagaatgccaataaggttcaacaaggcctaagtcagaaaagttcttacactgaggtacaagaggggctttttttgttgctgttcttttttctttttttgagacccagtctcactctattgcccaggctggcgtgcagtggtgtgatctcagctcactggaacctctgcttcctgggttcaagctattctcctgcctcagcctcccgagtagctgggattacaggcgttcaccaccgttcctggctaatttttgtatttttagtagggatggggtttcactttgttggccaggctggtctcgaactcctggcctcaagtgatctgcctgcctcagcctcccaaagtgctgggattacaggtgtgagccaccgcgcctggccccaagaagggctattcaatggctcttaccctaaaagaatcctcagtgcaagtgaacctgtcctttttatgaggaacattaacaatgagctgttgaaaatgttcatgatgctgctttttgttgaatgtctagtgtggcttgctcccccttaggatccattttgcctgagatgagcatctctgttctaagacctgacaccctcaaatcttattcaggaatttttcttaccaagaatttagatgtaaattcagtttctacctcttggaaaagcaaaatgaacaaaacaaaatgttgttaagagggaatcatccctgctactaagagacttaactctgctggcaacataaaaaaataggaatgacttgtcagtctgtgaagataatctctaaccggcaagccctccaagctgttctgttaatggagttactaatctcatactcaggtcctccattccattcctctcatctaggcaaagtcttctgacaatgctacattttgaacaatagttagatatgtgggattatcactcattgtcaattttccaagaaagttatttagtgcgcagtatgaattgcttatccagtcccctgaagggaatggggtaaaaagctgagagatcctaactgcagtattctgaattctgctaatgtttaagccacaatttactgaaaaccttatgattagacattagagaccaggtgcactggctcacgcatgtaatcccagcactttgggaggctgaggcaggaggatcacctgagcccaggagtttgggaccagcctgggcaacataacaagaccttctctctactaaaaaagaaaaaaaaaattagctgggcatgatggcatgtgcctgtaatctcagctactcaagagactgaagcaccttgagcctaggggattgaggctatagtgagctataatcgtgccactgcattccagtctgggcaac

SEQ ID NO: 16125 - DNA, 41613 bp, Human
tcatatttcatgacagaaaaacaaatttggcttcccattgcccttttaagagtaaagaacttttcccaaagccttcagcaaatctgtccttattgggccagttacttgcccattcctgaatcaataactggcaggggaagttatgaaatccacctaaatgtccatcagcagatgactggattaaaaaaaatgtggtacatggcggagcgtggtggctcatgcctgtaatcccagcactttgggaggccaaggtgggcggatcacaaggtcaggagatcgagaccatcctggctaatacggtgaaaccccatctctactaaaaaaaaaaaaccaaaaaaacttagctgggcatggtggtgggcgtagtcccagctactcgggaggctaaggcaggagaatggcgtgaacctgggaggcggagcttgcagtgagcctagatcgtgccactgcactccagcctgggcaacacagcatgactccatctcaaaaagaaagaaaagaaaatgtgctatacatacacaagggaatactattcagcttttttttttttaaaaaaagaaaactatcatttgcaactatacagatggaattggagaacattatgttaagtgaaataagctaggcacagaaagactaatacaacatgttctcacttattatatgtggaatctagaacacgagaactcagagaagcagagagtagttgccaaaagctggatggggtgggggtggtgggaatgggaaaaataatgatcaaagggtgcaaagcctcaattagacaggagaaataagattttgttctttgagatatattgtacagcatggtgaatatagtgaataatatgtattacatatttcaaaatcactaaaagagtaaatttcaaatgttctcaccacaaaaaatgatgaatatttgaggtgatggataggttaattagcttgatttaattatttcacatatttatagatcatagcaacactttacatccaataaatacatacaactataatttgtcaatctacaattaaaaataaatgttttctaaaactggcaaaaggaataggttgcccccaccaatcatttaactctttaagttaagttctattcctcagaaggtactgctggtatgctcactgggggattgtggggagaatggaatagatatttgaggcaccaaccacaaagtccgctacaacttccctccaatgcactctgtttccccagtgaagaaggaaatctcttgtttgaacatgtgtgtatgtgcgtgtggcatttcagctaattgaagacccagtggagatcatcagcagcaaactggaagtccaagccttcgaacgcattgaagactacatcaaactcattggctttttcaagagtgaggactcagaatgtaagttgtctgccaaccccagccgatcagtctaaaagctagattccaaacaaggtatgtcaggttaccccaaaagaggatgggtcttcagcacctcttttgctgggtagaatagaagttagaattcttcctgagcctaacacagtggagtacatgtgcaaaaattgtacaaaacagtcaggaaagctgcaagaatattaaggaggggccaggttctccagctttaaagcaggctgagtgttctacaaaaaagagaaaagctcttctccacttttcctgcctacccacctcccagtcggattctcccctacaatgggacaagcaatgggctgtctccctggcattggtagctcctatggtcaccagctggagagctttgcagtcaattggaaagcatgagtggaaaattggggtagggatgggcttagcagtggctacagaatgtgaaaaatcgctggccaagcccacagctgaccaccaaggctacctgtcatagtgcagccacacccttggacatattccctttgaaagctttgtgaccaggttttgggtggacacagaacctatgataacatcactacagcccatatagggatgagcgggtggtgggggtgagtcaggaagagcaggcagaagggaccaggaggagtaagcacttgagtactgtacatatttaaaactgctttggcagcatggcccccgtgaggtaggcttttttctggtatctcagccttggagagaggaacagcattagagcgggtgagcataactctggtagcattcatacacgtaggaagtacaaatgtgggctgcttatgactatttctgagaaccccaaaatattctgaaattgtttgcaaacccatttctttaaccagtcttcccactagcatccttagtcacctcatcaacaacccattcattttctgtctcccatgccccaacttaaccctcttttcatttgcttcattaaaacctccatttacagtgcttaaaatgaatgtgctagagggaggtggctaaccagggagatttgccccagttcttctttaggcaattttattttagtttgtacatttccgtatcagtgctgactactctggggtgcttctccttccccttccttttcagttcgtctgtctcaatttgtttccatctttatgttcctctatcctcttcatccatgtagctcaggatggcagataagagggaagcaaaacaaggttaggataaagagcacacctttcagtacccttggcgtcttcccccgcctagacgaatcatcatgataatagtatttaattaacacatttcatatgctagggcctatgctaggagcttatatggatgccttaatttcattctcacaacaagcctgtgaggtgattatcattattacctgcatgttaatgatgatgaaaggatggaacagaaaggtgcaattaacttgcccattatcacatggctagtatggtgtacaaaagtaatatgaaatatattacatattgcattgtaaaaaacctccaatttttaaaaaaaattttgaatgagaatcttatgcttgcctcaagaatatagcttttttttgagacctagttttgctctgttgcctaggctggagtgcagtggcatgatcttggctcactgcaacctctgcctcctgggttcaagtgattctcctgcctcagcctcctgagtagctgggattacaggtgcccgccaccacgcctggctaattttagtgtttttagtagagacggggtttcaccatgttggtcaggctggtcttgaactcctgacctcaagtgatccacccgcctcagcctcccaaagtgcttggattacaggcatgagccactgtgcccaacccaggatatagctttttgatattaggttttatgcttaaaatagcaacatgaaattccttatcaagattttaaatgatgatctcttcaaattcttgatggtcaccttggacaagagacttcacttgtatatgtggatagtgacaaatgggaggacaatatccattgctttttctatttttttttttttttttcgggatggagtttcactcgtgttgcccaggctggagtgcaatggtgcaatctcggctcactgcaacctctgcctcccgggttcaagcaactctcctgcctcagcctcctgagtagctgggattacaggcgcctgccaccatgcctggctaattttttgtatttttagtaaggatggagtttcaccatgttggccaggctggtctggaactcctgacctcagatgatccacccgcctcggcctcccaaaatgctgggattacaggcgtgagccactacgtccgtcctgctctttctttgactgatgagctttctttttttgccattggacataattcagataattccatctctaaagtgtccttcaagggcacttagttcaatctgacagctatcacttttcttttcattgacaaatgtaatgttcatattccttataataatttgaatgaatttgaaaggattacagatcttaattaaattttgtatatcatcaatatttcaaaataataatgaagcttttccttaggaatacacagatattgctctactgatcttaataatcattcttaaaatttaataaaattgctagtgaatcattttaacctctttttaaggttgaatttttgtttttaaatgtataaactttgttagtacattatatatttcacgtagcccttgcaattttcaattaagtacattcaagtaggtgtttagcaagatctagccttttttgaagccaataatgatccctcaaaatattttcaaagtaagcataattcatagcatagttttaaatctagtttttagctaataaactctgtaaaattcttgcgcagttaacccactttaggatgaaagagcagggagaggtctcctgaacccatttcttcaccaaaagctataaagagaaggagttatacaggtttgaatgttattggagtcactttttaaaaataacaacctttttgtggaatgcagattcacaggcaaacctttatatgatgaactttttctctgaataaatattatttgaatctcaagattttcagaaagagcttgatgtaaagcctttacactttcttgtcattgtagctgtactatcagtacatgaacttggacattcaaaatctgacttcagagtttaactgtgtatagaattcatacactataaagtttatacatttaattgtgtacacttattttgtgcagtgctttcagaatctattttgacatgtttatttacttctttgaatgtttcatccccaacaaattggtttggttcttctttgtaagacagatgatattattccaagcatttctggtcagggtttctaactggtgccatcaaccacacccagttactaacgtctgtgatactaatatccagtacgcacaaccctgagagagggggaagaaaggagagaaaatgctaagataagtttttagtaagctggaggctgggaactcaatgttcaggagcctattccagaagccaaaagagtcatcaaagaaagtgggaaaggggtctgactggaagggaccaggaacaggctggtcaggaggcagggaaagcctagagatgacctgagctccaacagagcagaagacaagaggaggcttcttggaaaacaactgctgtttggctgaggctaaaggtcaagccacattttgaatcacccatctggaggtcaccttgctccattcttcatcttaaagtgatgtagaccagctctccaagagaggaagggaagctcctgacacaggcctaagccattctttccaacagggtgggagttcatggaggggaagagaaattcatcagggacatggggattggaaaagagggggatagaggattctgatagagcccactgctgctttagacacagatggcttaggtgttgctttagccattctacttccttactttcactccattcattcttcaaatgctctcagccaacttctcccctccacccaattctcgaccccagctatgatgttacaggatatcttttctgactacctgcttacttttatgaggacaagttagtgtgagtgtgtatcagtatgtgcaagtattctcatgactttccaacccctctctcacctgtgcttgcggcactcacctctgttgtaacaactatcatgctgcattttgattctttaaggatcaatagctctctctaggctgagagcttttgaagatcagtatctttgtcttattcattttggtatcctctggattaacattgttctaaaaaaattttgatagaatcttagtaaattctgcatggtcccagaattctaacaaaggcttatacttcacacggttaagggaaatggaattccatgaaatggaaagaagctaatcttgttaagaataaatcacaggctcattgactctcaggcttatagcatttattcataaccaccaccaccaccaccacaattaccatcaccctcacaactaaggtttgaggacaaatctctttcccaagtaactccccaggtgtaccaaggttcagcactcccacactcacctgatctcatactgcctcggccagtatggactcaagtttgagaccatagtcaatcaagagcttgattaagtttaagaaatcctcttgaggcatcagaataaaaaagaaaactttaaaatgaaaaaaagggaaagaaaactagaattcagcaacaggagtacttccatgaagaagtttaaaatacttctgtgatgtcaattgtgattgaggttactttacactgtgagacgaatttccttcttacttagggctcatttattctggcaaactgcactctctctagagggcatgattataagtagcagtgagttagaatgaaaggtctttttattttggtttggagttttacgcgtctttttctctctcttttcctcccggttccctctgtttcgtgctttctacctgcagttcataaaagtgtggtgaatgggtcttctcttgggcgtttgaatgccagtcaattccaactccttggggggaactatgggcttaaataatattaaataacatctatgtaaacaatacctactaaattattatccaatcaggattaattggctttctactctctacaccatttaaaaagaagattcttctgtgttcatcttgaaaatgtctctcccttcatctttatttttccccttagactacaaggcttttgaagaagcagctgaacacttccagccttacatcaaattctttgccacctttgacaaaggggtaagtacctatgaaaccccaatttgaacagttttgtaggcatgaagaattaaagtttgaactctcaccactctttcttttcttttagcaacattaaccatcctcccttgcctctttctctagaagggttaagaattatatcactaaatcactattggatttaagatgagtacaaagatgactaagtcagaggatgtaaggatatttatgaaaacatccaaggaaaagtgatgacccaccattatcttcttatacactgagatgggaaacgtgtgggcccagagtgtgccagcccactgagccactgcttcctttttccttagggggtatcctctcccttcctggggttgcatacttccccttctactgcgtcaggatgggaagtagaatgggaactcctctgtgattagttcaagcaagtgttctgcgaaaaacaagaggaagtcagtgagctgaagcagggaagggacgtggtgggatgagattgcattcagttcatgtatatgatgaaccacttctgtagacatggcccagtcttcaagcctatgatccagaagagtgctctataatccaagtaacataatctaaacttgaagaatgtttatcctaattagttgtattacagttgggagggatcttgagcaagaataatcaaaaaagctatcatgtattaagtgtctattatgggccaggtgctgtggctcacacctgtaatcccaacactttgggaggctgacgggggtggattgcatgagccttggagttggagaccagcctgggcaacatggtgagaccccatctctacaaaaaatacaaaaattagctgggtgtggtggcacacacttgtagtccgaactacttgggaggcttgaggtgggaggatcacttgagcccaggaggttgaagctgcagtgagctgtgatcataccattgtactccaacctgggcaatggagtgagatcctctctcaaaaaataaaaatataaaaaataataaattcaaaaaaatttttatgtgccagagtctgtgctaagaagtctctttgtgccagagtgtgtgctaagaagttaacatggattttctcacttcatcctttcaacactcccataagggaggaattagtatcctcattctacagaggatgaaactgaggtgctgaaagattaagtgattttttcatgatcatgtagttactgaattgagaagcttgctataatctcagaccagcctgacttcaaagtcaatgctctgtcctactttactccagagaaagaagcaatatatgcaaactgcctagctggtttttggcacacaggaagcattcagtaatagttagccagctatgagcaccattgttcataagaaagcaatcatctaggcccaggaagtgggaggattggataggatattagtagagaaagggaggaacagagaagccgaaactgaatccattactgacatatggttctgatggaccatttggttctaatggactaggtgtggctaaagaggctcctgggtaagaatccagctgaaaggaatagagaggcaggccaattaatttgtccagcaacaaagccttagtttttagaggggtggttcaacgttgagctcagggtagtatttgtttgtagaagtgcctcctagtgcaactgtatagcttcatgcctgtggtccatgaaaaaggtgaggtcaggctatgattaaaaattcagagagatgctttattcaaactctgtaggacactgagtcataagtgccagtgttcatgtagccttgttggatttcagaatatttaaagagacaaaggtacacagaggggagagcactgagaggactctgatgccatttggtgcttaagaacttgcatccatcagttggggtggagggggtgtccaaggggagatggtggagtccagaaggcatgactgcacctggtagagcctcagtggtttccagcagggagtgctaggacagaagaggagaaaagtaataaatgtgaagtggctgaaaggacctgtttgtacaacacatcctagggaatctcagagggacctggaggtgctttgttgaggtctgaaaccaggagaggcaagggacaagaaagcactaatgcggtcacaaaaatgcaaaaaacaactggcactagtaaaagtggatataacaagaagatctggccattgatgagatgatgagagaaggcctcaaaataacttaagatagcaagtcttggcgttaagacagcaaaaattatgaagctactgaaaacattaggaaatccaggaagaagaatctattgaggaacaagagatggggttatgagttctattttctaaaagttggggaaacattcaactggaaatgtccttaattaattaattaattaattcagtcattcactcaacaagtatttattgagtgccctttatgtgccaggcactcttcttagtgccagggacacaacattgagcaaagcagattcctgccctttagaatttaaagtttattgtgggaaagagaagatggaaagacagaaagttcaaaagtaaacaaaccaataaatacatcatatgagttgcaagactgtaaagagggtgagatgtcatggctgctgatgtaaatttgtcagtcagtagttcccaaccactatccatattagtatcctccaacaagcttttaaaaccattggtctctgggccccagccctggaaattttaattttttagggttgtgccagtgtctgggaatctgcattttcaaaagccacccaaggaattttaaagggtgtggaggtttaggaccagtactgatctattaatactaatcctaaatcaagccacacgaaggcccaacctctctgaagaagcagttagaacaagaaagtgtcagagggccaaggatggttccactctgctgcacctcacagcctgaaaaatatcagttcttaaaatcccatgtccccgcccactgacctgttcctctctctgtctgagtgaacaatgagacgaaaaatcactttcttttttaaatcacactggggccaaagggtgctgtgactaaacaaagttagtggagaagatagatgttgggaagacctaaatttagtaatggcaaaaaccattacttttggcaaaaactgcgattacttttgcaccaacctaatacttgagttggtttcattggcaacaactaaaatgacttgctaactggaggaaaaatgatttgtatcaaaattcatatacatgcacatgtcagaaaattggcattgtactttgtagttttcttatctttgttgaaatctattccaactagttaacagataaaagcatgaaagaattcatttttatggacccatttggttcttaataatataattcattcttatataatgctaatacccatgaaccagatctcctcctggaataatgccttgggttcagtaggccccactaaatacttactgaataaatgaatgaataaaagcttcaaccaatcaaatcccttcagtccttaccatccaagataggaataataagaatgaaagagggggtcgggcgcagtggctcacgcctgtaatcccagcactttgggaggccgaggggggaggtggatcacctgaggtcagtagttcaagaccagcctggccaacatggcgaaaccccatctctactaaaaatacaaaaattagctgggtgtggtggcctgtgcccataatcccagctactcgggaggctgaggcaggagaatcgctcgaacctgggaagcggagattgcagtgagccgagactgtgccattgaaccccagcctgggcaacaagagcaaaactctgtctcaccaaaaaaaaaaaaaaaaaaaaaaaaaaaagaatgaaagagagggattctctgagatacaagatgagagcactccatgatggtggtaggtagacagtgaagagatccctgggaaatttttacttagcatttccaagacttaaattaaggacacgacaatccaatttttacattcttagacagcactgtggacccagacattggcattcagagacgagactatcaccaccaccaggcgggtttgacttctggctctgctccctccagatatatgatcctgacaaatttcttacccaaattgtgcctcaggttcatcatttgtaaaataactatgataatcattcttaccacatacaatcaaagtgagaattaaacaaagaatcaacctaaaacacctggcagcagtgcctggcacgtgataagcactccatatgtttgttattattactgttttcattctgatcacttctcctttcatggaaacagtcttctggttcctagaatacatagtaagtgaactcagaaaaccagaattcaatgtcattttcttgcccactctggctccctgcctcatcacctcatcatctacatcacccccctacccctgagaagagggaaaaacagttagaaaaaactccacgtctccctctcttaaaattaacctgacaataaaatctcccttgactgactatagctgtcaacatggcctgttttcttgatctctgagtaggatgctggaatttctctcccttaagtactatatgaaatgcctttcagaatatagtgacctggaattcatagcaattgatgacaaaaaccatatggatatcaatgtttcctcagaatggatctccttgtgtaagagcttatgcaatacccagctcctccccttccccagttagttgcagccgccctgggtcacggcaccacgggttaccaccacagtgcatcagctcttaggcaattcctcttcagcttaaagggaaccactgttcatccctgcgctttcttgaaccacagctctgaactagaaaagagtggcatttggttttctatagagcgttgcacattccaggcctctgaaatcatttcacaaacagaggtcctgagttcagcagctgtgcaggcaaacagcaaccattctgccttgacaacacactgaacatgtggctgctttaatccagagagaaaatgtcttcctggctatcggctggctctccgagctctttatctgttgtaagatgagcaaatcatcctggcttactggggtctgtccaagtttcagtactgaaagtcctgcatcccagggagcccttccacccagaacaaagcaagatggtcagtcacctcataactgctgacaaactgggcagctcccaaagcctgacaaaccatgaagcaagttgggtactgagagatttaactgtagggccagcacttcaacctaaaaagcaattagggctatgagcagatcaaagacaggctaatgggttgggttctgattctgagtacctatatgccttaaggatctccatcaattgcctgttttatcaacattggttccattaaatccatacaacacaggatagtaaatatgctccattggcatttgcttcccatccagccctggcaaatgcagtagagtgatggtgattgtagaattaaatttcccacttcgcatctcaactgctccctgcccctgcccgaccctcatttgctagataagtctttttccttcctatctttccttctttgatcacaaaagaagattagtctagccaggccttgggtgataagttcctgtcacttcaacattgaagttaaaactgtacatctgtttttatgtctttgccggaaaacatacacacttatcttagatggacaacacactgctattctagactagtattcaaataaactttgtcttatttctaatggttacaggttgcaaagaaattatctttgaagatgaatgaggttgacttctatgagccatttatggatgagcccattgccatccccaacaaaccttacacagaagaggagctggtggagtttgtgaaggaacaccaaaggtgcctgagatggcatgtgggggctgggggcctggggtctggggaatggagaggagcctctctgtgctaacatttcagacctgccaagagcaacaacctagttagtaccccagcagtacagaactcagtagtatggctttgttgatcagtaatgactagcagggatgttattacttctgaatctaagtctgcacctgcaagcagagtttgataaatccctcagtcagcaaatcccctcaaagccagggcaagatataaataaaattctatactaggaatgatagcaatttagtgaaagttcccatataccaataaccatgcccagtgctttagggaaactattttatctaatctccaaccttagggagtaattattattatcccaattttacagatcaaggaattggactcaatagttaagtaacttagccaaggatgaacactctatgcatagaacttctgggagagaaatgcttgataccacttagtgtagctccagcatggatcagcaaactttttctgtaaagaacaaaatggtaaatatttcaggttctgtgggccagatggcgtctgtagcaactacttgactgcggctgtggcatgaaagcagccatggatcatgtataaacaaatgggtgtggctgtgtaccagtaaaagtttatttaggaaaacaggaggccctggctggatttgtcccaccagctgtagttttttgacccctgctcttgagggagggaagatatgggaatatggaacatggtagtggactcactggcttgtccctccaccctacctggcatgtacacgagtgtgttcattggacctgcagtactgtgatccccctcacctggacagtcctagttccttcaggaaggcagtacttggaggagcaaatattaatatgtccagcactatttgccaatattcagaaagaaatgaaactatgagcaaaatatagatcctgtctgctcccctaaatatccctaaaggactttcaatgtatacaccagatgataaaacaaaggcagttttaacctacaaaatccgagatttcctgttttccccctcaggtttctcattccaggcctgctgtgggctctctggagtggtggctatctgtgaggaaggaaatggcatcttgccctgggaatgagctgaccctgtgccctctgacccattgtttgtaaaagactttataattcttggatcagtgggtctatgaaaaggctgagtgccttggcccagctcgctgtctgacacagcagagtagagcaggtctgtttccttagaagataagtgggtttttagggctctccctgccttgcaaaagaagcatcatctcattttacatttcataatgctgtggctgctgtgtctgccacagtgatccctactcaaggaagctctttctttttttttttttttttttttccagacccactctacgtcgcctgcgcccagaagaaatgtttgaaacatgggtaagaaagaggcaaactctctttgccttgtagagatgagtatagtcccaaagaggagtgcttcttagattaagtccccaaactcaaaccaagtttatttggctgaggtggatgtctagatgagtatttgaaacatggacagattgggtacgacggctcagaactgtaatcccagcactctgggaggccggggccagggatcacttgagttcaggtgtctgagagcagcctgggcaacatagcaaaaccctgtctctacaaaaaaatgcaaaaagtaaccgagcatggtcgcatgtgcctggagttccagctacttgggaggctgaggcaggaggattacttgagcctgggaggtcaagtctgcaatgagctgtgatcctggcactgcgctccagcctgggcaacagagtgagacactgtttcaaaaaaatgaaacaaaacaaaacaaaaacatggacaacttcatgctcaattaaaacacagttctccatggatcaatccaagcctctttggtactactcactaggcaaaattgctcttagttaatttcctgcagtgactatagcttctgttcattgatcatcagagccacacagtaacacagtggaaggaactcaggctataaagtaatagagactagggttcaagtccagaatctgccacctagtagctttgtgtactatgtcaagtcctgtggcctttctgagctgtctaaatttcctcatctaaaattgggactttttataaggatgaatatgaagagttcactatatggtagctgttttttaaaaatatcaactgaaggcactggcaagcagctgagccaacttgtcttctaggtttgtgtcatggataatatgtcaggcagctcaaacagtgttagatagagggccttggagataaacccccaacccacaccttatgtacagaagttcataaataacaaaggctgtggagcatttttcaaagcatttcatgcatctttttatttggatcttccaatagctctagaaagtgatgtagaacaagtattattaattagtcgggcatagtggggcacgcctgtagtcccagctccttgggaagttgaggtgggaggattgtttgagcacagcagcttgagacttcagtgagacatgataatgccactgcactccagcctgggcaacacagcaagactctgtctccccaaacaaacaaacaaaaaccaaatactattttagccccgtttgacatagtcagaaactgacgctcatacagattaatcactaaaagacacataactaaaaaccattagttcttggaacttaaatataagccatctggagccaaacctggtgttctctgcagaatgcctccccagagtgactatgtccccacaaggggccatttggtgtgagggctgggaaggaggagaaaggaattaacacggaagtatttatctgtttaattctttgaagtgatggatgaacagaaccagggagcaacttgacactgttttactggtctgtaacttacttggatgtttgaaggtagagcaaacatttcacaagataccaaagggtaaataatccagtccagaggagcggactatttaataacaactcagcacaatagaaacaaactttcctaacatttaaacctttcaaagatattaaaagggtcttatcgctaggcatagtgactcatgcctgtaatctcagcactttgggaggccaaggtgggcagatcacttgacgtcaggagttcgagaccagcctggccaacatggtgaaaccccattcctaccaaaaaatacaaaaattagccgagtatggtggcaggcgcctgtagtcccacctactctggaggctgatataagagaatcactttcatctgggaggcagaagttgcagttagctgtgattgcaccactgcactccagcctgggcaacagagtgagaccctgtctcaaaaaaaaaagagtcttattaatgtattttaaaatagtaatagcaaaaagatataatagtgctttaaaatagtattttttaaattgtttttgctttttaccctaaaataatttcagatgtaccaaaatagtgcaaagaacttcaatatctcttcacctagatctcccaaatgttaacattttaccatcccttctagctacatagatacatagatagatgatagatagatagatagatagatagatagatagatagatagataaatagatagatatagagagatatagatagatagatagatgatagatagatagatagatatagagagatagaattttcaaaatcaggaaattaacactgatataatacgtctactaccattattcaaattggccagttgtcccatcaatgtcctttactgcaaaagaaaaacgtctctttttcctggcccagaatccaatccaggattccacacttacatttgcctatgtttctctttctttttcttttattattattattttttttgagacggattctccctctgtcacccaggctggagtacagtggcaccatcttggctcactgcagcctctgcctcccaggttcatgtgattctcctccctcagcctcccaagtagctgggattacaggtgcataccaccacacctggctagtttttgtgtttttagtagagacagggtttcaccatgttggccaggctggtcttgacctgctgacctcaggtgatcctccctcctcggcctcccaaagtgctgggattacaggcatgaactaccacgcccggcctgcttatgcttccttagtcacctttaatttggaacagggtcttggtcttcgtctttcatggcacaaaatatcactttaaattgagagtcattattgatgttctcttctgctgtggctttatcttcagtttttttctttttattgtctttattcctaagaggcaagtctcaattatctaggttctaggaagggagggaatataccactatggaccccttctcccaggtctttccttcctgtcatagcagtatcactcaagaccatggtgttctgtagatggggagcctgtgtcctcacatatcccacactgctacagaaatactccctgttgacacattagaggcagatgttcagaaaggaagttcagtgtctggtttcattggaactcattctctcctttcttttcatttaatgaataagataaaatacagccttttgctataatataaaataatggtgatggctcatattttccacattattgcatattgaattgttcttaacttggggaagagagcagcgtattgaatttaaccaggcagagaaaagggcaactgaaatggtttattccttccctccccgttctggaacagcctcatgtcttacccaggaaccctaaccagacctagtcatcccctcattcaagtctccaactagggggaaggcaggacaggcctctccagtgtcatctttgtttccttgaaagggagaaacagaaatcagtccatccaaaggacctctgaggagccactttccataccccctcctctacctgggccccctagcaggtcactgctctaaagagtgccatccctgtgggccacgtggccacagcaacttaaaccacagatgtggttgtggaaagtgaccagttaatgaacttcaaagtctttttggccaggcaaggtggctcatgtctatagtcccagcactttgggaggctgaggtgggcagatcgtttgagtcaaggaattcgagagcagcctgggcaacatagcgaaactccatctctgcaaaaaatacaaaaattagctgggtgtggtggtgtgtgccaatagtcccagctgcttgagaggctgaggcaggagcatcctttgagcctgggaggcagaggctgcagtgagctgagatgtgccactgcactccaacctgggcaacagagtgaaaccctgtttcgaaagaaaaagaaaggtctttatcttcaacatccacttccccagacatctacttcccgagacattgagaaatatttaaataagatgggaaagccagctaggactaaaacaactattgatctttctctcactctaattgtgcaggtttttaagatgcaggccatagaaaacacatcacatatgattactaaagaaactggtgcctggtaatatttgctgtgtgtacattggaaagctatttatttattttaaatactcaaagaatgtcaagctgaggcagggcaaaaagagacccagtgctgatctgtcattccccctggagacctcaccctccatctagccaagtggcccgctggagtcctggggaactgcccacagggaaggagagtcagcaatttcttctaaaagaagcctccctatattgcaacaacaaaatactttcaagatggggtcagagacccccagacaagcatctaggtcactccattgcaccttaaataggaagcctgcttattttaaccgcatttttctttgcatctcttcattcaacatgagaacaaacattcaacagagactggaaggaaactgagtaaaatattaagtggtaatatatgttgttggtaggtaattgataagcatagtttcttcttggtatacctaatattttctaattttcttcagtgagtaaggtttttattgccatactccttttttgagtctataggcgttaaaaagaacctctgtgctaaacaatgaggttataaaagctaacattgctgtcctgtccttaagagctcagattaagtagacgaaacagtctcaagacatataacgccagcccagcatgctcactgctgcgacaggggggcgtacaaagtgctggggtatccaaaggaagggattcactgacgttattcccaaatctccggttctttgggaaatcttgcactcagttactttatatacaggtctctttccagcctctttcaacttaagagccattgatccaagtttacaacattttctgcaaaccctgcaggggaataaattcatggagcctgttctgctggtggtggtgagaaagaaagagtacaggttctgtggtctgaatgtttgtgtacccatgcaaattcatacattggaatcatagcccccaaggtaatggtgtgaggagatggggccgttgggaagtgattaggtcttgagggctgaactctcatgttgggattaatgccctaaaagatgccccagagagctagctggtcccttccaccgtgaggacacagcaggaaggccctgcttctgagccagaaagcaggcctcgcgagacaccaaatctgccggcgccttgacttcccagcctccataacagtgagaaataaatttctgttgtttataagctacccaggttttgatatgttgttatagcagcccgaataaaccaagacagtgggctttggggccagacagaactggcttgaatcccccttctgtcactactagttctgtggccttaggtaagacactttgattcttcaagcattcaataagaataagactttcttatgagattttgagataatgtacttacaaagtaagtacagaaaaagtggcaaatagcagatattgttgccactttaataactgttgttatcttaaggcataatcccttcttttagtgagctttccatctagttgaggagggaagattcatgcaattaaaaacagaatttccaagacaacctaaagaccaaatgagagatctgggtagcaaaggctgtgggattcagagaagccccgggggttctcagccctgaagtcagcacagctattcctcccctgtgcaagctgggttctcactgagtaaccccaacttgccagcttgcccatgggttctggctctgtgagtttattacttgaaaatgcctggcacctagcgctggcctgcttccttgtggatgtggaatacaggtctgcatgctgaatctttgtgacgcacacagtgacaggctctttcccttggtgacagtgctccctccagggaccatcttgggtctggggagtgacagccgtattatgagcagccttctagaaaacaaatatggattcttaattctaaagccaattccaaatgcgttctagcagggcacacagaaatgaagcctgcttcacagaattaacagcgctcactcccatctgatggcaggagacagagacacaggctagcctaatgagaactgatcgggatattctgtctggcgataatagcaaatgtaaaacagtgaaacctcagactccccttctggttgctgtcggatttgtgtaataagccggcacacacaggcacacacatgcgtatctgtaaaattaaattctccagagaatctgaccaaggcagtgcccactgtcttgtttttaataataatattttccatttaatctttcttagaatttgtggaggctttgtccattccaaactcaaaggaaaaaaattagcatttagataggattgcgccagcattaaaatcaattgaaatggaaacagagatcatgggaaggttgagacgcctggaggtttttccataggatgattctgatatgatgttcagggtgcccaaagcatacctctccccatgtctcatcatcactatgcactcggccttgtccccaggtgcctctttctcacacatattcctccccaagtctcctgagaatcacatttgtgatagcagagccccttccaagctctagctcctctttctccaggaataatcattgcaaaggagacacaaggcatagggtccttgctgcccagggtgtagagacatgaaatgcgccttgtttgccccatagacttaaaatactctctctaggttcttcttcctgcccctgcccccacagccatacaccacttttctcaatcgcacaccctcaaccttccttacgctcaaattccagacaattcctgcagcctcagaaatgcactggaggcctatactgactgggcaaggacttcaaggaagtcacctagaggccaattctagcagtgtcccctacacactacatgggttctgtaggcagggtcctaacagggaagcacaacccttgtctgtgattcttgtgtgaacaacaccagcccacatcctaattgacctcaatgattcctgtctgccatccatttggatatagtttcaggatctgtccacagcattcagaagcctccataatctggtgtatcactgactctatctgccagtggtaaattcttgaaacagagactgacagctgcttttactgagctgcctccagagccattgttgctctcagatctcctgataaaccagactcatgttctttctcattttgccttttactgctgcactcctggaaccaccagaccacaggagtgaggctcatttagtgctaatgtcttgcgtgtggttggtattttcctgtcttgcaaactcatttatctgagtccctgatccaaaccctatgcattcctggcagttgctcctcagcattccttccttaatgtgagccccgctgtactcctctgtgcttctgtgttcatccccgcttccacacctctccctacctctcctatttccattccagcttctgagtccctgtccctggctcagtcctttgcatccctccagctggaagtgtaacttttgatacttttctcatacaggaagatgatttgaatgggatccacattgtggcctttgcagagaagagtgatccaggtaggaaaccttcaacctgctcttttacagctctagcaagaactgatttctcacctttgccagccctcacctttctcttctctcacatcccatccacaatgcaactgcaagatattgggcaccccctggtggtcgcccattaagtatgagttcgttttcaattgtgcacacggctaagagaagaaaaggtgtgaacaaatcagaatgttatagactaccaggttcctacagcgctgcacagcaatggaccaacacactgagtcagtgggatttgcagcagagaaagagtttaataatcgcaaggctgccaaatgggtaagaggagggattctcaggccacaaatccaattcttcaaggggttctgggcaagggtttttaagaggatcatggaagctgagggcctggaaaattggggtcattgattgatctgggtaaggggatgaaatcgtgaggatgtggaaactgcattcttccataagtcagctccttgctcagccttttagaccagctgatgtcagtagttttattggtatgcagaacctaaaagagaaactcaaatggaaatcttattgtattagtccattctcacattgctatgaagaaataccagagacagggtaatttataaagaaaagagcttctattggctcaaagttcttcaggttgtacaggaaacagggcagtatctgcttctggggaggcttcagggagcttttactcatggcagaaggcaaagcgggagcagatatctcacatggcaggagcaggaccaaggtggtggggaggtgccacacacttttatataaccagatcttgtgagaactcataccaagtggggaatggtgttaaatcataagaaatcacccccacgatccaatcatctcccaccaggccccacctccagcattggggattacatttcaacaggagatttgggtaggggacacagatccaaaccatatcacttttaatctcaccatgtcttaaattttgtctatagaacagagaagggacaacaagtcttgtgacaagggctacattatcctggggtagtacacagtgaagagaagtgggccagagggcaagccagcttcacgattgctgccgatggtgtgggaagtctagcgggattttatttttttctccagttgattttataaagtgtttttggagatgctttcaagaacctcaaacattctgctttgctgcccaaacatagaaaggtacactgggcactgggggagatattaaaacataccagctttacagggtgtgtgtgtgcttgtgtgtgtgtgcacgtgtgaacttctgttcacattaaaagtttatttacctattttgccatctagcctatatcaaccacaattctacctgaaaataggataaatgtatactttgatccataaaatattgtctgtgcttaggaaatgaagtaggaaacattcccctaaataatgagacctggggaaaatgagcagcttattttgaaagtgcaagatgaccctgtaaatggatgggtaactttgtttttggaacttggacaacttttctctggtttcactcttttcaacaccagtggagagtgaagtgcaggaaaattgattttgcaggtagcaattccctatggcagtgctctgtgagacagagagtccccaagagaaagtggaagcacagattctgaagtgcattttggaaaccctgggacaacccagaatgtaaccagagaagtcaagggaatgtagactttcatggtatttgctggggacctcagtctcttgtatactcatagggagagatctagagatggttccactagacagatcaggaaacagcggtttggagaagttaaacaaactgcccaagagaacacagttagtggcagatcatgaagggtgaacagatcgcctttttcatcaatatatagctgattcttgcacaatgtcttgactcgtggtaggcgcccaataaatatttgtctggcagatgattagagagttagatgaccaaccaagacagagccccaaaatcttcactggcagaccagcttttccttcccttttttggcaatacactaatagcctccatagtttcttacagagtgaaacccacattttttatcatataatttataaaatcaagatataatccatataccataatagtaacccttttaaagtgaagattccagtggtttttaggacattcacaaagttgtgcaaacataatcagtatctaattctagaacattttgataaatagccattagcagtcactcccatttctctctcacccacctctgcaagcaggaattacctactatctctaaaatttgcctattctggacatttcatataaatggaatcatttaatatgtagccttttgtgtgtggcatctttcacttagcatgatgttttcaaggtgtcccaatgacattgcacatatcattccttttaagggccgaataatattccattgtatcaaaaccaaatttatgttctgaattatctgagcactctcttgtctttttcacttttcaacatgatctagcccttgtctccacctctcaaaaaaaagctagtgtggtttcagtgggttttccacaggttccggccaccactcttccctggaggagcaaatagcaaaggaagccaattgcctaaggtttacaagctataatcaaacagaatcggatccctggtgttatgtgaacagagatgcagttgccataggcagcagcctgctggccagactccagagggctccttccccacctcacctgccaccttccaggattgtggggaagcctgtctggctctttggaacaatagaacaaagaggcctccctgaagttgtaagaacctgtttgaccgagattgctgctgtaatgaatcaagctccagaaactacttccacctcctccctgcacaaatatccctgggcctgaagctgtgcctttccccaaaagagcccaagctggggcttgtactgggaagctgtaagcatgcactgaggtgagggcagggggatagggaggagctctagaagcatcttctgtgagcaagggccttgccactcagggttgggaaagggaaagacttgtctgtgaaagtccctgactctgaatttgtggttaatcagtgatttacctgcagagcgctgatgtgtaacctggggcaatgggcctgactgcaggactaggaatgtcattcctgcaaaacagtccctctgcattcctttgctcttgctaacaagttagacatggcctttcaccccaaccaaacacctaaccccaccaccccaaggaaggagatcatacctccaggaaaataatacagttcttcttaaagaactaacagtattgaggaactgtgctaggagctttatgtagatgaccttatttagcacctaaagccactctgtaatacgtgcatgatgattattattctagtgtcagatgaggaacgtgagttttagaggttaaataagttgcccaaatcactcactatacctaagccaagattcaaattcaagcaggctatcttgacctctaaatacatcatgactatgaggaagatgatgatgattgtcacttactgtgtacttatatgtacacaagaaccccatgaggaaggcattatttttattacaactgaggaagctgaggctgagagagcttacctcactgggaagcatgaagttggaatgacgctgaggatgtctggcttcccagcccacacccttaaccacaaggccctgccatagagttatatgaagtcgtcaggttagcaactctgagtggcatatacgtctgtagcagggccttatgctaagtgatcattcgatcctccttcctgcctctctattgcccttcaccatctcctccacctccaacatttgaaagacaagaaagcggagacccagggcaatgcagtggcatgttcgggatcacagggttataggaatagtgggaaatcgagcttagatttcccaagggcccctcctgtgcacagtccaccctatcacaccaactccaaacaatgccccagccagtgcaggctctgagcatgtgcagtgctgccgcatgtactggggaaggggacacgagcaggcagagcaggcggaggtgagaagagcacaaaaccacctggaagcttgagagcctagttagggaagaaaagtcaggcttcctcccactgtctgtccaggtttgggatctaagattacacagcagcaacaaccacatgtcccagtgatccagctgccccaaccactttcttcccccagcagttctgacatgatcctcatggccaagagcttgagttcacccagggtaggaagctgagggaaggcagcaaccctgtactcccacctccacctgccaggaggcagagtctgctctcctggccctcgagcctaatcgccagatctctcctgctgtactcatcccatgccctcaggcaggcctggctgggaaggacatttcctagccctgtgctcttgcccattgcctggtggtgctgccagtcttcctccagctcctgcgctcaaagtgcccgccagagccgctcgtctgacaggtttgaaaatgaatgactgtcttcctcaccacccctagatgtgtctgtgtcaggctgacatcttctttataacatgtgatgaaaggtttgcaaagcagcgtttctacatgagtgcatgctagatggatatcctcaaagggcactgggaatattagcgctaacaagctggaaatgcaaggaaaggctgctgtctgcacacgtggaacagaattagtgacaggccctggaaggaacgtctccaagctctgttccatccaagcttccactgcttcaggttcttgtaaaaatctttttgagaccaattgtctcaagtaggaccactaactgcctccttgagcttttgattttaagtttggtttaccaaatttaacatttggttctttctttctttctttttttttttttttgaggcagtctccctctattgctcaggctggagtgcagtggcaccatctctgctcactgcaacctccacctcccgggttcaagcgattctcctgcctcagcctcccgagtagctgggattagaggcatgggccaccacacctggctaagttttgtattttcaatagcctcccaaagtgctgggattatgggtgtgagccactgtgcctggcctggttcttactatgtgttgaatgttattccaagcacttaacaagtatcaacatatttaacctttgcaacaacccgacgtgttaggtgctgtttttatcatcttccccggtgtacagatgataaagtacagggacaaagaagttaaataatgtccccagctcacatggctaatcagtgatagaactgggattcaaacccagcagtccagccccgagtctgggctctgtaaccatcagcttaagcttctcttcatcacaacaccatatcatttgactttttcaccaattctgggatcttagcgccaggagaagacaggcagagaaagagggtgtggtaaggagtggtagcgtattcacatgtctcaagtgccgtctcatagctgtggggcccagacaatgtcccctgtcctacgcggatgtctgactctcacgggtgacttcttggcaattccatcttgtgagaggagagctcccagccttgtctgtccctctgaggtttcccaaaggatccagttcagatgctaggctgctttttgagaattccatatttactgagtgagctctggcctagagaccaacaaggtctttctgagagaggacctgtcctattcacccttgtgtctcagcctcaggctctgggcttaagatgttgtgggaactcaaattatacctgcctgctgaaaacaaacaaacaaacaaacaaaacccttaagcctgtaatcccagcactttgggattacaggcgggtgaatcacaaggtcaggagttcgagaccagtctggccaacatagtgaaaccccgtctctactaaaaatacaaaaattagctgggcgtggtagcatgcacctgtagtcccagctactcaggaggctgatgcaggagaatcacttgaacccgggaggcagaggttgcagtgagccgagaccacaccattgcactccagcctcggtgacagagtgagactccatctcaaaaacaaaaacaaagcaaaacaaacaaacaaaaacccttcccatcaatgaaggatcaaagtagtgaaaaaaaaaaaaaaaccttaaaatgagtaagagtttgatgggggtggaggagagaaaggaagaagacagacaaagtctttatgaggaccttctgcatgtgtctccctacacactttgcccaacccacatgctgatagcatctcgttatatcaacatgcctgagaagtcatgtggcagctgttctctccactttcagaggaggagatgaaaggggagcggttaagcaacctgtgcaaggtctttaaactccagacccagtgccctctttagacacaacctctaagctgtgtggttccagccccggccgtttatctgtccacctgccacacaagcaagggcaggaccccactttaagagcttggccctcccaagctcaggcctctcctcacaggagcagagaccctgaggcccagaacttcccatggcatggagtcaggaagggtccctttccgtgcctttgtggagtgagcacagccagctcccccaggagtggggccatgaggacagatagcagggcagggcaggctgcatgctgtggacctgttcactcctggaccactgcttggtctgagacacatgagcctctgctgaatgtggccttggctcctgacttggctgtgcctggcctgggaccggtcccctagggcttggtgaaggctcattcccaccagtccctgccagggaaacagaagaggataatcaccagtttctcctcccacaaagatgtgattcccagaggccagtcgcttgccgtgggaaacctcctggttcaacgtgcatcccttggctgtgggtcatggtctctcaggactccaagcctgagtggcaggagaggagttgcagttctcacagctccaggtctctttatttacatccatctctgagactccagtcccactcagagccatccctgagttagccaacccatcatactacagctgctgggaggcgagggcttggcagcgtggtttgaaggaggggaagggacccctccatgggaaggtagaggccagcccgccagccctgggactgaccccatggacagtttcctcagtgtcccagcccctgcttccctgatgttgaagctttcacactgggcttaaaaatctcaagcactcgaggaaggaagatggcagcaacattggtaggagtgcggagacctcagagggtaggagacagtggaagtggctccagacgtgcagacttaagacctgagttcaactcccagctctaccatttgctcccgtgtgatgctgggcaagtcatttgctctccttgggtcttaattccatcctctttaaaatggagatgataaaatcttcctaacctccatcaagactagttgtaaaaatcaaatgtaaaagtactcagtacccagtaagtgttcaatagacactcagaaaataaaggttggagcagcgtgattatagactttctgcatatggagaacaatgttctgtgtcctggctgggcatggtggctttcgcctataatcccagtactctgggaggctgaggtgggaggatcgcttgagcccaggagttcaagatgagcctggacaacacagagagacttcatctttacaaatagtaataaaaaaattaactgcatggtggtgtgtgcctctggtcccagctacttaggaggctgaaataggagaatcacttgagcctgggaagtcaagactgcagtgagccgtgattgcaccactgcatttcagcctggggaacagagcaagactccatctcaaaacaaaacaaaaaagaacaatgtccagtgtccataaaggaagaaattggggagtaaacgtcatgtgaaaaaaaggagatttcaattggatgcaaggataagattcttggctgttagaatgatcaactctgtagtcagccttttagcaaggtcaaacggtctcagtcctggaaatattcaacagagacaaatgttctgagtgagggctattcatctacctggagtttggaatgtctgggttgcgggggtctcttctgattttgagaactgatgcttttctgataactgcagagaatagtcctctacttgctttgtctagataactattagcctacacatctctgaatagtacttcccccttttctctatacagttttttgaagtataggctatattacttctgaaacatacatgaccatagtcttgaaagggctccaagccatgtctaccactgataaaggaaacatttactcattttaaactcagtcattcatccatgtaattttaacagtggactagtccttgcttaacattgaattactaaagtgaaatgcggcttcctacacctgccttcctggtcaaaaagggaggatccacagagcacgtttctcttttccagggaacttgccagttttacaaagaaacagaggctctctttggaaaaaattgaacttgtaacttacaattttagcaactgaatacatgtgagaccaggttagctgccttaactcactttcacagattgacaatccattttaacaggtctgcactcaaggctggtgtctgaagaggggagagccttggaggcttttaagcctttgatcaggaatatccacacaagctaatgccttaaaagcaaaggaattaaacctttccctgacccagttatcaaggcacggttctcgtggtctcaccagctggcacagccatccctgaagcctttggtcacagaatcggcaacaggagctggaaggagctgccccacgctgtacacttttgtgatatagttttctgtcagcatgtaccacgtggatccaagactgcctctaccccactcccagtgcccagatcactgaacgtaataccgatgtggtaaatgagcagaggaatggccaggcttagggagttccagccagcttccttgcctttgaatatagaatgtcaggtaatttaagtaaaataatggctaaaccttactatatgccaggcactgtccaagtgcttcagagatactgattcatttaactcacaactacccgacgaagtagatgctatcattttcatcatctctgttttaaagatgaggagagaaacattaaataacttgctctaagtcacactctaagggtacatccacgaccttggccaaggtcatttggccccagagtctgtgtgtttaagggccatgctgggctgactccctgaagaatgggctctgttctgtcattgaaagtatctggggtcagagacattgtccattacagaattcatcaccctgaacatcagaaacctgcccttggatctagaggaaactttttcagctttaatgtcaaccttatttattaatttattctgggaatggtttttgggatttctttgcttctccatagacacaaagaatattctctttacaaaaaccttttattttcttgaaaatgggcattaagccacacttttgacttcactcgtttacaaaaaaactacaacccatttgatttttcttgcacagttcagtttttcttttcatctcttaacctgctctagaatgtcaaataggaacgtagtaggtaagttcttgtataccacattccttttgatgaatctcaatgttaagagagtttttcccataagaaaacaacagtgctccattgtgtattcagcttatagttctgggtcacagatcctgtccctccacaacacttgtgcctgcctagactctcctttcctttatgtgaatcagtctcttgcaccacaagtttactttctactttcatttgagtctgtgtttttgcatttcatcctctctgtgaatttcagttttgtcatgtcccttttacatttgactctctctcatcttccaaagtactggcagtgtcacctcattgattatcatttctttattttctgcagctaaaaacagtaactgaagttgttttggaggaattcctccttgtggtctttgtactatgatttctatctctacagataaccaaggtggcaccatatttccctctcctgtgacagacacatggccaaaggacgacccatagtgtccacacgtcagtcagtgatacactggaggggcaggaccttctcagttccacctacaggcagcaggagtaatgcccctaccccacctcacccccagccctgcaatgacagataaatgaagtctaatgcttagggccctgtcagtctccggtgtttgtcataatctcatttgcaatatggttatgagcacggattaaaagatcaccgaggtccactctgtatttctgcaagaagtggccaccggccataaagaccccttctaggcctgacacagtgactcacatctgtaatcctgcactttggaaagctgaggcaggatcacttgagcccaggagttcaaaaccaacctgggcaacaatgtgagacccctgtctgcacaaaataaaacaataaaatttaaaagactagctgggcatagtggcacacacctgtagttttagctacttgtgaggctgacacaggaggatcactggagcctgggaggtcgaggctgctgtgagctatgatcccaccacgcactccagcctgggcaacagacaaaaaaaaaaaaaaggaactatttctccactagaggtcgctgtgcttcccaggtaataaggcctaagggggctcagcctgaatcttcagtgtgagctagcaacagtgactacaccaactcaaaaactcaaagtagagttgctaagaatagtatgcgttttgcctggaatgcattagagataaagaagtgtagaaaaaaacttttaccaagagtccaaaagagccaaacaaaagctagcattcctggagagaggagaggtttgctaaacagaggccatagggaggagctcaagtttgctgagactccagacaaaagaagaaaaactgtgcaaagaaagcacagttaattgaattcccaagtagctggtgagttacttgtattcaacgtataaatttcaagccacaaattcagctatgcaagaaatgtaactttattatttagaactgaacctaaatttcaattttgagtgtataccactgagtggtggaagctggggctgataattaaggtcctccaccccaaccccactatcccaagggatccagggtctctctggttcccaggcatatctgagtggggtgcacatctggtatgggtcatcgttacctgttcaagttcctcagaatgacaagacaactccatggggccttctgacaggcttttctgccctagtgctcctatactagggggttctctaagggattctgggatcttttcatttgcctgagtttaattctgaaacaaatcatgggtcttctatactctgggattccctgaaacaatggagattctgtacgtggacacacatgcacacatggcttgtgtttctgcacatgcacgcgtgcacacacacacgcacacacacatacacacacgcacgcacacacatacacacacgcacgcacacacacacaggcacagtttattattctcagggaccttccagaatctaaactattttttctgtttctagctgggggctggggagtggtgctgagggttgagagtatgctatctcttactaaacgttctcctaaaatttttgtttatggcaaaaattgtatgctcctagtccttcaagatttaggcttttaaagctaacaagtttgtgttcttgaagcttataaagctcctctctgcttttcttaggaatcatcccacccctggggcaatgactgctgctgactgaacagagggagggcccagtatacaaggaaatagggagggagggagggagggaagccccatttactatctcagagctgtgaaaccaactgtaaatcagaagctcgtttggtttgaaggttttagcaattcctggttgtagaaaactaagggtccaggcttagacattcttggtccttagagcaaatgttattggggactctaggggacagcaaagcatctgtttcaagagatcgcacaggatcagtaaggacaggcaggaatttctctgttccgtgactgactttctgacccaaggctgggcagttttcacaaatgaagtttggcttccagtgaaaaaccagccagttctctgtgaacttttaatcctttgttcaaattttttattgtttcctttgtataatctgctctgtgcctggagctctcatctgactcattctatagaataatcctataattgagggtgagcaccaaatgtcctaagaagtcctcgtggaaaaatcacactctgctctccacattagaagctgtgtatgtgcaggggttactcaactctcttgaatcctgtttcagatggctacgaattcctggagatcctgaaacaggttgcccgggacaatactgacaaccccgatctgagcatcctgtggatcgacccggacgactttcctctggtgagtggctccagccagcgccccaccctcagttgctgtcacaacctcatgattgcgttcagcatctgaggaggtgaaataggcaggggcacttgaagaaacccagtggcggtcctcacccagtgtgggaggtcttggcccttggggcagtattgaacttggggcctggtgctgaccctgaaaggattcggcttactccctggagtccaggagttgaaaacccttgaccctcggggtcccacccaagtgagcaggctaaactccttcggcagcagctgcagagctgcccctcatcactccattcccagtccccagaactacttttattttctgggtggggaccatcattctgaggccacctgaattactaagtaataaaaatcagagatgaacatttttcagcgagttcagaactttgtggagagaaagcgagcgtgcctgtcatgttcatcgtgttctccccaggacctagcatagtgtctagcctacgatgaatgtgaaagaaacttcaagtccacacttttgctagtgtgcatgatcaatggcccgaaacttttgattatacttagtttttaaaaaagaataaacagcatttgtacactacatgtattgaaccctggtactggttctggtgctgataataagtactggtactgataataagcatagctgatatattctactgtatgcctggaactagagtaatactttacatgcctcatcacagcgaatcctctcaacaaccctgtgaagtaggtactattataatccctgtcacaaggtggagagaatgatagctggggaggttaaagctagtgagtgatagatgtgatattccaatctaggtctacatgatgctaaagcctggtctaccgactgctttaggtaaatgcttattgaagtaatcagtacaagtttagttatcattaggttatgaatgatgactttatcttccaggaattatcattagttgcataggtcatgactgatgatactgtgattaaatagagaaaattgagagggatctcaagggtcctgaaaatcagccctatgtagaggagggggtgaatcaaaggcagaggcttccatgacacttgagaccaatgtcatagcactgggtaattataacaaagtcatggccatataagactgcatacagtacagctttgttgatatagcttctgcctggttgtgtttctagtttatctgactattttgttatacaagcttgcagatggtttgcagttttcctggccagttttttttttgttttttttttgagacagggtctcactgtgtcacccaggctggagtgcagtggcataatctcaatttactgcagccttaagctcccaggctcaagcaatcctcctgcctcagcctcctgagcagttgggactatagaaatgtgccaccacgcccagctaatttttaaaatttcttgtagagacaaggtcttactatgttgctcaggctggtttcaaactcctggactccagtcccaaagtgctgggactacaagcatgagccaccatgcccagactctcttctggccagttctatgtgtttgccttggtttttgcaaagaagaaatcttcagactattctgatttccagattcctgaatatccctagtccccactaggccatatatttgcgtgggagatttcctaccactggacatctccattaaaaaaaaaaatcctgtggccccttgctcctttatttttgccccagtcagagatttgtccacatggagtccaagcctggttgaatgaagaagccttcttcttacttggcaacttatgacccatcatggctttcccagctatctcatgtagcacaagataaggtatttttaaaactgggacattaaaaagaggtggagggaaatggctctataaactataaaacagccacaagtaatttggaaagcaacattagaccacctctataattttctctcttacagctgcagacacatgtttccataatttatgctgtgtcatcttttatttaatgcttatttgaagtgcttgaaggctggggccaagtcttcaatttgctaagtgctcacagctgttttgaagacctttaaccaatggtgacctagttactgtgatgggacggcgggtgggtccttaacagagaatgccgtctgcctgctgtctaatcttatttttttgttgctgcagctcgttgcctactgggagaagactttcaagattgacctattcaggccacagattggggtggtgaatgtcacagatgtgagtatcccctgtgaaggcttgctcaggcacccttggcctgccctgtcttctgctacacagcttagattgtgagagcatctatagtagcccagccttttcagaagagggcaggggtcctgctcaaggaaacttgccagtgtgttccacgcctggtctccgagccagtcccaatctgtggttccatggctctcttccatgggcacattttcttgcctatggggccagcctttcctgaatcactgatttggaactttcccttcaagtaaactctcctgtatttacccccaaagtcaaacagcaaacaaaaaggtctctttacaaaagggaacccacaccaggagccatcactgcacaatgggtgatggggccgttgtggcctagaatcccaggcaggcaactactctacaggcaggagaccaggcctgcagaagggaaggaagaaaatcatatgcgagtaaggggcttctcctcagagttcaggcattgttgaaccgagggtgggacaggctagtgaggtacactggcagaatgcgaggaaatcttagatctcagtccatacatctcatacaactccaccatcataaaactcaagtggggacagatacaatcaggcaaacagtggacagaaagggatgatcacagaggattattagagccatacttaattaagatagaatctcttaagaatgggggccaagccaggcgtggtggctcatgcctgtaatcccagcactttgggaggctgagatgggtggatcacctgaggtcaggagttcaagaccagctggccaacatggtgaaaccccatctctactaaaaatacaaaaattagccaggcatggtcatgggtgcctgtaacaccagttacttgggaggctgaggcaagagaatcgcttgaacccaggaggcggaggttgcagtgagccaagaccgtgccattgcactccagcctgggcaacaagagcaaaactccatctcaaaaaaaaaataaaaaagaatgggggccagttagcaatgtctttctcccctgttgataggtgttcaatcacctagggaactctacattcatttattttgtaagctactttaaaattaataataatacattacttttaaaacatgctcaagtgaaaacattttaaaacagaacagtagattagaaggtcaaagtaaaaagtatttcctactcccctgacccaacccctagtctcattcctggagggaaccactggtggttgttgcatgggtatattaccagaaatgtcatatatattccactgggcaatggaatacacatttccttttatgcaacacaaacagtatactacacataccgttttgccgtttggcatttccatttaacaatgtgcacgttcctaataagtgtaagagagtcggggggcactcagcatagctattcagcacggctatccctggtctggttcagccctcatgcatttacccactcattcattttgtccctcactgcaggctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgatgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctctagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcctatcttgatttttctgactctgctcattctcatctggctccagtcctacctccttatttcttctctattttcctttctagcccctcttcctctgcctgctctttgaatgatggtgtttcacagcatctcaactctacatactcttccaaaatgatgtcatcgtgcccatcaatactatccatgtgctaattacctccaaatatgagtctctaaccttgactccttgccttatttttagacacattcattcaactgcctctggatatcttgacttgttgttgtacaagcacttcagactcaacacaacaaaacctgaactcattgccttctcccctaaacatcttctcctcttcatggagtcctagtttgggtgggtgatagcaccatttatccaattgtctaggtgacctgaaggtgccccttcccccctgtgatttgtgcatccctggatcatgtcacttatcatttaaggtataacatatatttgcatgtctgtcctttcactaaattgcaggctccttagaggcaaggaatttatcttagaatccctagcacttagcgctttgcccatcacaaagtagatactcatttattgagttggtggatgaataattgattaactagaatacctataattccccagcactattgggtaacagagcttacaaggtgtcttagtctgtttttattgatataaaggaataactaagagtgggttatttatgaagaaaaaatatttatttcgctcacaattctgctggctgcaatactgggcatcaggtgaaagccttggctgcttccattcatggcagaaggtaaaggaaaaccagtgtgtgcagagatcacatggtgagagaggaagcatgagagagaggaggtgccagcctctaacaaccagctctccagggaactaacagagcgagtacccactcacaccccacttcctccagagagggcattcatctattcatgaaagatccatcccatgacccaagttctcaagttcttaaatcactccctttagaccctacctctcaatactgccgcactggggattaaatttcaacaggggatttggtgggaacaaatatccaaatgatagcacaaagtgtattagcagggtttacttatgtagatataaattgtgtacattttgcttaatggcccaaagaaacagcttatcaataatctaaccaatgaatatctttgagtcaattgctttctctaatttctgtccatgcaatagctaagaatttgattgtgtgctgtcaaaattctaccactgaggttagcggaaaacaggcttcatatttctttgcaaataatcaaatttcctttaaatagacctatctaaaatcagttgataatttaacttgaattcccaagccactcaggaaaataatccaatattcacctcccacatcaacccaaagtctgttacttttctgtcttcttatttgactcaaatacctttccacttgctggtttactcaaaagatctgtttcatctccatgttttagagcctgaggatttcatttttagttatctattcaaaacattttcttcactgtaaaatgattgacaactagtagtttttgttacaatggtaattctactttcccaatccatcacaattgtcttggtttttatagaaatatgacaggttgtcttgaaattctgaaggtctcaaaattatgcgagagtgaaaaatgtccctgaaaaagtaagcaactttttagattgaaataatcacatgaagaaaagaaacaagacacaatttgatatttcagtttattttccaagtttacagtataaaaaatgtgatgtgtaaaacattttacagttaattgggatgagggggggattatactggaggacccaaaaaggaacaaaataacttgggtgacaggtacactattccatcagagacactaactctgttactgacatcacaatgagaagaagtttcatagcata

SEQ ID NO: 16126 - DNA, 16404 bp, Human
ggcagtgaatggagaagagcgaggaaacgaccccaataccaccaacagaggctggaaactcctcaggctgtttaatcctaagaatgatgcatctgttggccgggcacggtggttcacatctgtaatcctagcactttgggaggctgaggcaggcggatcaccttaggtcaggaattcaagaccagactgaccaacatggagaaaccccatttctactaaaaatacaaaattagccgggcgtggtagcgcatgcctgtaatcccagctactcgggaggctgaagcaggagaattgcttgaatccgggaggtggagtttgtggtgagctgagatctcgccattgcactccagcctgggcaacgagagcaaaattctgtctcaaaataaataaataaaaatacaaaattagccgggcgtggtggtgcatgcctgtaatcccagatgctcgggaggctgaggcaggagaatcgcttgaacctgggaggtggaggttgtggtgagccaagatcatgccattgcactccagcctgggcaagaagtgcaaaactctgtctccaaaaaaaaaaaaaaaaaaaaaaaaaagaatgatgcatctgttggggatgcagtggggtaagcatcttcagtaagcaaggtgtgaagaggggaaagagggaaggtgaatatggaggagagggtgaaggagggcactggaaagggtagtaggatcccagcaaagggcgatttggctgaaagggagcgtgataacaagggtgggggtggggccaagaagcagccaccatgtgtgggtgcctctgtgcgtgcagtcatctttctcacatcattgtggatcaagagaggaaatgcccacttctggaagaaaaagccacaaaatgagacttggaagggaaattgatcaacatctacaaaacggcttcttaaaggaagcggccctcagacaggacagagttgagggaaaggacagaggttatgagtgcctgcaagagtggcagcctggagtagagaaaacactaaaggtggagtcaaaagacctgagttcaagtcccagctctgccactggttagctgtgggatctcgggtaagttgctctccctctcggcctcacggacctcctgaataaaaattgagggttagactggatgatctctgaagccatctctagcttggtagtttatgaggttaataatttatgagcaaacaaagttaatttatagatagaacatcattatttttgagtcagaaaatgactctgtaactatgtgcttttcttggtgatttcactttttttttttcttttagagacatggtcttgctatgttgcccaggctggtatccaactcctggcctcaagccatcctcctgcctcggccttccaaagttgatttcatttttgtcttccagtattgttttactgttgttccctttgaaaaattctaacctatcttttctgaacttgagctgagaagggaaggggttttgcctctgttgggcaaaaggatggtggcaagtagtgtgaccaagtgccctaacttgccaggacttaggggtttcccaagtcaagggacttttcagtccttggcagactggaatggttgatcaccctagtggtgaggaaaatgaaggtttggaggtggcttggaggagaggttgctgggagagctcttctcctgttctctgttgatcaggagtttccctcatcaacctgctgactttgcgtggtggtttcattacaagttgtgagccccttattgggggtatagggaggagaagtgagggcagcctttaaactagtcataggccccagttgagacaattattgccgggaaagaagctgaaatgcttgactagcactgatgctgtgggggattttccctctttcttcaaaaaaacagaaaagacccagtggaaaaaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctggtgagtagacacgggtagcttcctgtcgccgaggccctgtctggaattctaacatcctttgccagagtccgagggagaggggacagtgtgggaatcctctcccactgtggatctgtaaaatctagacaggtcagtcagctcccgccctttaagagtttattttccattctgtggaagaagcagataaggagagctgctgtccttaggagacatcctttagaggaagctggaagacacgggttcaggccctgcatcctcctctgagttgctatgtgactgggaacaggatacttcacctctccattctttctctccttttctcttagggtcggaatatggaactagacaggaaagtactttggaggttttcttaccgtaaggaggctggcattgctaatcagtcaatgaatgcatagctgttcgtctctggccatatgattatgtcatcagggcactacattctgtgttgggtggagaagttgaggacctggtctttgccctcaaatagcttctgctctggccagagaaaaaaatcactcactggaagctattaggcaacaattatgtgctaaactgagggaatgtgagaccagatggtagcaaggaagaggatcccagcaggctggagtcagggagcagggtgagaaaactgttaatctgacaaatgtcttggaacctgttgtagaatctctagagataaggtattcttggaaaggtttcttgggtgggctaagaaaatggtctccagcactacgctgccaccactcaagtctctccagtgaagcgtagtggtgcagttgacttggttgtcactgggctcccagaagatgtgtgtgtgtgtggagcagctcaaccagagaaacacagggttccttgtgagccgacggcagaggctggttgtaagggtttcttggaaacttcttcactgtcttttctccccctggagagaggacttgtttcggggctgcactctgggttagatcatgaaggagccaaaccctggctcctaccaactctcctgtcccaaacttaccctaagatattgtctgactccctcctgctcccccggctggagtggactttgtggagtggactttgtagttccaccaaccatgttcccagacttgctcagagaagcccgcctctcgcttgcccagatcccaaggctgggaagtgtaagtaggacacggggagaaagtgggcagaagggctgactacccaaagcctggcccctcggatccaaaccgtaggtggaatcagagccggaccattcatctaaccaggacctgctacataatttgtgggacccaatgcaaaatgaaaacatggggccccttgttgaaaaattattataaataagaaggcaacagcagagcactaaacctcgtggggggtcctgctgggtgcaggcccccgtgtgactgccccagttgcaagcccatgaagctgccctgagtctaatcacagagtctgggcaataccccaaatcagactaaaaacccgcggccccaaaggggcaatgtgctcccaccctggcccccggtcacagccgctggcctcgcctgattaggttactgggcgtcttcctctgcctgcagcttcaaactgaccacgagccctgacccagttggacatcttagtaaccaactggagacccggcgggtcccagcttctgagaaaccttaagagtttcccctaactgcacgcctcacctcactgagtgacctactagggacaggtgggggcagggggcaggggcagcagggcatgtcccaagaaaacctacatctgggggaaagggacccagtgactttcttcatgtcacacctcaaatgagtgatcctcagccaggcattccaatatctggatccctcactcagggtctagccaggagcccaggagtcctaggaccatctgggctctggagctcttcagccagccaccagtgcctcgttcccccttcacgaatctcctacacaccctgtctccagggccaatgtcccctcagaacacagaccctctcctccgcccccacccactcactgaagggccgtgagcagcttggcagactgtccctcagtgtcacagtacaaaaacctcgggcgtagtggtacaggcaggagaatcttgcatgtagcagcttctcaataagtatttattgatttgtgatgcagtaaaggtcttagctcaccattttcctctggagttagtctgggtccttctattccttctgcttcctattctcctccttgtccttgcccataccaggtattggttcacattccttgaacgctgggttttacactctcatgttgagctaagaactggggccttttggttacacaaacttgccagaaaaaaaaaaaaaaaggaactgggggctcctggccataagccaggttcgtcattctgtattccatttgtcctcttgaactcgaagaccaactcgagccgcttaaaatgtccacttctttaaggcaggggctggagggtggggaggggctgctaattctcatgaatgaaaggtccaaatagaacaaaaattagatggctaagaaccaggaacaagaagattccaggtcctggggtgggtatgccagggacccatcctgctggaaaggccgatcctggcagacctagagcagaccctgtctatgcgaccctcgatctgagagcctccttccaacagaaccagggcctgggctggggcatccacagaggctggtcataaactatacctccagccccaccctgcacaccagccgggaggggaagctgctatagcgcacggtgaagctggtccaagccccagagcctggctttctatgacccctctccatagacaattaccacacatcatgacttcagtgtgaccagagcatcacaggcgacacagcccgtccacgtggaccatctcatttcatcatgtaggtgtgaagaagaggaaccaaaaccagctcaggctgtttctgggcttcatctaggggaaagggaggttctccacccgccccccgcaaccaggtcaaaagtcccagaggaaccccagcagaggaggcccaactggggtgtagttggaagggtcagagatgagggagagccccaaggccaagctgaggatgggtcagggtcaaagtgaatatgggttcgggcatacaaactgcagagtctccgtcaggaactcttgctttccccagggacgcaggctgcagctgatcccactcctctagcagaacggcagaaacagtggccgcatatgtggacctaagaatcaggacacaagaatgagcattctttcaagagtggtggggaaaaatatttccaacccaggagatggtttcaagaggctgccacacacacctgggaggcctgtctgcctgcatcttggactgtgtgactctgtatccaaagggcaaagagacgctggggtgccaggtggggctcccttaagcctaaagacttgctgcagaggcttggagtagcttaaactctccccctaacaccacatccagcacagtacctgcttctgatggccaaaacccgtgggtagagatgaaagaggagtctcacagacttgtccctgaaggctgtgggtgcggcaagggagatgtgacaaatggcaagccagagtctcagatggtctttaggggctgtgggcctcctgaagaaagacggggtaaggggtacagacctaca[450 bp omitted]ttgaaggcagagtccagcctccttcttcccagggcaggaatctcttcccacacacttgggctcaaacgttcctctccttcctaaaggtaccatctcattgctggacagttctgtctgttagaaagttctccctcctttgactgaaacgctaccccctcagcttctgcccagtccttctagactgccccctggaagctcatagcaagagtccattgctgccctcttgcccatggagcttctttccaagccttgacatcagccctcagggactcaagtcttctctgtcccagacactacacccctagtacctgaaaatttcctctatgggcagggttttccaagcccctcaacaaagtggtcatccttgtccagaccaaccaaactgggctggtgtcagctgcccacttacaagcctctgttcacctagatgaaggtaacagtggcccttcggctggccacgtcactcccgtgactcatcttaagcttgtaggtgacaaactcccaagtctttctgacgaactgttgttacctggtcctccctaacttatccctggacgggtaatgttttaaacctgagtcctggcttgtatatttttccccatgcaatttcatctggttaggttggacccatggttccagcttgtaaagaactctgtgttgcctgagagtgcccccaaagctgggctgagagtgctgaagaggaggggacccaggatagatccctgaggcatgctaggcacccctgcccaatgcacctgctgacatagaatccccattagcaaatgtgagctgagctccatgctggccagtgctgggcagtggggcagcctcattatttggagaagtcaggtggggcttggagacttaattatccagggaggagcctgcatcctacagtggagggaaggagaagagtaacattttgggccctaccacaggccaagcactttgcatctccttacaccccccacctcccgctaagcccctcaatactggacactgttacagcccctgctcctccccagtgctcacagcaattttctaactagattctagctccactctcagcctcattctggtcattgtgtttcttgccttctttggggcatgtgaccctggcccatgaccaggctgttgtctgctgggtgcctgtctaggccacatgctggtgtggcccatcttggcacctgtgtctatgcaaggtgcatgttgctgtcaagagtgtgtgtgtgcacgagggcctcaggtttcagaagcttttcatgtcaaagaatgggcacaccgctcacgcaaatggtctgccctgtgctccctctgggcatgggattggagggcttccttcagcagcacatgccccatggtattcaggattcctgattcctcaatttcccatgaggccggagccaaccttgctttattgcctctctccatagtttgggggagattgggggagctagaactcctatgtgtgggaagtggctttaacatgtgccactcccgaacccccaaaacgtctgtttgacacctcctgctgagatgtgctgtcaattcccagcacccctcaaaccagcttcctcccatcttaccctctctgaacgctgccagacaaatacctcttggcaaggaggaagacacaggcccctcccaagccccctctaaatctggttctcaggagatgggagccctagggagatgtcccactgcattgactttagatgagcaataactcagtcagtctggaatctttgaagggcaagaacttgtgtggaggacaagcccagaaacccagggctttctgggtcagacaggctggctggacctaagccctcacccaggcacggccaaggtaggtggagtccagccctgctgaccgccccaggccctgcttctctcctccctgtctgaacggcttggctctgcgtgaagactgctgaattccagtattagtcaagtgggtgtgctcagtgacggtattggaaatagctcccaatagagggagagcactcaagataggatctaggatcaaggccatcaaggttattgggagaaggcagaatgcagaagattacggagtgagtccctgcagaggcacttgtctaagtctcaggttataagggctcctggccttctctgggaaactgctttcagagcaggtcagcacacgtctgtcctacgtaaaacacgtggccttgggagggggacacagaaggcctgcttctgagaccttgccatctggttagaaagtgtcatcccaaccctgggtgctgtaataaatgcacacgcatcataaggagaagagagaattccaagaggggagccgggaaggatgtctgaagatgggattgaattcggctttggaggaagggtggaaattaggcaaatttggaaagaaagacctgctagacagaaggaaaaggccaagcagaggtttggagacaggaatgtgttggggtgttggggaaaggccggggggtggtctagagcaataatttattaatagaagacaaagtttgaaaggtcagaggaatatacatttgggaagaacataaaggctgtgttgggaggttagacgtcttcccacaggtccatggttttcaaatgaaagtagaaccattttcttcaatgaaagcttatgtgtgaagcactgcacaagtcaaaagtggagagctctagtttaaagtcaaggaggggagcctggagccccaacaccactccccactccaggggaaccctgtgacacacacacagtcatgggtactctaaagaaagtccttggagctgggcactgttgtcacatacctgcagtcctagctacccagaaggctggggcaggaggaggatcacttgggcccaggaggtcaaggctgtagtgtgctatggtcacacgtattaatagccactgcactccagcctgggcaacatagcaagacactatctatcaaaaaacaaaaacaaaggcgtgtgtttgggggagaaattccatggaatcctactgcatgggatgttctgcaatgagttctaaactttattttttaaaaaaatgttttgtagagatggggtctcgctatgtcatgcaggctggtcttgaactcctggcttcaagcaatcctcccacctaagcctcccaaagtgctgggagccactgtgcccaggagttctgaaatttagcgatgtgtgaatggcactaagtttggcttactccaatcattttctttttttttgagattgggtcttggtctgttacccaggctggagcgtagcagcataatcatagttcactgcagtcccaaattccctggctcaagtgatcctcccgccttgtcttcccaaagtgctgggattacaggcctgagccaccatgcccagactccaatcaatcttctattgatgaacatgatcacaaatatgactttttcttatagctgactttgctattaaatgtgaaattgaggccaggtatggtagctcatgcctgtaatcccaccactttgggaggccgaggcggggggatcacttgaggtcaggagtttgagaccagcctggccaacatggtgaaaccttgtctctactaaaaatacaaaaaaattacctaggtgtggtggcagatgcctggaatcccaactacttgggaggctgaggcaggagaattgcttgaacccaggaggcggaggttgcagtgagccgagatcgtgccactgcactccagcctgggcaacaagagcaaaactccacctcaaaaaaaaaaaaaaaaaaaaagtgaagttgaaaaaataagataaagacaaaaagcagaagaaaaccactgcttacaggtgatggggaaccagtaaaggactttaaacagaacattgatgcgatgggatttgtgttttagaaaacttaccctgtcctctgtgcaggaggtggacaggagtagagaagctggtggggatgggacccatggagagatggtctcctgagcattagagtaaagagaaggaagaccagactgaggcaatggcagagggatgctgcgggaagggttggcagatggctctacccttgcactgatgtatctcccacacctccttctcacagaccctcattcccccagagccagaaggaaagacccaggttggagaatgggtctgctcagcattaggagtgagtgtgtgacccacaactgtggctcctgagaggcaagaaagccctgtggcacccagtgtgaccatcccctccttgtgggggtgccttgctctcctgaaatgggggcaccattaagccacccggagcctggtggacagagtaccccatcccatcctctgcctccctgggttcatcatttatagtattgccattttgaatccacataggttggttataattggttttgaattgcctggggaggggcttgggtagggagggtgggaagaacagagctgggaggtgaggaggaacaggtgcaggggacagctgtgagtgaaaggtgtgaaaacaggcacatgtcttcctttgtggttagctgggtaaacaacctgagtgctggggtgatggggggggggtgatggggagaggaagaggaggatggggaggagggaacttccggagacatcacgggcacaccccctgcacttggagcaggctctctccttctctcctgccagtctccccgtgtcgccctcactttctcctgcctctctctgcctctgggctttctgcttctgagtgctcctagctgcagggaggttgccagtgatgggaagtagcagggagcctgcatctgctgcccctagaaggaagcccaggcagggttgttcagtgggaggtactggctttggaagtagataaacgtcggttcacacaaacctgatctttagcaagacacatctgtgaaataggaataatattacataccttgagcgggttgtgcatattgaaccagatgggaggctattactgccatttcagtgataacagagacagtcaggaacaggaagacccatgaggagggagcccacaggccaagtcagcacccgcccgcccctagtccccagcacaatgctaagttgcagtgcccgactgttctgctcagaactggaacagatgggtccttgtaccaagcaggtccattccccaaattgaagtcctgtgactccagccgccaaggctgcaggcttccgtacatgaggacccaaaaacacaagctgacttatggggtccagccctccagcacttacaaagctcagccacccgcacgcctcccttcatcagcaccaccactctaaggaatgcggtccctttgacaggcgaaaaactgaagttggaaaagacaaagtgatttgttcaaaattgaaatttgaaacttgacatttggtcagtgggccctatgtaggaaaaaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtatttatatatttatatttatatatatatttatataatggtacaaaatggctgggggtgtggccatggatggagggaagagtaggctggcctgtggcgtgggtgggaggagaggggacggagagggcactcggcccgctgcaatctgacccctctctcctcagggcaggaaacacagagtcagacagtttgggggggtcttgggccaggggtggagggctcaagggcacagggcccaggctgaggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagcaataacttgaagaaggggggaagggtttcttttatccttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacactgccacttccccctaagctgccagcacat

SEQ ID NO: 16127 - DNA, 42242 bp, Human
aagtattttttaacattaggtacattatatgctaagtacttgtctagatactttatgtgtttattttgcagacacacagaacacatttgtatatgccaggtgctgttttaagtgctctataagtattaactaattcaatccttagaataggattatgtcatttaaacttctcttcagctcttattagccctatcttattaaatggaggctcagagaggcccaaggttgtgttattaaattgtagggtctgtgtgaggctgaggcaactgccctccccagaagacactgggagctccctgctagggactaaatgtttgtgtcccctctgcaattcatatgttgagaccctaacccccaacgtgatgttatcaggcatttggcagataattagctacaggtgaggttatgagcataggcccccataatgggatctgtgcccttataagaagtgaccaggaagcttactctttctctgtctccaacatgaaggtgtccttctgcaaaccaggaagagggccctcaccaggaactgattggccagcactgtcatcttggacttcccagccttcaggactgtgacgaataaattgctattgtaagccacccagtctatggtatctttgttatagcagcttgagccaagatataccctctaatggtgctgtaggatggggtgaggaaaggcccccagctctggtttttgggaagctgcatctttatttttattatttgtttgagacagggtctcactttgtcacccaggctgaagtgcagtggaacgaccttggctcactgcagtctcaggctcctgggttcaagcaatccccttgcctcagccccctaagtagctgggactacaggcacgtgccaccatgccctgctaatttttgtatttctttaagagatggggttttgccatgttacccaggctggtctcgaactcctgagctcaaaccatctgcccatttcagcctcccaaactgttgggattacaggcatgagccatccttccaggccagaatctgcatctctaaagagcagattctcctgcctcagcctcctgcgtagctgggactacaggttcgtgccaccatgcccagctgattttttgtatttttagtagagaaggggttttactgtgttagccaggatagtcttgatctcctgacctcgtgattcaccctccttggcctcttaaagtgctgggattacaagtgtgagccatcgcgcccggccggtttatttttttaaaaatggctgggcacagtgacttgtggctgtagttctagctacttgggaggctgaggcaggaggattacttaagcccaagagttggaggctgcagtgagctatgatcgtgccaccacacactccagcctgggtgacagatcaagaccctgtcttaaaaaaaaaaagtatgattattatcagagtctctaggtgacagtgagaggcagcctggtgcaggggatagggcacagttgtaatctgctagactgggttcaaatcctaaatcggccattcagagcgtgaatacattagaactggcttaaattagcatttaaaatgtcaacaggattaagtaagtagttccttctcactttttccacaggaggtgagaaaggtctcagcaaggccctaggagggaagggcgtggggatgaaagggatccagagagtctgtgcattggcagagaagatagtgtaactggcactgcggctggagggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagtaagaggcatgggaagttcgtgtgtgtgcgcgtgtgtgcgtgtgtgtgtgtgtgtgacaaggcttgcgggagagagagggagggagggagatgggtccggtgttttgtttcctacttgcccttgcaggtagctctgggtcctcagagcacagtcgcctcagggtcacccatgccgcctgctaccctccttcccaggggcaagcagagactgagaacattccagagattagttctcccaactggaacgctgtggggcctcagagctcagcgattctgcatcatctgtgattacgacccacagcccgttcaaacgagcgttagtagcctgctaacctgcaggaagtggtgtgaatattaattacaagtgttccaaaggaaacgtgcctgcttctaaacctggttgtgatttcttgaacgttgatgttttaattaatgtgttttcttaaataaactgcctatggtggtatgattatcagattgaaaaaaacttccttcagaaatattagctttagattaagtaattagctctaaattttaaaacagcttcccactaggattattcaatatctcgactgcctggttaaatagagggcttttactccatgggagtcacatttgctcaattcatattatcttacctacaatgtcagctggggaaaggggtccgagtgcaagagtgcaagacttcttaccaagcatgcatatttctttatatttccaagtatgcctgtaccaggaaatagggccaagccgtagactgctcaggttacacaaacagccagaagcaggaaggcctcacagctgaggatccagtccaggcctccgtgcatgctcaatgtcttgcctagccagtctgttttgagattgtatgaagatcttgaaccttcagactcacgttttgtggtttgattcacacaatctgttgtggagaagagcaggatatttgtttctaattaaagaagcacttagatctgttaaaaggaaaaccctagacaaattacatttaactgagtttaattgagcaaagaacgattcacagttgggcatggggaaccggaataggttcagagagactctggggctgccacgtggtagaagaagatttatggacagaaaaaggaaagcgactcccagaaaacggaagcatatagttcacgatgtacggagaaacctttaggctgaacttaaaatatgtcagaaggcagctttaggctaaacctaatttagcaggtctaaggctcactgttggtagcatcctgactcacaggtgctaccaaacctgcatgcgcctttatcctaggcctgcaggtccacagatgtcccaaagctgacagaggtgctcatcctccctgtttgctgcttgtgcagggggctgtgtgaactggggccagaatgttagggggctggatggagtgggggtaggggtggggagagaggagaggagactgggtgaatgatgattaatggtggacagggaatgtttaatgacaaggtgttagggccgggcacggtggctcacccctgtaatccgagtactttgggaggccaaggcaggtggatcacgaggtcaagagatcgagaccatcctggccaacatggtgaaactccgtctctacttaaaatacacaaatttgctggacatggtggcacgctcctgtagtcccagctactagggaggctgaggcaggagaatcgcttgaacctgggagggggaggttgcagtggactgagatcacagcactacactccagcctggcaacagagcgagactccatctcaaagaaaaaaaaaagatgttgatgaagagttgaactttgtaaaataattgaaaagctgtattctgagccaaacatgagggacgagtggccggtgacacagcccaaggagattctaagaacatctgcccaaaggggtctggctacagattggttttatacattttagggagacataagacatcaaccaattcatgtaagatgtacattagtttggtcccaaaaggcgggacaactggaagtggggcatgggcttccaggtcataggtggatttaaagattttctgattggcaattgattaaaagagtttatctacagacctcaaatccatagaagggagtgcctgggttaagataaggggttgtggaggccaaggttcttactatgcaaatgaagcttccaggtagcagcgtttggagagaatagattgtaaatgtttcttatgagacttgaaaaggtgccagactctgttaattctctcctggatcagagaaaagacctggcaagggaaagggattttctacagaatgtagactttccccacaagagacaactttgcaggaccatttcaaaatatgacaaagaaatatattttagggtaaaatacttcaatttctttcaaggcctgctatctgtcatgtgatgctatactagagtcaggctggaatttggtgtcttatttctacaaaaagtcttaagtgttagattttttaaagggaaggtggggttaaagaaagacacagagagagagagagagagaggagggggagggggtagagggggagagggagagagagagaggctttacaacaacacaggtttattacaaaaacctgtggaggtgggggaccagcttaatgccagagcccgccattgcttacaggctggggtatgtacaggtatgggcaggagggttttgggcagtatggcttgctgccctggaggatattgataagatgttcttatgttcaggtggtttggccagggatgttccttgggctctgtcaggatttgatagggatatttcttcagttgggtctttgcttggcagggtatgataaagatgttcctgtgtcttgtggtcaggtggctaggcaggatttctcagggcccgaacccccatggaatgtttcactttgaccaaggtctgtgaaatggcagggggcttacaaaatggtgtagtttggactaacattaaggtctgtttcagtgttaatgctggtcagttatgcctgaattccaaagggcggaggatataatgaggcacatctgacaccttttccccatcatggcctgaactcgttttttaggttaactttggaatgcccttggctgagaggaggactccatttagatggttggggggcttagaattttatttttggtttacaaaggagagagagagtgtgtaagagggagacagagagaggaagacacaactgtttagctggcattaggaaccagaatttgctccttttgcaagtctgatgttcatggagtcgggacaccatgtgccatggttgaagcagcttaggttttgaagacagacagagctgtatctgttggtctagccacttcccagctgggtgtccccgttcaggatacactgcccttcaatgttaccatcaaagagggtttaatgggacgctggggaggaaatcccaccatagttcctggccccatgtaggcgctcagcactgtcagttcccatcctaaggtccttcttcgaagagagaagtttctgctgcatggagaggtagagacagggtgaaggtacccagctgtggctgggtgggcatcacagggggtaaggggcagagaaagcttccccttcaccctctgaaggttcactgaacgtcaactgacaaaaggcagattaacaggagaaaggctgtgacaatttattttaatatgcacagcatgagagaatggttgcccaataatccaaaggggtacagcagtttgtataccattcttcacaggggagggaggaaatggggaatgcagacaattcttttgagtggtagtaaacaattattagggagaatgaatggactgggagacaaagtaacttgtcaatgattctctggaatttgattggccagaggggtaggcttaatctggtgggaaagttcgtccaggtgtgtgcattcctcggtcttcttttccacatgagataatgaggtctgagggaggagacggcaggcaattgtgtttgtcttagggggtctggtttctaggtagataagggagtttcagaggactgcccagctgcatcctgtgccttggtagagaccacaggttgagacaggaggcagtggagaggtcacaaagaccttgaggcagcttctttagttcagtcatattttgaggtgtaatattctgatttccttcggtggggggcggggggggggcggttaacagaaataccaaactctgtgaaatcttttaaagaggtttattctgagccaatatgagtgaccatggctcggagaaaacacaaacccaagaagccttcagtgggtggtcccaaggcaattgggttacagtttggttttatacattttaaggaggcaggaattataggcaaagacataaatcaatacatggaaggtatctattggttcggccccaaaaggtgggatatcttaaagccagggggcttacagattataagtggactcagagattctcagatttgcagttgttaaaggagtaaagctttgtttaaagacttgaattcagcacaaagaaatgcttacattaagagaaggggtggccaggtgtggtggttcatgcctttaatcaagcactttgggtgaccaaggtgggtagatcacttaagcccaggagttcaagaccagcctgggcaacatgatgaaatgctgtctctattaaaaatacaaaaaattagctgagtgttgtggcactcacctgtaatcccagccacttgggaggctgaggtgtgagaattgcttgagtccatgggttgcagtgagccgagatcatgccactgcactccagactgggtgagagtgagaccctatctcaaaaaaaaaaaaaaaaagataaagaggtcatgtgatgctataccagagtcagttggaaagtaagccacatactgggttaatttaaaagaactggcctaatgagatttgatggtttgtagggcgtgacttaacccttgccttgtaaggccttaggtcttgtctacaatttgatgtcttcttgctgcagccggctttgttagtcttatgatccccattttaaccttaatcctgggcagttgtgcctaaactccaaaagggagggggcacaaccaggtgtgtcctacctcccttcccctcacggcagggaattcagtttttcaggtctctctggggttccctcggccaagagtgggtctgttcagttgtttgggggttaggatttcatttttggtttctcctcagcacatgtgtatctctggagaaagctagggaaagaggaaagacaggcaaagcaaaaggagattattatctagaggttttaatcaactcataagggaaataaagttgaaactctacagaaaaggaggtgaaatagcaccccactgtcatcatatattcatcatatatacgtatatatattttcagacctactgctctgtcgcccgggctggagtgcagtggtgtgatctcagctcaactgcagcctctgcctcccaaggtcaagcaattctcctgcctcagcctcccgagtagctgggactacaggtgcgccaccatgcccggctaatttttgttgttgttctttttgtttttttgagagggagtctcactctgtggcccaggctggagtgcagtggtgtgatctcggctcactgcaacctctgcctcccaggttcaagtgattctcccggctcagcctcctgagtatctgggactacaggcacacgacactgcacctggctaatttttgtatttttagtagagatggggtttcaccgtgtgggccaggctggtcttgatcacctgacctcaagtgatccacccgcctcaacctcccaaagtgctgggattacaggcacgaactaccgcacctggccccactctcatcatattattccaaaaatagccatggtctctctgaggcccctcacctgagagaacagaagggcttctatcccttggggctggaggtgagcccagctgaatcctctttcttggggctggactgggagtaggtgggatatctcagtacctcttccatttactgaagctcattcctcacacttgctagtgtcacaaacagatgcccattgggtgcaattaacgtaagaaaagatagcacttttaaggcttgcttactcccagcctcattttgaagctctaggctcctgtgcattactaattcataagtctaggagcacatacctttcattatttccattttataggtggaaacaagaagacttgccaagtattttctgcaaggctgtgaagcatgttagaagcaatggtaatagcaggtgcagagtggccaagtcctcatttccccctcaatggacaaatccctttagctgagcccatgagtcattggcctttccagattgatgctgccctggagggatggagcccagggttggagacagtcagggcccatctgtacattccttctcctcactctgctctctcaggctgcagtatgaatgagaaaactccaatcccaagcatttacacacttttttttttttttttgactcggagtacagtggtgcgatctcagctcactgcaacctccgcctcctgggtttcagcaaatctcctgtctcagcctcctgagtagctgggactacaggtgtgcaccaccaaactcagctaatttttgtatttttagtagagacggggtttcaccatgttggccgggcttgtctcaaactcctgacctcaagtgatccactagcctcagcctcccaaagtgttgggattacaggcgtgagctactactgggcccggacagcatttacacactttagatattcagtgacaatgtttaaatcctaaacaacagcttatttgtagcagaaggggattagtggaagggaagagcctgctttgagagcccttgctacaccaggatcaatattgacttcttgtgagagggggagatcatatcctgttccagtaggaaacacattgcctctaatactcttaacacagggagagacccaaactatacacttggtgtggaattttaaaaggaaacatttttaaaatattagcaggtaggaaacagatattgaggtactaaaacaagtcagacaaggagatagtgggggagacaactggtaaggagctaaaactgaaataaataatgtgaagcgaaataatagttactgtaacccaactgaacgtgggtccattcacccagcatacagaaacaaacacaagcaccaggatttgcagtgacagaaagggaagcattgattgcagggtgccaagcaaggagaactgggcagctaatgcttaagaccctaactccccaatggctttcaggcaagggttttaaaattttatttattttattgttatttgaaacagggtcttgctctgtcacccaggctggagtgcattgatcctggctcactgcagccttgtcctcccaggctcaagcgatcctgcctactcagcctcctaagtagctggaactacaggcgtgcaccatcaccacacctggttaatttttgtatttttattttctagacatgggttctcactatgttgtccaggctggtctcaaactcctgggctcaagcagtcctcctgcctcggcctcccagaatgctggaattacaggtgtgaaccaccatgcctaaatgggtttttaaaatttgagatagggtcacaccatgttgcccaggctggtcttgaactcctagtctcaagtgatcctcccaccttggcctcctgaaattctggattacaggagtgagccaacagacttggcccaagcaagggtttttaaaggcaggggtatatttcaggaaagcagaaggtataggaaagataataaatcaatacatggaggttataccttggtttggcctcaaaaggcaggatatcttgacacaggggcttacaggccacaggtggattcagagattctttggtttgcagttggttaagggagcaaggctttgtctaaaaacttgggtcagcagaaagaaatattaaggttctaagctaaaaagtatctgagacaatttagaaaatttattttgccagggttaaggacatgcccgtgacacagcctcaggggctcctgacaacatgtgcccaaggtggtcagggcacagcctggttttatacattttagggagacatgagacatcaattcatttatgtcagatgtacattggttcagtccggaaaggcgagacaactcaaagtctatatccaggtcataggtagataggagacattcttttgagtttctgattagccttttactgaatcaaaggaagcaatcagatatgtatttgtctcaagtgagcagaggaatcactttgagttctgtctgtcctttgtccacaaggaatttccttgtgggtaaattgtgagggagctatgtagttttttttttttttctttttttatctggtgtctaggcaaagtggctcacttctgtaatcccagcacttttggaggctaaggcgggtagatcacttgaggtcaggagttcaagaccagcctggccaacatggtgaaaccccatctctgctaaaaatacaaaaaactagctgggcatggtggcacatgcctgtaatcccagctactcaggaggttgaggcaggagaattgcttgaacccaggaggtgaaggttgcagtgagctgagatcatgccactgcactccagcctgggtgacagaatgagactctgtctcttaaaaaaacaaaatctttatagctatcttatttaggtatagaatgggaggcaggtttgtccaatgcagttcccagcttgacttttccctttggcttagtgatttgggggtcctaagatttattttcctttcatgaggtttaacccgtgtgtgtgattctctgcaggcccctcaggaagaaatttagaacagggaatggtggtcagaattcagtcctcagttcccgcttagctgaggtctgtgtgacagtggtcagcattttccatctggtggaggtcctggtttctgagaaacaactcaagaacttatgtgaagacgttgtctttagtttctatagggaaccgaacgtcttgtaactctgtcttatttgggtgactattatttaaactattattatcttctcgcttagcgggactgaaggatagcaaggtgcttggaatttcccttgaaggaactcaagagtttttatttccgtgcttgaggtggctagcaggtccctaagagtgttccttgctctgtctccatgccagaagtttattatggggtgaaaagaggaagttaaggacaggaggcaagacctactgaaggctcaaaaactgacagaggaggaagtatggatgtggaagtgaaagaagtccacagagctcatcacaagatgaaggtggtcccaggcatcagagttgattatctaatgaaataaaggagaagaaagtcatactgttttataacagggaaacgtcggcaggtaggagccatcatccccaaagttttcttgtacctgctgggcaaggtgtcagagccctggcaatggaaagtgattggcccacagggagtaagaatttaccgacaacaatataggtttgaaaaggaaagttttattagattgagagaaagctgcagaagagtgcagcgggctgcctcagcgagaggactgagcgcgccggggaggattttccttaggggtatttatggaccttaaagcaagagcttaggggtaatttggtccatattagccacatatgtcatgataaatgattacatttgtagacattttggtgtcgtaatgtcagcaagggttgcacaatgagttttgtcatgcatgcattccggagatgtatagaggtagagaaagtctagttacatataaattttggggaaagaagcctggaaccggccttagatatagggaagatcaattatttctaaactcctcagataaggagttctgcctctggatggtcggcttcatggccaccaggtggtctttgctctctttagtggcccctccctcctggcctcctcatctccaggcaatctttatgtcactatagattcatttgcattttgagaattttatataagtgaaattattcagtagtactcttttttaaaatccttgctttcattcagcataattattttgagattcactcatttttggggggtatcaatagtttattcctttttcttattgttaagtagtatcccattgtatggctctatcatgatttatttatctactcacctgttgatggatactcttgtgagtcagggttctccagagaaacagaatcaatacacacactcacacatagacacacacacggagaattattttaaggaattggctcacacagttgtgggggctggcaagtctgaaatctgcaggaaaggctggtaggcaaaagttgatgttacaatctggtgttgaaggcagtctggaggcagaagtcctttctctttgggggacctcagtcttacctcctagggccttcaactgattggatgaggcccacccacattaaggagggtaatctgctttactccaagtcaattgatttcaatattaatcacatctaaaaaaacaccttcacagcaacatttaggctggtgtttgaccaaacaactaggcaccgtatgctagccaagctgatgcataaaattagccatcacagagttgttcctgttacaaacaaagctgctgtgaatatttgtgtacaattctttgtactgaaggaaataaaaatattttacccaagatagatttctttgacagattttcaaatggccctgcaaagctgttttttgtgggggaactttgcattgtggagaatctccatgaatgcagcaaggccttcccttgtccagatctgggagagattaatggagtctgacacctgtaaagatctggaagaaacacttaccatctattttctctaaggggctgctatctgtgagatttcgtctgtataacatgactcccttggctagctgagcctcctcttcttcccctcccatatcctgtcttgccactaaaacctgacttaccaccataacctgtttttttggccatgttctgagcctgcattgcttctgtgaacccaaaatatctgataggtctcaaccaatttagaaagtttattttgtcaaggttaaggacatgcccgtgacataaaaggacatgcccgtgacatagcctcaggaggtcctgatgacatgtgcccaagatggtcagggtacaacttgcttttatacatttcagagggacatgagacatcaatcagtatgtgtaacatgtacattggtttggtctaggtaaggcaggacaaatcaaagcaggggcttccaggtcatagatagataagagataaaggttacattcttttgagtccttgataagcctttcactgaatacacaatttagtctggctcagtgaatctgcattttttttttttttgagacagagtttcactcttgttgtccaggctggagtgcaatggcatgatctcggctcactgcaacctctgtctcccaggttcaagtgattatcctgccttagcctcctgagtagctgggattacaggcatgcaccaccacgtccagcaaattttttgtatttttagtagagacagggtttctccatgttggtcaggctggtctcgaactcccgaccttgggtaatccacccgtctcagcctcccaaagtgctgggattacaggcgtgagccaccgtgatcggcacatttttacataagcaatcagatatgcgtttgtctcagatgagcagagggtgactttctgtccagcacctgtgaagataagcttttccttgtgggcaaattgtgctttgtagctatcttatttaggaattaaaatgggaggcaggtttgcctgctggagttctcagcttgacttttcccttggcttagtgattttggggtcctgagatttattttcctttcacatttctgtagcctcaagatggcatatgaacttctgtacctcactgtggagcggggtctttgttctgaaggctgctatgtatacatatgaaataaatgtgtgtgatctttcttttaatgtctgttaattaatctgcctcatgtcagtgattttcagtgaacctccagggggccaagggctttggcccctacagtatggacatacaattttgtttctcttagggaaatacctatgaatggaatgactgggttatacattggaggtatgtctaactaaaagactcccttccaaactgtttttcaaagtggttgtaccgttttacattcccaccagcattgtatgaaagtttcagttgctctcatatcctctcctgtcttttttaattgctatcatctgtctttttgattttagacattgtaataggtatgtagtactatctaattgtgatttaaatttgcattccactaatgactaatgacgtgccccatctttaacgcaacatttccctttacttgcaggttattttgctttgcaagttggaaaggcaagattaaaatacaaagttacgcccccagcagtcactgggtcaccagagtttgagagagtatttcgggcacagtaagtaatgcttcttccacccttcatggatctgtgcctgccatacagacacaattcctgactaggggaaagggatatggagaagaccctaagttcatgtgcaatatctagttataacaagtcactcttcacagccaagaccgttctcagaatccagaaagtttgaagggttcggggcatgaagtctctgcccacatctattaccaattcagcagggtatatttacagaaaaggctgggatctcaggagggactgctgtgtctcccaaggagggtcactgggtcaaagaggccccctggagccttgtgagaccacaatagtctgaagttggattcgttatgctacaattttctatcttattttttcctccctacttcaaaacagaggtagatcaggattaatcttttgccagtttctctgtgaaccatttcttaaaatcagaaacctgtaagaatgagaaagcttgccagctcacatgcatgcgccatgttttttgatcatcttgtgctccttgttttttcagacccacacaaaatgttccaccataaacaccgtgaacttgcctgctgcaggaatgctagggcgtactttatatttcatcccccaaaatacgtgctttaagaaacatttcatgcgtcaccactgatatatcattgggttcttttgttaccatcttgggatttttcatttatgtttacaagtgagattggcctacactttgcctttcttgtctggttcttgtctcattttgatacagatgaacctagtgtcaaatgagttggaggaagcatcctgttctactttctcagataattttaataaggttggaagagtgtgttccttcaaggttgtgtagaacttgccttaaaataatctgggcctaatgtttttctggtgggaaatttttaaattatgggatttgcattctttaatgattattggactaggcaggctttttgttacatcttgaatcaattttggtaggccttggtccttgagatgataacattggtctcttgattatccacttgctccaaggagggttttacagactactccctaggcttgaaagcgtggggtgaataccaccgggagtacacgagataattgtaagaggtgtgtagacttggttttaaataacattgaactacatgatgagaagtcattctcatttcaattatctttgaatccttatggttaagtcaagtggaaagtattggtttggagccagcatgtcccacacctcaaaattaatgtttatttttatcaaagtaatttatgtacgtgatctgaagataaagtgggattacaggttttatgacaacaaataactcttccttgtccctacctcccctctccctctatccctagagataaccctttttgattactactttgggtatttacttctgtatttctaaacattatactttcactgctatttattgattcacaaattttagacattgtcagttggcttctttttatggaagaaataatttcatgctcctttacttcttcttttccttacctcatccttccagtaacattatatcactctgttaggttaaatcaatagccaatgtttataattattgtgattaagaaaataatgttgaaagcagggccttatagtatactgtggttacatttccttcttgtgcaattttttttccctagggttaataattgctctttatttctttgtttgcttagtttcatgcccaaatcttctgcagaactgaaaatctcctttcgttacattcaaatgcattagataatctagtaatacatttttctgtcttggagtcatttctgcctgagtcctccacttttcgcttcaagttgcgggatgctcttggtgcttgctgcacagctgctatcctgggacttcctgtcaccatcctagaaatttcccttatactgtcctgatttggatttcctggacctcctgttttcctgtttattggttttctctctctttttagtggagtgcacccttcagaagcttcctgagaaagggtgaatgtttggtaaagttttgagacttcacatatctgaaaatgcacctttatcttgcctcacagttaagggatggcttgtttaaatgcatttctgtattagaaatccttacccttagagtttttgaaaaaatttgctccatggcttcctagttcccactgatattgttgagatgttctgtgctattctgattctggaccttttgtttggaaactatggaagcttcaggatcttgcctggcctactgtcccgagatgttaatagcattgtgcttgttgagaggctttttcttcactgtgctcaaccccaggtgaggccttttcacagcctgaaaactcatgtccttctgttttagaattttttttttgttttgagacagggtctcagtgttgccttggctgaagtacagtggcacaatctcacctcactgcagccttgacctgccagcctcaggcaatcctcctacctctgcctcctgagtatctaggactacagatctgtgctacaatgccctgctaatatttgtattttttggtagagataaggtttcaccatgttgcccagtctggtctcaaacatctgggctcaagcaatctgcccacctcagcctcccaaagtgctgggaatacaggtgttagccactactcctggcccagaatattttttaatattatttcttcccccagatttcctctccttcattttctctgttctttcattcttaaaacgcatactagttgtgtgttaacctccaggactgatcctctagttttcttttatcttcaggttttcataattttggatttttgttctttcagaggaatttcctcaacttctaactttttatctgaaatttgagatatcataattttaatttccaataacttatttttattctctgattgctttttagttgttggtgctgatgttaaaccgtcacttttttatttcattgatgtagtttattctcttatatttgaggattttaattataattttaaaaattctctgtaacatttctgtttcttccaagtatctttgtgtcttttttggcctttgtctttcatttgtatttattatttacccattaagtatttattgagcacttctgtgtaccgggcattgttataatagcttggcctagatccatgaacaaatcccacaaaaatccttgccctcttggagtttgctgaggaagccagaaaataaacaataagcagatgatattataagaaaataatataagctgggcatagtagctcacacctgtaatcccagggactcagtaggcccaggcgggagaactgcttgagaccagaagttcaagagcagcctgggcaacatagcaagagccccctctctctattaaaaaaaaattaaaaaattagccacatgtgggtacatacctgcagtcctagctacttgggaggctgaggttggaggattggttgagcccaggagttcaaggcttcagtgagctatgatcatgccactatactccagcctgggcaacagcgaaagaccccaactcaaaatgaaagagaaaatcatatattatgttagaaggtaattggtgctaaaaaaaaaaaaaacaaaaacagaaaggatagcgttgtaagagggtatgggatgggttcctggggggtaagttgggtggtctgtgatatacaataaagctatgggtgtaggtcccgctgagaaggtggcatttgtgaacatgtagagaaagagctcttgggtcagagacaatagtcagagaaaagcccttagctgaggatacacccagtgggttagtcaggaggttagggggctgcagggagcctggcagggagtgggaggaggtcaactcagagaggtcatagacggctgggtcacactgggccttaaaggccactgtaggggactttggcttttctctgagtgaaatggaaagtcatgacagggttttaagcaaaagagtgacatgatcttatattttaaaaggagaatcctgtttgctttgctgagaagagcctgtatagaggcattggtagaagcagaaaatgcatttagaattccaggcaagagatgatggtggctgtgttgcagaatttttgctccttagttcagctaaaactgggttcttgtcacatggccaggaaagattaggcgtgctgacacattgaagggtgagtagagcagaatttattggatgtaaaggaaaaaaagaaaaaaaaaaaaagaaactcaacaaagcgggagggggtcctactcacaggcccctgcctcgcagattaattccaggtcaccacccacgagctggagaccaggctcctccctctgcacaaggttcgaacttcctgtggctccaccctgttcctccagtgagcatgcaggctttattcagaaagaatcagtttggaaagggcaggcaagcgggggcagttctccctcagggtggcaagtttcatcctggaccagcagtccaggctttcagccttcaagcttttttagacttgagggtggggtttcaccagggacccttggctgtctcctgtctctgtcagctagagccagggagatagcagtgaaatgatgggaagtggtcaggttctggatatattttgagggtagactcatagaattttctgacataatgaatgtgaagtgtgagaacagtcaagaatgattcttggattattggcctgagcatccatcccaaaggatggccttgcgatgatctgagatggagaaggctgcaggagaactggttttggggaagtattaggaggttctgtcttgacatgttgtgtttgagatgtgacttaaggagaggccttaagcattatgatctactaagctatttggattgtttatgattgcatcataaactgacaaatacattgttggttacacctccaagtagagaggcagctggataaacaaatctgcattttaggagagagagctgagctggaaatataaattcaggggtcattggcacaggaagatgatttacagccatgagactggataaaatcacttaggggagtgtgtgtaggtgtattagtccgttttcacactgctgataaagacatacccgagactgagcaatttacaaaacaaagaggtttaattggacttacagttccatgtggttggggaagcctcacagtcatggagaaaggcaagtcacattttacatggatggcagcaggcaaaaaatgagagagcttgtgcaggggaatgcctcttttaaaaaccatcagttttgtgttttttttttttttttttttttgagatggagtctcaccctgtcacccaggctggagtgcagtggccacaatcttggctcactgcaacctccgcctcccaggttcaagcaattcttgtgcctcagcctcctgcgtactgggactacaggtgcctgccaccatgcctagctaattttttgtatttttaatggagacagggtttcaccatgttgactgggctggtcttgaatgcctaaactcaggtgatctgactgccttggcctcccaaagtgctgggattacaggtatgaaccaccgtacccggcctaaaaccatcagatcttgtgagacatattcactgtcacaagaatagcatgggaaagacttgcctccatgattcaattacctcccaccaggtccctcctacaacacgtgggaattcaagatgagactggggtggggacacagccaaaccatatcagtaggtaaagaacaaaagaggactgagccctgatggcatcaggaggtcaagatgatgacaagggtcctgcagagagatctgaataaaggagatcttagaggttttacccaaacatctggtattaataattctcaactggctgttaagaaagaggcattagagagtgacgtggaagctccatgtgcatggctggggcttatgattggtcaggaggcagctttcttctggagaaccctcaaagtatctgtaggtcatctttctggtaccacttagtttctctagagaaaactctttaaacctccttcaggggttgaaggaaagaggggtggagataggataataggcctgacttttgagagtgcagtagtaaagacaggaaggtttttcgactgtgcagtgtgcagcatgcagattctgactgttttcaggacagaattttacccccaccctctattattcctgaagtccctaacagtctctggttctgtttctccaggcaataagcctcccacctcctgtgatggggagcaggctggggctcaggagtgggaagcagaggtggagggcagctaagccctccttattcagtttttcaaccactcttaagttccagcctttggcctctaaggtacctggggtgcccaattcctgagcttcttttggttctggggtaaggatggtctcagtcttcattgcttcttccttcagcaggcacataggtttcagctttctgtactctaccagtccagccactgttcctccatgtgctgtctttcccgcagaattttgctaatggctctcttccactcttgagagattgtttggaggttccagcaggggagcatagctactcatatacccttgaccgaaaactggtcctcctctatggaggatggtcgtcctctttgactgagcatgcagctttgggagggacgcacatggagtggggagggaggaagggaacacccgcctagccagccagatcagccgaatcaaccctggcaattgatggggtgacagatgttgcagccagattaccctcacttcctctcttttactcttgtgtctgctctcattctctttgttcttgattactcatatctatttttttttctttaactagcattttagtgaagcttcagaagtgagaagaaatgagcatgggttcaatctgccatgtttaacaggaagtcatcatgatacatttttgatatcctgtgcacacccattttcccttgtcaacaaaaagagtcaaactctataaaatacttaaagagatttatgtatgtatttatttatttttagacagaatctcactctgtcgcccatactggagtgcaatggcgcaatcttggctcactgcaacctccccttcctgggttcaagcgattctcttgcctcagcctccccagtagctgggactacaggcatgtgccaccacacccggctaatttttgtatttttagtagagacagggtttcaccatcttggccaggctggtctcaaagtcctgacctcaagtgatccaccctccttggcctcccaaagtgctgggattacaggcatgagccaccacacccagcctgaagagatttattctgagccaaatatgagtgatcatagcccatgccacagccctcaggaggtcctgagaacacgtgcccagtttgtttggggtgcaacttggcgttatacattttagggagatatgaaacttcaatcaaatacatttaagaaatacattggttttgtccagaaaagtgggacaatgtgaagtgtggtggggtgggagcagggggcttccagcttataggtagatttaaaatttttcctggttgacaactggttgagtttatctaaagacctgggatcaacagaagggaatgtctgggttaagataaaggattatggagaccaaagttcttgtttgcagaggaagccttcagatggtaggcttcagagagaatagtttgtaaaacgtttcttatcagccttaaagtctgtgttgctgtgaatgctgaagaggtataagggggtatgtctgactctcactttccatcatggcctgaaacagcctctcaggttaaatttttaaaagagccctggctgaggaggaagtccattcagatggttggggggccttagaatttaatttttggtttacaccctattcaacagagaaagaatctcatggtcagagccgtcagcaatcattagtatctaactagaatttagtaactttttgctttcattggatttatttttatacttaacctttatttagaaagctacactctttctgctcttgtaatgatgtaaaatttattttttcttaatttaagcaaaaaagctgatttgtagaaagatagtgatacattaaaaggctaaaactttcacagtgttagattaatgcttgaagtttgggagacactatgctatttataaaaatcatcacgggaggaaattccggatcttcccactttgtctttcatgatctgaaaacttgttgggaactactgggtatcaaggaggctaagtccctgggccacttcttggttctatttttattctcatagtttccacaaatttgactttctttgaagttattttgctctccctcctcttctatatctggaatcctcttgtcccaggaataaaactgaacaccatttccaagtatttctctcaagttactatttataaagtaagtactgtatacaaacccagtttccttgttagagatgttttgctttgttggattaatcatggtagaacagagagtagttaaaaaatgacgatcaataatcaggacagatttggagccaggaaatactttgagcaacaacacagtagttgttcccctggtttctcactgaagagtgaatggggatggctccactccatactttgaatttcttcttgaattttcccagccctagcccaatttttgccttagattctaaggcgtaggataaatcgggccaaaccaaatcaagagtcattgcttgcaaagccatttagactttatctgaagtagttagagcagaattccctgggataaccagttcagtccaaagcctacttggttatctgtttttttccctggaggaggaatgcactgtcttttctggctctcctggaccagaagcactggtttccctttgcctctttggaaggacttagagcttagaggtccagccttttccctacccttttctcctgctgattttgccctcagcatagccaagaagcccaaagttatgactaattctatctttaggtggacctggacatctcatcagcgtcacttcaaggttcactgatcctaaaggactgtttcttgttggaaggtcatctcagggtgggtatctatttgtgaccagagctgatatggagtccagcctttctgagttactagccctgggctccttaaaatctccattcacttcctcttcccttccttacaggagaggacttacagatgacagtctctagagtcttgccgtcttttgccagaatacattttttaaaattgtgaaaatagcaactataatttcaccaaggaccattcctttacgttattactgaatttagaaaattctatctcatctaatctgagcaccttgatccctttagagtaaagtcattttataaaatctaaaaagtagatccaagtaataaattgattttcttgcaatttaaatacatttcctctgattctaccttcactggaaggggagaatagctgctgacctcactccttttcatgtgctgaaagaccattattaagcatctttcatcttctggattttgaggctagggagcactaattcttcagctttttttctccaaccatttagaaattttggttctctttagacaaaaatttttaatattatttctaaacctggagtctagatgtatatctagtatactaataatggtttctttggtgctggttaagacagaagaattgcttcttagttcttgtgaatgcactcctatttgcttaatgctgaattattcagttcctgttccaaaattaacctgccacaaggcacaggtaagcctgatcatcgtgaatctcggtaccctttagaaatattagcctcttctcattctactgtgattctgtattttttttttttacattttattaactttttaatgtcattttgaattctgattctgaaatttggaaattaaaactagtgaccttaatgcatgtctaaaaactatggagaaaaagaaaatttacaagaatagtgatttttcaggtattgtgcaactataagattacagtaatgtgggcaactggcttttgtaataagtggaaaaaaaagagacagtaaacatattcctgttttcttacaagtgtaaccatcatggacaatagcagaaagcactagatgcccttatccactgaattattataaagggctgggggctgggcgcagtggcccgtgcctgtaatcacagcactttgggaggccaaggtgggtggatcacttgaggtcaggagttcaggaccagcctggccaacgtgatgaaacctcgtctctactaaaaattacaaaaattagctgggcgtggtggcacatgcctgtaatcccagctacttgggagctgaggcaggagaatcatttgaacccaggaggcggaggttgcagtgagctgagatcacaccactgcactccagcctgggtgacagagtgagacgccatctcaaaaaaaaaaaaaaaaaaaaaagggatctcccaaaatgacagagtgactctgtgtgatgagctcctcaaactccagtgtccttaccaataccaagcagcatctgtcacataatccgggagattctccaggtggtcaggggacaagagggagctgggaggtggaggaactgcaaatctcctttccctgcatgctctttgtgttccctacaagcagcaccactgaagggcagtggtgggactcatgctctcctgccaccagccgccacctccctattgtgtcccactcagagttacttgacaaggagcaatttagacagttacacgtctttataaaaagattaactccagcaacctctcatccccaagccttttctgagcatattaacctgttgctctgatcccagtcagtgtaatcatccaaaagaccgcccagggtccaaagtcagaagaccaaggccgggtcatccattcagagtgcaaatggctcatggcagtgtacagcccactggttcaggatgagtcacctaaacaagaagagaaaaaatcagaagcaaacagaaaacctgcaagaagcaaacttcctttgaattgctttgtctgtttttatttagaaaaagatctactgtgaacctggcattagaaatggctcatgaggttttccttaggagaatgtttcatattttctgaacaaagttgttgcaagcaaagttgcatattgtgttcgttggacacggtcaaatagagaaatattcataaaaagttttaggccagaagtctcccaagtgatgtgcccacattgaaggaatacactaagtaatccactgtgagggtgaggaaaatattggagcatctgtttatacttattcttaaaatcctatcctttaattaaaaaaaattttttttgagacagagccttgctctgttgcccaggctggagtgcagtggtgcgatcttggctcactgcagcctccgcctcctgggttcaagcgattcttctgcctcagcctcctgagtagctgggactacaggcacgcaccaccatgctcagttaatttttgtatttgtaatagagtcagggtttcaccatattgtccaggctggtcttgaactcctgacctcaagtgatccacctgcctcggcctcccaaactgctaggattacaggtgtgagccaccgctcctggccttaaatttttttaaaaaaattttatttttttatagagatgaggtctcactgtgttgcccaggctggtctcaaactcctggctcaaatgatccttctgtctctgcctcccaaaggcccgggattacaggtgtgaaccagcttcctgatcccccatcctttaatttttatgatgtttgttttataatgaatatgatattcttttccagttgaatgtattagctgtgctaatggataaatcccagattctccatggtttaacacagtggaagttcatgtcttgctcaagtctggtcctatgtgggagctcctgggtgtgggcctcctctgctgcaggaggatgtgtgcatatttttatggggctgtgcaactgttagagctatgcaatcagaaaagtttggagactagtgttgaaggaactgccacatttggagctgccaggccacagtttgattctttttcccacccccaaataacataaactttgtagtatacttattgactgagacaaggcccaaatagcacttagtttgggccatccttactgctcctggttaccagatccaggtgggaatgtgcagtagtcctgagcccccagggcccaggctccatggtactgggatgaacaacaaggggtctcagcagctttaactactcaatctccacagtgcccaccagactctttccagttcttctgggtcttacccagttttagcacttaaagctccatgtccccctaaattcctcagtcccaggcaaaccaagatagcgttcatgggaagcttcaatatcaaaggagcaggggattgttcaaagagggctctcgccagggaatgagtatacacagcctgttttcccatggacagcctgtttttccagtatggacatgcagagaggagacagtggtcataatcaactctaccccctgttctcacaggaagggaagattgacagctactgcaggctgtttgctgttccatttgggaaattttcctgaggatcccctgtaataagaggatagaatatatctgccttcatgacttaaaagaggctataaattattttcatgtcaatgaaactgtaattagccactgacaggattgtcaagaagtaattttcagagtttggtccccttgagttaaacatgcctgctgacagcttactgaggacgtgttattgtgggacaccatccaggcctggagggacccagaatcaggcagaaggacatggtcacatggtggaggggctggaggaggtgacaattagcaggtagaatgggattccaggtatttcaaggccaaaccaatacttggtgctttcaccaggcaggcagcagggaagactgtcagcaacaaacagggcaccccactggcagtcagatgatgatgatgatgatgatgatgatgatgattattattattattatttgagacggaatctcactctgtcacccaggctggagtgcagtggcgtgatctcggctcactgcaagctccgcctcctgggctcacaccattctcctgccttagtctcccgagtaactgggactacaggcacccgccaccacgcccggctaattttttatattttttaagtagagacggggtttcaccgtgttagccaggacggtctcgatctcctgacctcgtgatttgcccacctcggcctcccaaagtgctgggattacaggcatgagccactgcgcccagcaattattttcaatctctgagagatgatagcaagaaatgggcaaagtctcatttccaagggactaaggcttgaggcaggtcagcaaaagagggaccagggtgaaagtacaatgagcacagctgggacgtgaggttggggtgagctcagcagtgaccagccacttgtaggggacaaagggcctatttcttgagaaagaaaggtacagagatatggtgctgagctgctccagtactccaggtgttgccatcctgtgagcacaaacgcagctgcaatcacatccttgcctaaatctcagtggcttccagccacctgctgctcacccaggatcccagcaccccggttccccatcttcccaattccttctgggaatacaggggatgtgcccagggacacagctcctgctggcaagcagctgaagcaaggggctatgccactgtcctgctccccagtcctctgtgagtacaataccctccccaggttctggagtgccttccaccaccaccaggagctgctctgggtctgtggcagagggagattaagggtgtgactctccccgactttgtctcttctgtcatctgaggcatggcaccacttgtatctggaatctcaccaagtttttcatgaggacgatccgtcagcatctgttctggtctctggtttcccattaggtgtgaaactagttccctagcttgtgagggcagcaggggaactccaaaacatcccctctatttttatttcctttctccttgctcaaaggccttcttcctctttcagataagagacacaaaagcacacatgcctatcaatttatgtggacagacacccaaagggcttctgccctctgcagtgcagtttggacttaggacattcttacacaatattatctctttgtccccagatgccaagccaaggccactagaaaaacctctaaataattagacttttatgaaggctaacctgggctatttttgaaggtgcttttaaaacaatcttatcacacctaattttgaataaagatatgttgtggaaaaacttgatgcttacatttggaataatttaaggtgtattacaaaacaataaatgatgggacaattgtgttatgtttccaaaaaagttcatataaaatttcagtgagtgggctgggcgcggtggctcacgcctgtaatcccagcactttgggaggccgaggtgggcggatcacgaggtcaggagatcgagaccacgatgaaaccccgtctctactaaaaatacaaaaaattagccgggcgcggtggcaggtgcctgtagtcccagctactcgggaggctggggcaggagaatggcgtgaacccaggaggcggagcttgtagtgagccgagatcgtgccactgcactccagcctgggcgacagagcaagactacgtctcaaaaaaaaaaaaaaaaaaaagaaattttcagtgagtgtggaaggactagagccttcctctgctactactacattttacctcgtgggaaacaggcctatggatttagccaaggaaaaagaaacgtgggaatgctgtttattccttgcatagccgtaatataaagtatgaattttatcaagtatcttttcactcaacctatcatagccactcaaaaagatgttaatggaaagacaaccatcagaagcaaaatcatgccaagaacgagaagcagcaggaggaaaaactttggttacttctgtgagttctagaaagttgtagttacggtttgcaagagtatcagtgttaggctttagacaagacattccttgggtcaccagtggccttttgggtggtaatggccacagtccaaaaaggaagaagaaagcaattttgcattcatattatccatttccaattttttaggggactgatggtcactctcctggcccttagagatgtgtgtgggtaacctcgctggtgtctttgctggtggggttaaaattttccatacgtgcttcaggactctacctcagccatgtctttctgtgagcattgagcttgttaatgatgcatgtttcttacccagctttaaaagatgattgagttattactggggagttattattggggagttttttcccatgtagttgaggcataagttgataaggttgagctgacctagacgcagttttctgtgggattatggagaatgagggaagaattacgctttgtaattatgcttttttttttttttaaattcagagaaaaaagatcacttatggtgacccaggctaaaagacctaggtcttcaacaaccagcgtcatctatttctagatcaattgccttgtaatattaagtatttaagctttgaggcttactgaaggaaagatatggggtcatttacaatcctgtagactatgaccttccaccaggatctactcaagacctcatcacacattatgttaaattctttctggtggtgaaattgtcagcaaagagctcggccaacctaaccaagatcacttggagttataccttaggagggaggatgaatataagtcatctttttcccctttgttagatgcagatgaattaattatagttcccagagaactattcccttttgcttaaattagtgtcagattttccatccacgtcttctatgaatagaggcaatatgacttgacattaggacagagctttggaatctagagatggatgctgtctatctttgattctctgcaatgcatgtcagtctgggctctcaggccttagtttcttcctccataaaatgggaatgaaatatgctcactgatttacttcaggagattttaagggaattatttaaagaccattttgtaatgttctgggtaactcaagtggaaggcaatggatgtgagggaatttttaaaataagaaatctcttgaatatgaattgagtaatctcttaagttctttagataagatatggagtgatctttaggctcaggaggcctgtcttttgggaaagtgctataactcacttctactaccggcaacttaatacgtaagagaatattcttggccctgctctgaggtttaaacaatgttcaaccttgaaagattgattttaaatgtaaaggtcatttaaactcttttgtaagttcttatattttgttaaaataggctgaacatttacctctagatgaaaaatcaatgcttcagtgtatacttttctcataaaataacctatgtctttatttttttctgcagacaaaactgtgtggagttttatcctatattcataattacattgtggatggctgggtggtatttcaaccaaggtaatgttaaaatacagtcaactgtgttctaatgatgactgtgatgcttaaacgattaaggagtagatatatggccaggcacggtggctcacacctatattcccagcactttgggaggcccaggtgggtggatcacctgaggtcaggagttcgagaccagcctggccaaaatggtgaaaccctgtctctactaaaaatacaaaaattagctaagtgtggtggcgcatgcctgtaatcccagctacttgggaggctgagacaggagaatcacttgaacccaggaggtggaggctgcagtgagctgagatcgtgccactacactccagtctgggtgacagagactccatctcaaaaaaacaaacaaaaaaaggagcagatatgcaactatatagctaccaatcctggagactaaacaaaataaacagtgtgtgcatcagagtgctatgttgcaggtatatgaactttggcttcattctaatttaattcaataatgaaaaaaatattgagacaaactatatgctagatactcaagaatgagaacgacatgagctttgtcttcaaatctaataatctacagttgactcgaacaatggaggggttggggtgctgaccccccgccccacacacacacagtagaaaatctgcatgtaacttgataacccaaaacttgactactgatatcctattggtctggaagccttactgagtacagtctactaataaatattttgcatgttttatgtatcatatactgtattcttgcaataaagcaagctagggaaaagaaaatgttattaaaattataagtaagaacaaatatttactatttattaagtggaagtggaccatcataaaggtcttcatcctcatcattttcacgttgagtaagctgaggaagaggaagaagaggggttggttttgctgcctcaagggtggcagagtcagaaaaggtgaaggaggtggaagcggagacagaattggcaggcgcagtaggtataaatttatagaaatatcatttctgacgtttttgctttttttctctaaaaatgtttctatatagtaccaatccttcttccactgttacgtttagtttcagtgcttgtatcatagaagggtccatgtcataaaagaagtaaaaaagcagacttgaatcatcagaacccttctgccagattgtctaatgtcaatttgttttctggtactgcctcttctgtcttcttccttatcatctggcagtggttcagagcactcgtctctaccaagtcatcttctgttaattcatctggcgtggtgtctattagctcttgaatttctccaagattcatatcttgagacccttcatcccccacattctttgccacagccactatctctttcatgatttccttgattggctctgttgtaaatcctgtgagtgtcatgcacaacgcctgtacacagtgttcttcagcaagaatttattgtttcaggtttgacggctttcacaaccttcctataacaatgctagcatcttcaatggtgtaatccttctaggcattcataatgctgtttctatcagggttctcttccacaacattgacgatcatatccatagagtaccttgtatcatgagccttaaaggtcctgataaccccctgatttagaggctgaattaaagatgttgtgtttgggggcaagtagactacttttatgccttccacgttgaactcatggggttctgggtggtcagggacagtgtccaatatcaaaagaatgttagaaggtaatcccgtcctgacttcagggacaaagcattgatggaaccaatccagagaaggggttcttgttgtccaagctttttttttgtacaaccaaatgactggcaggtgctgtttatctttttccttaaggctcagggggttagcaactttatagataagggcagtcctgattataaacctgactgcatttacacaaaacagtagagttagcctatcccttcctgccttaaatcctggagcttgcttctcttctttactaataaatgtcctttgtgactttttttttctcccccgggacagggcacttttgtttgcattaaaaacctgttcaggcagatatcctttctcctcaatgattttcttaatggtgcctgggaactcatgtattgcttcttggttggtagaagctgcttctcctgttatcttgatattttaaaagctaaacttctttctaaaattatcaaaccatcctttgctggcattaaattcttcagctttagatccttcatcttccttttgcttaaagttgtcatacaaggattttgctttttctcgaatcctattagagtctacaagtatgtgtttcttttttcttttaatagtttaatgtattttaatagcaaacttacaggaacagcacagaagacagacaacattaaaaacatgtacttgcatgtaggacaactcagttagaaaagtatagtgaatggatggaatctactgtatgataaaaatgctacaagcaccatttagttgccatcaataagaaatttacttgttttaaaaaaatccaaatgctggcattgtccagaaaaatttaacaggtttatttataattattataaagttgaaccgctgaaacttgttcactgaaacattttaacttgcattaatgctttacgtctccgcatttatattaaaaattcacacacaaatgaaaatggaaaaactgccaatacctgatttctgtcccctatttttccactcgcaatcatatacttaggtaccttttgaccccatggaaaaaaattatctaacgttcagaactaccaataacaggaagaagagaaatttaattttttttttgagaatgaaatgtttcccatcatagtggattcttaagcacgttctccacgtatgcggcgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgttttaaagtcctgagcaatttctcgcaccagacgctggaagggaagtttgcgaaccagaagttcagtggacttctgataacgtctaacttcacggagcgccacagtaccaggcctgttacgatgaggtttcttcacccctccagtagagggcgcactcttgcgagcggcttttgtagccagttgcttcctgggtgctttaccaccggtcgatttgcgggcagtctgctttgtacgagccatggtacagagacctccttacttaccccccttctccttcggctggagctcggcgagcgagaggcggcgctggcgttggagagccaagtatgtgtttcttatagcaatcctgctcccacataaaagctgcatttcaatatgagataaaaagacattttggaaaaagtgcaaggtttttccccctgctggtgtagctgcaagtgacagctttacaaatcactttttctttcttttttcttttcttatcttttcctttcttctttcttcatcttcttttttttttttccactggtccttgcactgaattcatttatcttgcaatggtggtcaaccacagctcacagctgcagacctcaatctatgacacatattaagccattcaattttttcttgtaatatcataacttttctctgctttttgggagcactttcagcaccactagtagcaatctgtatgggtatcatggcattattcaaggtttatggtattgcactaaacattgatgaaaaataggcaaaaaccctgagagatcactttttactgcgatacgcaattttctggaaagaagaactgctcagttggagataattagcatcaccttttaagcagatacttgcaacacttgagctcactgcaatagcaacaggaggtggctacaaaatatttacagtagtacagtatttctatagttaattttatgcagttatgatttaatactgcatctttacacttgtttacatttctctcaactacaagtggcatcatgcattatggtctgtgtttgtatgctttgataaattttaactttgcataaaattcatatatatatctatatagtctttctgctgaagctttgtaaaaatttgcgtatattttatgatagtaaatgataaaatagaccagtatctacatctgttttgtgcatttgtgacagacctttttcctaatttttcagtatttctgggctatgtgattcatttgtgagttttgtcacattgtcacaaatctccaaaatgttttccaatatatttatgtttatttttgtaaagccacctcctgcacaatccaatatatttatttgaaaatatccatgcataaatggacctgtgcagttcaaacccatgttgttcaagggtcacctataattctaattaactgaaggaggaggacacagaatgaaaaattcacattaataattatagctggcgaggcccagaagcttatgcctgtaatcccagcaatttgggaggctaaggtggagggattgcttgaggccagaaattcacgaccagcctgggcaacaaaggagaccctgtgtctacaaaattttttttaaaaaactatctgggcacacatgtagtcccagctacttgggaggctgaggtgagaggagctctcaagcccaagagtttcaggctgcagtgaatcatgacagtgccactgcactccagcatgggtgacagagtgagaccctgtctcaaaaagaaaataataataattatcattatagctattatttattgagcccttactatgtgccaggtactgtttttgttttttggtctttggttttgctttttttttttttttttttttttgagatggagtctcgctttgttgcccaggctggagtgcagtggtgcgatctcggctcactgcaagctccgcctcccgggttcacgccattctcctgcctcagcctccggagtagctgggactataggtgcctgccaccacgcccagctaatttttcgtatttttagtagagatgctgtttcactgtgttagccaggatggtctcgatctcctgatctcgtgatccgccagtctcggcctcccaaagtgctgggattacaggcgtgagccaccacgcccggccaccaggtactgtttttaagttttatgcatacattgtcccatgtgtaagatttacaggatttaaagccttcatatgagggagggtctataattaatttatactttacagatgaggaagctgaggtacagagatgttaagtaatttttccaacttgacattcaccaatgtggggaaatttttcctttcaagtgcagagccgggtctgtaagtatttgtaccaacaacccatgcaccttttcttaaaggtctccaagtatgtagtgctgccgtttgtatgtagcgactctacaaacatccactttctatttgactggggtatccttggtgagctgagggctttctccaaacttggcttatgcgtttaacagtgagtcagaccagcccctgctaccttcgttggagaaattcaatctcctttttctggtaactttcactgtctcattttggtctatacttgattgccaagatttaaataaaccaaaatccagctgctttcaaaggcaaccccatcactctctttcttttagtttttactgtgaactgagtaatttcaggtacaatgtcctttagagaaagacttcttcactttattacaactatacttgtgtcgcttaagggcatgaatgaaaccgctgttccttgtcacgtaagagcacgttaacaactaataagaaaagcgccttttggtaatgggactctgtctctgccatttgaccctttggatttctctgtgataggctgaatgaggcagactgcctgtcagaaaggattgcttgagtatcttgtcagaaatttcttttcattctttctcatccaaagtaagtcacctactaactgttcctgaactgttctcattggctttctgggagtaactccctagacagggagtctcaaaactgagaaccatgttcagaactctttggcttcctcagaccctgggaagggtccaccagctcttccttcccagctctttgcttggtccgctcgttcctgtcctgtggtgccgatacagatgtcatcccctccagaggccttcctataccccattttggcaacctcctccagttcctctctctcccatctctcttcatttctttcacagcactttcaagtttgcacttttcttctcatttttttctttgttgtctgtctttgctgagagaatgtatactctctgaagtcagggagcttgtatctttttcactgccgacctcaatccttaaagtaatacctggtttatggtagatacggggctgggtgtggtggctcacacctgcaatcccagcactttgggaggccaagacaggaggatggcttgagtccaggagttcaagaccagcctaggcaacatagggaggccttttctctgaaaaaaaaaattaaaaaattggccaggcctggtggcatacaccagtggtcccagctacttaggaggctgaggtgggaggattgcttgagcccaggaggttaaagctgtgctgagctgtgatcatgccacacattcctgcctgggtgacagagcaagaccctgtctcaagaaaaaaaaaaaaatcatgcggccaagtaaaataataaatttaatttaatctagcatatcgcagtcccacacatagactccaaatgtttacagtagggctctggcaacttgcatctgtgaggtgctgaggaagagagtggggccctaacatagggaagacattgatatgtattgatatgtttcactggatgcgatgatagaacatcatcatactgtatttcataattctttttgagataaattttgtatgtaataaaatgcataaatcttcaatgaatgttgagaagtacacacacctgtgtggtccagatctctatcaagatctagaacatgacaaccacccagaaagtgtcctcctgcttctcccagtcagtccccattctcactcccagatgcaagcacttctgattgttttcatcagttaggtttgtccattctagaacttcgtataattggaatcatacagtatgtagcctgtataatgcttcattcactcagcaaaatgttgtgttgcatagatctgttttttttcattgcaaaatgttgtgttgcatagatctgtttcttttaattgaatagactctatcacagcttggttatccattctcctgttgataggcttctggactgtttccagtttttgtctataatgaataaatctgcaatgaacattcttaaacaagtccttttgtgaacacatgctttcatttctcttgggtaaatacataggaatgagattgctgagtcaaatgttacgttcgattttataagaaactaccagaacttttcccaaagtggctgtactattttgcattcctgccaatgatgtgtgtggattccagttgcttcacatcctcaccaacattttgtgttactggtttttttttttttttttttttttttacaattttagccattctgttggatgtgtggtggtgccatctcattatagttttttatttatttatttatttttcagatggagtctcaatttgtcacccaggctggagttcagtggcatgatcttggctcactgcaacctccacctcctgggttcaaacgattctcctgcctcagcttcctgagtagctgggactgcaggtgcccgccaccatgcccagctaatttttgtatttttagtagagacgaggtttcacaatgttggccaggctggtcttgaactcctgacctcaagtgattcaccccccctcggcctctcaaagtgttgggaatacaggcctgagctaccacgtccagcctcattatagatttaagtgggaatttgttgatgttgaatcatgttgaaacatttttcttgagattattggcacatttgtttccttcctatgtggattctctctatattctgaatataagtatcttgtccaatatatgttttgtgaatattttctcagtcgtcgtacaacatcttaagagactgctgttgtattttgtgccttttctttttttttcccacccccctatagtttttgctacttgtctgggtctggtgtacatatatggccgtcacctatacttctggggatattcagaagctgctaaaaaacggtaaggagaacccagtaattttgtatttatgcaaaaagtagcaggataaggtctgggtcagtttccttctcctgagagatattaacagcactgtgagttgtggtggcaaaagtaatccatactgtctgaggtcaagtcttgccagttcatacacaattaggcatgagatgggaaaatgcaagtataaaactgtgcactgaatgtggactctagttccttgcaaaaattttgcattgtctccagaaagttaccgaggaaataatcctgcctagccttgataatgctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctcatgtccactctgcaggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaatggctttgtagaaacacacactttagagaatacatttcctgtttaagaactgaaatttgcttggggtaggtacatccatatcatcagtggaagtgtgttgtgccctagttttagaaatgcatgctgaagtcatgaccggttgtgtagggacacagcagcctgacccgtgtgctggccgttccgaggactactgacatatcctgccactctgactgcttctctcttgatggaaagtttcagacagaagctgataaagcagctgagccctttcattggttataggaaaacaacagataggaaggcatgtgggggacatcaggcaaacacatagagtagccagagaagggagtcatcaactgatagcacaaaacaaaacaggttatagaaggctgggcgtggtggctcatgcctgtaatcccagcactttgagaagccgaggcgggcagatcacaaggtcaggagatcgagaccatcctggctaacacagtgaaaccctgtctctactaaagatacaaaaaattagccgggcatggtggcgggtgcctgtagtcctagctactcgggaggctgaggcaggagaatggtgtgaacctgggaggcggagcttgcagtgagccaagatcgcgccactgcactccagcctgggtgacagactctgtctcaaaccaacaaaaaacccaaagaaaaacaaaaacaggttataaaaatgtactttataaagaaaaaagtgtttccaggccaaaagagcttgctgcctgatgcccatactgtaaaaccaggtttttgggaaaagaaagaaatttaattttaaaaaagagacggtcttgctgtcacccaggccggagcctccaacacatgggctcaagcgagcctcctgcttcagcctcccaaagtgctgggattcaggtgtgagccactctgcccggccaacaaaagctttatattgcaagtcaactcacaggaagataggagtcaagctcaaatctgtctccctctgctggcttccaagcagtatttttattagaaaatgtcagggggtaaattctgagattagtaggtgattggtggaaagaaaggggaggtctgaaaagtccttgggcatgtccagttatctctttatgctgcctcagaggtagcatgtgcaaattccagaggagttagtatgaaatgtcatggaaattcaggctgtgacatcagcaagcttgttctgtgcagactccagttagccatcttggttccaacaaatttcagccagtttttttttaatctcataaggagagagagtttcagtgtttcagtaagttatttcttttcttatctgccatcctccaaattcaagaatttcctttagttattggtttcttgaactctttggggcacaatttcaagaggaagaagtaaaaaaaaggataccatttcaaggaattgcccagggacaagtgcgaagagaatattctttctcttggctgaggaaggtgggtcatgctcacggctgtagaacgtgggttgggttctgctgcatgccctgtgtcatgtggggtttggagggtgatacgggaagtacagcggaacccccaaagctgttctgaccctgaagtgcagttattgtctggcaaaatgcagatgacttttcctcattttcttcatctgtaaaatgagaacgattctacctcacagctttcaaataaaaggcaaaatgaattatgagcatacataacacattttgacgtcaggaaaagggcttgagtctggtgtgggcatcttcaaaaattgtttagtagtacttttctttttttgtggatacaatagaagttaaaaaggccgggaaaaatattaatagaaaaagaaagagagacacttaaatactagtgttcccataatacataacctcctgcatcccaaatagcagtacagtattaaataccccaaagcacactgagaatatactggcctgggagtgggcacatttgcatactagctcaggttcccctactcat

SEQ ID NO: 16128 - DNA, 7130 bp, Human
agcggctcactgcaacatccgcctcctaggttcaagcgattctcatacctcagtctcctgagtagctgggattacaggtacgcgtcaccaagcctgactcattattttgtacttttagtagagacaaggtttcaccatatcggccaggcggatctcgaacttctgacctcaaatgatccgcccgccttggcttcccaaagtgctgggattacaggtgtgagccaccgcgtcccgtctatcataagttttattgaacattgcctaggtatcaggatgtgtttacatgcattatctcatttaatctgtaaaaccaccatgtgagggagaaactgaattatccccattttcaggataaggaaaaggagggactgggaatgtgaactcaggaagtgtgactccatcgggtagactgctcaggctgcagatgtaaaggttttacacgtaggcttttccagatctcagcttctgaaaggcggagggaccgtttggacgggagcagggcctcctcttccaagcaccctgtgcctttaagagtcgccccctccctccagggatgctccaatttctttctccccaccacccccaccccgccccccgcgccgcggagccgcacctcggtccttcctccccgccccacaccctcaagctcggctcttggccttcgctcgtccagaagtgggtgagctgtaccgccagaggcgcattctcctagccccaaaccatgcccgctacgccccagcggaatgccaccttaaagaccctaatccgggcacctcccagctcctgcttcccaagggcgaggcctcagcgccccctcccatcgcccatgctcacgacgccgtgaaggtgacctcccccaggggcggcacacgcccagtggtgcccgaactggctcacacgtggtgagccgggagcgcgcggcccctccccgccacgcgcctcgtgccggccacccggccacgcccccaggactggctccgccccgtgcccctgcacgcttctccaggcttgggtggggcgacgcgcccaagtcgggcaccgggcaggctacggggtggggtaggacctgggaatggcgcacccacgcatcctcgaatgtcgcctgcggtttgtgaaaagcgggaagtccgcccagctcaggacctttggctggcaggcgaggtgccccgcggcccttggtgctgagcaggggagagacagctgggaccgcgagcctgggaatcgaatcctagtctgcgtgtcctcggtgcttcctatttggaaactgggcatcatattatcatattcccttctccctccggattcttatggagcttcgaacgagattaaatatacatatatatgagaaagggatttgttcactaggtccaaaagcatttgctggtcccatatgtggtcggaccctgtgtgtagtaggcggggggcaacatctacgacaacctgagttcgtccccttaagaagctttcctgagtcttgggccccccaaattctcttctgggatggtccgaaaagacgtccctgaaagaggaaagggcggaaatcctacctgacggcaggtgtctcggaatgagctaaaatttaaaaggcaacgcggggcagggacaagcgtccagcgtcagatggaagcaggctcgcgtcccctacccttcctccaacccctaacctaagaaaagaaaccgatctcgccggtctcccccaatcctagccgcgagaccgcccagccccgcagcccgagccccgccccgctccggcggccagcgattgggagatgcaaataccggcttctctgcccagcaacgggtgacgcggcgcccgagcgcgaggcggggcccggccgcagcccaagcgggcacctcggtgtttacacggggcggccccgcgcgcgccgcagcggcccgcagacggcgagggggaggggtggtgcgcgcgccggcggggccgcgcggggagaaagacactgaaaggcgtcggcggccgggcggggagcggcgcgcgcgggccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccacccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtgggaatgcagtccacagtggccaggtggccagatttttcaagagaagctggatggatgtttctgagtcatcttaatttcaaaatgaaagctgactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaaccgggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtgtagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaacccaaactcagtctcattgtctgtttctagagaaacccagtctacaacagagggttcaagagactggacaaagggaattgggtcagtggcccagcaactgcagctaggccggtcggatgtatcctaatgtcaagagtctgttcaccgatgccatcagcaccaaactaggggctgcacactttcctagtctgcacaccagtcacgtcaattagagactccagcctcagcccgaaggccttccagggccccctgctgatgccattctcactgccagtccgtcccctggtaaaagcaggtgggagggaggtcgtcatctgagtttgtcttacagaatagcctggaatggggtgcacggtaaaatgcctgaccggagataatgctagagctgtggaaccttgggcaagcctcttcccctttgtgggctgtattgggagtcggtaataggactagaagagggaccatctcattttggttccttccatttcagatgctgacctgaaa

SEQ ID NO: 16129 - DNA, 35417 bp, Human
aagctcttggagagttataactacacttcatacacgtgtacactcccaacattgtgcctcacacaatgtcctatgaataatagctgctgtaatatttttattgaatgaatacttcatattcacttttccttgtagactaaattttcagctgtcgtcatgatggtcatcgcatgatattagtcttttctttctttgttcatttattccttcatccatttatttacctaattatcctaatacagtcaagcagtgtgctaggcatcagaatataaagatcaagagggggccgggtgcagtggctcatgcctgtaatcccagcactttgggatgccaagacgtgcagatcacttgagcccaggagtttgagacaagcttgggcaacatggcaaaaccctgtctctacaaaaaatacagaagttagctgggagtggtggctcaggcctgtagtcccagttactagggaggctgaagtgggagaatcccttgagcccaggagccagaggttgcagtgagccgagatcacaccactgagctccagcctggggcaatagagccagactctgcctcaaaaataaaatagaataaaagattaagaagggatgttctgatgcagagagatggacacaaataaaaaagagctgtgtctggcactggaatgcaccttcacactctcatcagagccatggcctctgtaaagacagagaccagtttggtttgcagaagaatgggtgatgtaacctcttaaacataactcataggaagatttcccaaaaagtttatatcagcgaacacctggtacatcatggcatctctcataaacccttctcagtttagctccgtcatcttcacaaccatgtgagagtaaatcaggagggtggattttgagatgtttgtcctcgggtcttatccaggtcattcatggcctttgacctgctcctataaatagctcttgccagtgagcatttgcaagtcccctctgggctgaggattccccaattgctaggcctagaaacactgctcagagtctccgccagcctccctagcatcagaggcccaggccaataccgaggcattgcaaatacagggaaggtaaaggatgcaaaagtaaacatttgctggatactggagaggcgaaacatgcttggtgtctggggacacacaaggggacaacaaagaagccaaaccacggtgatgggggtgagagaggtatcctcccttcagttcttttttttttttttgagacagagttttgctgttgatgcccaggctgtagtgcaatggcgtgaccttggctcactgcaacctccgcctcccagattcaagtgattctcctgcctcaccctcttgagtagctgggattacaggtgtgaaccaccatgcccagctaattatttgtatttttagtagagatggggtttcaccatgttggccagtctggtctcaaactcctgatctcaggtgatctgcctgcctcagccacacaaagtgctgggattactggcgtgagccaccacacccggcgcctcccttcgtttctgttggagcccccatccacaaagcaatgagaaatgctgaaagcagacagaacgtaggtgctctggtgacatgtactcctcattgattggatggagctccactgaacatttggcccgttccttaagggccgagtgacagctcagcagatggaggggggaaagacactctcagctgtgggaacaggatgcacagaggttcagctgtctgaaagggcagagcattttctatgatcttgcatcctgtgagctggcataactgagtctggaaagattgagtgggaataggttgtgatgttcttgctatgcaagatcaaggtctttggattttaatgtgattctttctaggaatttggctctgcccttgacaagcctcaccccaaagctgctctttggtaacttacacccttcccccacaccaccatcccttgcctcctaggacttcaggttctcctttctgcctcacagctctaggagtccagagtatcaactggcagaaggccttcaaccgacaagcgcatcacacagacaagttctccagccaggagctcatcttgcggagaggccaaaacttccaggtcttaatgatcatgaacaaaggccttggctctaacgaaagactggagttcattgtctccacaggtacctgctcattcccctccttgcccaaacacacacatacttgagtagcccttgtgcattcaaggactgatggggaccacactggggccactggcattgggttctagccttgctctgtcattgattcagtgtggccttgggcaagttgctgtccatctctgagcctgagagtcaccatcctcaaatcaagagggatctggcctgtatgtttgttccagttacttccagtggtagaatatggcgcttcattggctcatgtcccccagaggggggttgtattggaacctggtctctccacagtctgaccagtgcttgttggttttctcaacctctgtcttctttgacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatggtaggtgtctagccacccacactctcagccctggcctaagctagaaaagaaaaaggggatgggggaaatgatcttcacaggctcaagtttgattagggaaagtccatgggctgtggaaagggcgcagaagctagaaatgaggagctctgacacttaagcagctgtctgagtgtgggcagtccttctatctctccaagccccaatgtcctcaccattaaatggacatcctgctgtttcttctgggaatattgtggagatcacattgagcttttacaaactgcatagcatggttcattttaagggacaataccacagtataattccacagcatggagatagctttctgccagaaagagcaggtgtcttatccctggggtctcattttcagaccctcgggtcatcctagcttctctttccagctcatagttcccacaattggagttggaagagttacagcccaagggtcaggggagggctaaaggtggggcttgctccaacccccaggccggttcaggagtgggaggagaggaggaacgatccctacagtcctccgaggattctagtcgctggtgtctgctttttgtatcaaatagtggatagcgtctttatgggtaaccacgctgagagagaagagtatgttcaggaagatgccggcatcatctttgtgggaagcacaaaccgaattggcatgattggctggaactttggacaggtaaaagggtcataaggaagctaagggtaatgtccctgttacccaagaagctcagcagcttgccccacagatcaatgggaagtcccacatctgtccatctgcctgcccttctttttgttcatgtattcagaagactttcattggccacctattatgtgtcagaccctgggatccacactaaggataaaggagatgaataagacagatccatctttgagggggttgcaatctagtgggcaagacagaacacacacataactcaattgatgcaatgaagtagtattggtgccaggatgcacaaataaatataaggcccccaagagacactggggacagtaatgtagcttctgtttttcattccatgtaacaatgcgatgacacttccttagtgtgcccactcagcctttccaagccacacccttttgttcctttattacagcaatccccatttgagtctacagagttctcagatttggtcagtttagaaaactttcaagaatgccctccaccttttagtttatccaccagacaaaggcattagaataaagcacctcgggcggggtgccttggatatcagaaagatgtgtgcttggaccatctacagaccctgtctgtagtcaactggagcaagttgggaggaagaaaaaagagaaggataggacatagagtgcacctaggagtggaagagaggctatttttttttatggcatggttagggagggcctcacttagaaaggagcctttgatcaggaacctgaaggagatgagggcaccagacagagatcttgggaaagagcatcaggcagaaggaaaagcaaatgcaaagacctaaggcaagaggagctcggccttctcagtttgagaagcaatgacttcaattaagtcttattttgtgaaaatcacttcaaatacatatactttagcaagagattttatttttataactagttctccaggagtctcaataacgtgctcaagattgcaggcaggccaggtgcagtggctcatgcctgtaatcccagcactttgggaggctgaggcgggtggatcacctgaggtcaggaattcgagaccagcctggcctatatggcaaaaccctgtctctactaaaaatacaaaaattggccaggtgtggtggcacgggcctgtaatcccagctacttgggaggctgaggcgggagaattacttcccaggaggtggaggtcacgatgagccgagatcataccactgcactccagcctgggtgacagagcaagactccgtctcaaaaaaaaaaaaaaaaaaaaaaaaaaggatgggaggcagagctagaaggaaactctgagatgagtttggcctaattatacagatggagaaatcgaggccagacaggctaaacagcttgctcttgaggtttgtggcagccggggcgtcggctagaccaagccacctcccatgcattcactttaagagagtttgcacaaggtcttatgcttttttatttttaataattttttatttattatccttttctgtctcttttttgttgttgttgtttcaaaagctgcctttgaggaaatacacagggtcttgtgtgtagtgagtgctctggatgagtttgcggggttgagggctgggcatggtggctgtcctcagtagctctcagttccagaggccacagagtcaaaggatctgatagttcctgtggttcttgccagtgcagttcccttcttgagccaactctccttgtcatttctttaattgtaatgtatggtctcgttctgaacagtttgaagaagacattctcagcatctgcctctcaatcttggataggagtctgaatttccgccgtgacgctgctactgatgtggccagcagaaatgaccccaaatacgttggccgggtgctgagtgccatggtgagtaacaggaaaacgatcacagctagttgtcatcatatattgaacaccacctatgagctaggcacgcacactctttacatatgtcatctcattaaagcctcaccaattacagctggtggttagaaccatccacattttactaacttggagcacaaggcccctctaagttacagggcttgcctgaggcacacagtgagtatgtggcagaagcagagccagacccaggtccagccagcttcaaagccctttccaccacatcatgaagcctttctcagaggaaaagggagcttgctctttgagtgcctgccaaggatgggagaatgcaaagctagggctctgctccatcattgggcctcctgggaaaggaagcgagaccctgattgagctggaggtggtgacctcctttgcctaactcatctcttccacagcccagagcacagcccagagtgtcagatggtaggctgcctcattcatggtctagatggggaaacaagcttggagagctgaagtggcttgctcaaggcacacggcatgcaagtcagaccagaacaaggcctccatggaaaaggcctgtgcccctacaacacacacaaacacacacacactcacacaatcacacacactctctctctctctctcagacacacacacacacgagctagatcccctagaaggcatctatggctctgcactcattgtgtagagaatatctccaaccagtctgggcgtggtggctcacgcctctcatcccagtgctttgggagatggaggtgggaagatggcttgagcccaggagtttgccaccagcctgggtaacgtagtgagacctcgtctctacagaaattaaaaaaaaactagccaggcataggcagacacggtggctcacacctgtaatcccagcactttggtggggagatgacttgagcccaggagttcaagactagcctggacaacatggcaaaaccctgtctctacaacaacaacaaaaaaaattagcagggcatggtagcatgtgacagtagtcccagctacttgggagactgaggtggaaggatcacttgagccaaggaggtggagattgtggtgagccaagatcatgccactgcgctccagcctgggtgacagagtaagaccctatctcaaacaaacaaacaaaaattagccaagcatggtggtacatacctgtattcccagctactcaggaggctgaggcagggggattacttgaacccaggagcttgaggttacagtcagctatgatggcaccactgcactcaggcctgggttatagagcaagaccctgtttccaaaaatattcatccagaatatctaaacctagatcaacctgctcaaaagttgtaagttaagatgcaaaaagtcgtgatcaggcagagtggttcacacctgtaatcccaggactttgggaggctaaggcagagaatcacttgagcccaggagtgtgagaccagcctggacaacatagtgagacctcatctacacatacacacacacacacacacacacacacacacacacaggagccaggcatcgtgacacatgcctgtagtcccagctacttgggaggctgagctgggagaattgcatgagtccgttagttgcaggctgcagtgatctgtgattgcgccactgcacttcagcctgggtgacacagcaaaagcctatctccaaaaaaaaaggcgaaaagtcaaagtgaattctttactttaatcctcttaaactaagtaattacccagaaatcctgtaacctttatttatttatttctatgtttcatggtttaggcatttcttgatctcttgacttttgagttggatatgtccatgctaatgagctagttacttggttaaaaatgtgaacaacttctcagctgcatgataaatatccggggtgcatctgagagggcttttggaaagagctgagtcttagactgagcctggcaagaaaggagtaaggtgggcccagggaacttagtagccgagggagagtatggagaggaagtgagcctggaacaaaatcttgaaaccaaatggcctggaagaggtgggattaaagccctggtgacttagaaggctgagtctctttggcctaggagagagtgggtgaggccagcggctcctgcagctgctgactcactcgcaccccagggccaaaccactttatcgtggagccaatttcctcagctgcacctcccagatgctctattcagacctcccagctgggctgggccatgaactaattatggcctgtgcggagctttgaagtgctcagctttcagccagagatgaccgtgctgatagccactttggaggctggagcaccagtgactcaggagatggggaagggctgcgcaaccttccatctctaaggaggccctgtcttgcctgactctgccatgacagcccaggacctcctggaaggggtgcagaactcactactgcactgagggcctggcaaggctgggcatggcctgtcctgggcaaggatccctctgtgtccagactgtccattctcattggccttgccacttacaggcactccaaggagaaggggtaggacacacaggctggaggagccttcagagatcctggtccagcctctcattgcacagttcagataaacgacagccaaagtttcataaaccctgacccttgactacaaaagacacctcagagcacctttgtcctaactttcccttgaaaattcccttccctattggaaggtgaagaactaaggcctagagaggtgaacagacctttgtgcaatcatcaagttggcaagtggcaaggtggggcttgtaacctcagtgtctccttctctcttttaacttttattatggaaaagttcagacctacataaaagtagagagaaaagcataatgaactcctgtgtctgcatcacaagcttcagcaattacctcttcaaggctggtgtcatttcatctgcgaccctctctttcacagatgatttgataaatcttagacattacacatttgtcataatttcacctgtaaatatttccaagtgtgtccctaaaagacaatggaactcaggtctcgatttctagtccagtgatctttccaggctgcctcttggttgtgtcacttagattagaaccttaaattgaataaatgaatgagtaaactaacaaatgaacaaatagctgaatgaatgaaagaaaagaaatactctatctttattctttccaagaagaagttagttgctaaagttctaaagtgatctttttggccgggtgtggtggctcacacctgtaatcccagcactttgggagctgatgtgggcagatcacttgaggtcagcctaagcaacatggtgaaaccccgtctctattaaaaatacaaaagctagccgggcatggtggcacgcataacaccagttactcaggaggctgagccaggagaattgcttgaatccaggaggcgaagcttgcagtgagccaagatcacgccactgcactccagccagggcgacagagagagactctgtatcagaaaataataatagtaataaataataataaataaataaaataaaaataaataaaataaataaagtgatcttttcgtaagaccatacaccaaaaaagagtttcaaaccatggactcccaggcagactgtgacagcagtgatagcctgtggattcttacctgccagaagtcctctgcaagctggagttgtgccctgccttgccacagcacaagctgtgctgtctgtttcccatgtcaggctgctgcacaggaatgacgtatggatcaaggacaatcaaacatggcctgtttgggaaagcacctctaaactcgtaaaccactccatacccctaagggttaagtgttacaatgatcatccccaagtcacctagaaagacaaagaaaagttcaatcatggcctttggcttccttcctcatctccccaccttgtcctctgaattctgcatgtcagtctccctaggaaaggcattagtgctgactcattttgggggggtggtttctgcccagatcaatagcaatgatgacaatggtgtgcttgctgggaattggagcggcacttacaccggtggccgggacccaaggagctggaacggcagcgtggagatcctcaaaaattggaaaaaatctggcttcagcccagtccgatatggccagtgctgggtctttgctgggaccctcaacacaggtaccttgggtgtggtgtgccttggctgggtcagtgggtggcagtgggctatgccaaggtaccatctccaccacctgagtcctcacgcccaccctgacttgcagcgctgcggtctttggggattccttcccgggtgatcaccaacttcaactcagctcatgacacagaccgaaatctcagtgtggatgtgtactacgaccccatgggaaaccccctggacaagggtagtgatagcgtatggtaagtatctcaccttttccctgaacttcgagcaccacatttgagtggcttctcgctctcaccatccttctgggacccaggtccaaacaggtgttgcaaggcaagtaacatgtcatcacagggtgtagaatggaactgctggcaatgctgattacacacttagcagcacccaagacacctcttctcggtgctctgcggtctgctagtctggtctatcttgctgccgtcagacaaaggatctgatcccagtgaaagacagggctcctaaattcactctgaatttatgggatccattggaccttatactactatagaatatacaagttgaaactattgcttttccagcaagaaatatacatttgtttcatttcaagtaatccatatgacttacaaactttcttaaagagaataagaaaagcaacacatcttctcttagcatatatatatatatatatcatatatatatatatatatacacctattgcataccttggttgacatcaaaagttcagagtttattctggattccggatgaaaacaattatttttttgagatggagtttcattcttgttgcccaggctggagtgcaatggtacaatcttggctcactgcaacctcaggctcccaggttcaagtgattctcctgcctcagcctcccaagtagctgagattacaggcatgcaccaccatgcccggctaatttttgtattttagtagagacaggctttcaccatgttggtcaggctggtcttgaactcctgacctcaggccatccacctgcctcagcttcccaaagtgctgggattacaggcgtaagccactgcacccggccaaaatgttttatatatatttgggcatttatattcctaaccataagtatgccatgtgcacactatcaatacacacacacacgtaatttaatgatagatgccactggaagtaggaaatgtgtagacatatatctgtaactgcatagagcactagatagatagatattatatagataaaaatagacattgttacaactgtttaaggttatatcatataccaagttattaccggatggcaattggcaatgatgtctatatctgtagatacacagagatatctatgtatctatataaagtacccatctatctattgttttaatccatttcaaaggctacacacacacataattgctcacatgcatgtatatggctagataatcgtatgacagatgtaatcttattttcagatgttcaattttgagatagtctacataaaatgtttgtattacttatcattcccagaataagtatatctaacttatctgaaatgtgcttaatgtaactaagggtataaaatgaaacgaaaatagataataatggaaaacactgttaaaacaaataaataacaactccatgccagcaaccgagttgagtaataaaagcatcccttcccttctgaaggagagtgaggtttatgtaactcaccccagagtcaatggattctggggttttactaggggagagaaagcttatttaaggagtttctttcttgatctgcacatacacaactttctctctaatgatattgcttacttgtggccagactttgttttccaacttctcatgaatgagtgtcttcttttccctgggcttttctttgttcttgtgtccaaaatcccatcgcaaccagctctgatcactggggctatgccattcctaactttagtttcttctacaaaaggagatggttggtgagacaagttgggggtcccctcggcataccctttctgtgattatcctgtacattaggaactgcagggacgtggaaagcttaagtctcagttcctccactgaaagcatttttatggtgctgttaggaggcacggggtggggaagccactagtagaggctaattagcaacacagcatggtgtgtgatgcccaggcaagtgactgagacagggataccaggaactcggaggaaatcctcaaggaaggcgtcctggaaacaggaaagtgaggcttttaagctaaatttagaattagaacccaggtctcctggttagtgattcacactgccccccacatcagcttaacatcacctttgggacaagtaggagctgatggagacattccagggtggctctgtggtcatttctgtggcctcatgggagggggccaggcgcagaagctctgactgttcctgaggatcttgtcacccctcccttcctctccccttttctgaaccttctcagaaagccaagggagctgatagttactccctacaccattccctacagctgatggttgggggagccagccctggagggcatgaggacagggagtcccaagcactagctccagccctaccacccaattgctgtgaggcttgcgcaaggcaatttatcctcctggtcccaagtttcttcatatgtgaaatataagggttggcctaggactagatgatttcttaagtcctttgccagtttaaatgtttaaattctcgggagcttcagcccactccactttctataagggagctagccctcccaagggagccctgctgttccttcctccttgaatcccatgcaggggagagctaaaccaagagccagtttctgcctggcgtgaaattactaagctattcttataagggcaaccggagtttggacagaaaacctctgacatgaatctttgtatgttaccaaaaagtgttgaaagctttagaaccgtgcccagatttgcctaaagtaatagaatgtgagaatcaagggagattaagcattagaagtgcttagtaatagtaacagcagcaactaataatttgttgagcagttgttgtgtgccaggtactgttataagtgcttagatttcatcttcacaaatgacgtaggcattgttattttcatccccaatttatttttcatggatgagaaaacaaaggccccgagagaagtaacttgtctaagggtaaacaccgggagacatgtagacattctaagcgcataacattatgtaagttccttgcctttgctacacctcaatttcccacttgtaaaacaaagggccagatcaggggacctcagtgacattttctaggcctttcttttaatcagattcacagcagccagtggggtaaatttttttctaagccactctgctcatgccaatggtttggcttaagaggcacgcagttccggagtattcactctcttcagagtgaggacacttttcgggggagcttagtttgggatgcttctttgagatgtcctccttcgggtccactgcaaaggaagtctctggagcctattcagccaccgagcagcagccgaatgatttggaacagtttagccaaagttatcttgacttttctggcttgttttcttcattcatttggcttgatcccccaatttctagagtcatagatctgactctacctgtagactttgcagaactctgaggtagaaggtgcctagagactgcccagccctgccagggaggtgaagtcaggcagtgcctccagctgtcagcacccacacctcagccaagcccctggctcctcatgcaatctctccacggcctctgcctctgaatacctgcttccactaatcctgaactggctcctaggcccttagtgaggaagtgacagagagtggtttcagcccagaaacaactcaattcagcaaacatgattccatgcacatctgcactggactccgggcaccaagaggaacaagatgcaggaactgtgctggaggagggtttttgtttgtttgttttgttttataactaggccttagagactgaatagacgagtttacagctgcattaaaagcttggcaattatggagtagcaatgaaatcaatgaattatttgcaagagtcagagacagcacagaggtattattggcactctcttggcgtgtcaggaaaggcttttttggcagaggtagtatctgaacaaactttgggaggacaaatgggagtttacctacagaagggcagggtttggggccactttctaggcaaggtctcctaactctgtgatttcaaaggtaagcatagctcagttggtgtctgtagagcagtgttttataaacgtcaaagactgcatgagaattaatttgtgtggggaaagatgagagcagcggaaatctgcactttttaataaatgccttggatagttctgatgcccgcagcctgtcctctcctgagcttatgctcctgaaaccctcaggaaaggagtggagcccgaggttggggggtgggagacagcgtggcacacaaccagaaacccacaccggaatttccacatggcgccactgggcattggaaagatgcacatcccaaatatttctgtgtaactgaagtggctggcttttgcatgagggaggaaccaggatgcagttgttatctgctctgccttaaattcctgccttgcaagcaagtattaaaatacagctacttatcaattttttttttttaaccagcctgcccttccccttgggtgctctgccaggagcaaattgagtgtgaaacttggtgtccttattcactttctcatccctcccttgctcctctcacccacctgggaccatcttcccacactccttcccttgccttctccttggtgagttctaaccgatcatgaaggcctgttcaaaaagactccctggatcctggagatcatttttatgatgcccttttaaaaataattataaaaaaattcaaaatacatacagaaataaaaatcatttctgatcttattcacatatcttcaacacttggtagttttccattcatcttttctctatgagttattgttatttacagaattgggatgatacattttccaaggcatgagtagaagacggagcatataatagacacatcccactttttcccacacctcgaaaccaatcacttcaccattagttttagtcatgtgttttttactaaacattatatcatgagcattctccctatgtcattaaaaaatcttcaaaaataagatcatttcaaatacgtcgtaagtgcatcatattctattatatggaatggaacctatgtaaagtcaggttacataaaatggaatctactgttaacctgtttcccttttttaaccccagctgcctggattcaaatcccactctgcttaattactcactgtaagaccttctcaagtcacttaacttccctgaacctcagtttccagagttgttgaatggggaataataatcatttctgtcttttagggtgttgtaaggattaaataagttaatatatgcaataacacaggactcaactttctgtgttaacactgtgttagctatgatcatccaacttacatatattttctaattatagaagtaatgagtaattcacatgatagaaaataaaaacattatagaaataagtaacataaaacttagtttgtatgcactatatatataacacatacaccaaactgttaatggtggatatctaagaaaatagaattattgtagactttctccaaagttttatgtataattttttaatgaacggctttatcatacatctacatatatacacataggtttttttctttttccttttttatttccataggtttttggggaacaggtggtattcggttacataagttctttagtggcaatttgtgagattttgttgcacccatctcctgagcagtataccctgaacccaatttgtagtcttttatccctcacccccttcccaccttttctctctgagtccccaaagtccattgcgtcattcttatgcctttgcattctcatagcttagccttgacttatgagtgtgaacacacaatgtttggtcatactgattttcttatttcatgatatctcttagacatctctccatgtaagtactagattgattttgcttgtcctttttgacagctgtttgatatcccattccatggctctgccaccatttatctgccaattcccttattgatgaacttttgctccaacatttttgctgttacaaacaatgcctcggtggacacctttagatatacatgtatgtgcacttacgtgagtttttccatgggagaaattccctgatgtggacttactggctcagtgagtatgtagatttttacaagtttttatattcattgccaaattgctttccacaaggtcatagcaatttaaactcccaccagtggggtatgacagtgcttgttttcccacctggaaatgagcaccacaacgagtatcaccatatgctttaatctctgtcagtctaataggtgtcatctatgtatctctgtcatgttatctctttgtcattttaattttcttttcatagtactgaggttaaaactattttcatatgtttggtggttatttgtatttcttataaaaattgcctgctcgttgctatttatgggcatgtttttctttttctatttcttattttttcatcacttagttcaaggaaagtatgctttctcttatcaatttgtaagtacattacaatattgatacagtaaatctctatctagcatgtatgttggatatattttctctgctttattgatttttttcaatcatttgtctcactttgccttcaaattggataatttctagtcatctatctccaaatttattgactctttcctctgtcatctctatcctgctattaagtttatttatcatttaatttcagatatttgtcctttttccagttaaaatttttccatttggttctttttttcatattttctatttctctgcccaaagtttatctcttttcattagttatgagcatattttcctttatttcgttgagcctcgctctagtagctgctttagtctttgtctgacaattccaacatctggattattttatggtgggtttctgtggattatcttttcccttgaggataaaccacattttcctggttctttgtttgttgagtgattttggctcataccccagacgctggatgtgtctgaattctgttctcttgttttggctgcctatcttgggtcactcaacatgcaaactgtctcccttgcagtaggcagtggctctgctctcagttcagggcttttatctccagctgaacagctcatggtctgcctcatccatgcatgattgagggtcacctagaggtttgggcagcttccttgactcttttcagaattcccccctcactctccagcaacccaggttggttcaggctctgctcctggttcctcagatcagaaagctgtgggctgcctgtcgagttcttgctccatgtactttaccccaactgtggcctttccttagagcaaactcataaaaagtgcagcttcctctacgttctgattcctctctaaaatcatagtgctttgatcatgctcaggtgtctttcctagtttttcatttttttccccacagtttatcattatatgcaaaaggattcatctgttttgagcttatcctccacaccagaaacagaactacaggtttgtttgtttacatgtaacttcaatatttttacatactcaaatatatgagtctcttcctttatgctttctgaaatgggtggtctgcttagaactatcttttccacctcatgagtatagaaatatttttttccacgttgactagaacttggatttatgtcgaacttatattttcttcatgttgaactgaaaagtgccaagaccagtgtgactgtagtttccatgggagtggagaggagagaagagggcagaattgggggacagaatgagtaagaccttggctacctggctgtgcccggtgaggggtgagtggtgactgaggcttactaattgagacataagacaaagaacatttgaggactggcaggtgtcattcttcagttcagatcccagccaagagacggtgtggctcttagataagtcagccactcctgcagcaaccccattcattttcggccaacaccaagcacagaagcataccccgccaggcagagggagaaagctgtgtgggtttgcccctgggtggctggctccaatctggattcgttctgctccttagaaaggtgcatgctggtcaaggctttgacttttgagttaggcatacatgggtccacattttgaccctgccattgttagatgcttaacttctctgagcccaagtttccctttttataaaacgggcataaaaatggtacctatttcacagtgctgtgaggatttccacgagacgatgctcaccagggcttagcataaccgccgtcacagggcaaactcactcgatgcatgttgtcatgctgcactgttggggcaaagatgtgctgtcttgccactcatctgctgtgtggtcttgggcaagcgctgcagtctctggttctatctgcaggaatttccatgtctggaatgaaggctggtttgtgaggtctgacctgggcccctcgtacggtggatggcaggtgttggatgctaccccgcaggaaagaagccaaggtaacttctctgggtgtggttctgagtcgtgagcctcacagttatttacagccatggacagcagcatagggaagtaactccaaagccctctccctctggaatgcatgatgggattaaaacaaaaatagtttaaaaatagatctcccctgctaattttgcttggctcgggctgctgtttaaatgagtgcctgccctgcacccacaatggccactgttgctgcacagagccttggcacaggccaggtgggcagagagagcagccttcctctgccagtaatgattttccttcaccaactgcagcagcctctccttcccagcacagaaaattcatggttccctgttgcccttggggtttagtccacattctccactggtcaccacccacagcagctctctctgccacaccaagctcccccttaggcaggctgcctctgccatccctatcccgggcctctgcttcctcctctggcctccctctgtctcctgccccatcaggggttgggtcccaggctctcctggagcctttcctcttcccttctctgacctctagagcatgacttgtctgttaccctcattttcagttgttctttgaaacattaaaaagtgatttatggggctgggagtggtggctcacacctgtaatctcagcactttgggaggccaaggagggtggatctgttgagatcaggagttcaagaccagcctgaccaacatggtgaaaccccgtctctagtaaaaatacaaaattagtcgggcatgatagtacatgccttaatcccagctacttgggaggctgaggtgggagaatcgctggaactcaggaaacggaggtaaagccgtgagccgagatcatgccgtggcactccggcctgggagacagagcaagactccgtctaaaaaaaaaaaatgtgatatatgaagtaatatgtgcatgtagttgaaaaaaattcaaactattctaaaaggactaacaataaaacttaagtcttaccacacccccaacccctagctcctctaccagaatcagtgcacgttactagatttgggggcttggaggtaactgagacatttgctaggccacaattttccaaaagtttcattgcaacccattagtggttataaaatctagttagtgggctgtgtccatcattttaggaaaagaaaatgaaatggaatggaacggaaagcagggaaaagaacataaactatcaaggctcattagatatagttagactaggctgggcgcagtggctcacgcctgtaatcccagcactttgggaggccgaggtgggtggatcacgaggtcaggagatcgagaccatcctggctaacatggtgaaaccccgtctctactaaaattacaaaaaaaaaaaattagccgggcgtggtggcgggcgcctgtagtcccagctactgagagaggctgaggcaggagaatggcgtgaacccgggaggcggagcttgcaatgagtcgagattgcaccactgcactccagactgggcgacagagcacgactgcatctcaaaaaaacaaacaaacaaacaaaaaagatatagttagactaaagaccattgtcctgtgaaacttttgtttctgtatcatatgtgtgccaagatgtcaaatgtatttctttctaggggttgtggtgaaaaaagctgaaagtcactgacatctgtctatctatctatctaagcttcctatgctgagagctaagaagagggaagaaatggtcaggcttgggagctcagaggaacaagaggtccctgcaggctgcctgttcagggaagtcttcctggactaggaaggtgatgagcttctaggccagaatgacttgcagaggtagaaaagaggcagccaccctgagcacgagaaagcaagactttcctctttaggaaacagaccaaggacagtgggtcagcatggattaggcgcccggaatgcggaattgtgtagtcttatgtagaggttgagttcgaccagcaagagaatcatagcccgggagggtctctgcagaatgccaaatgagtgggacacacagtcaggggtgaaggaatttgggcggggcagaggcagggggttgcagtggtcctggaaggccctggggaatcgggcactgggtaggttgtggccttggcatatatccagcctctgcatcttggcctccaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggtaggagggacgctggcggggcagtgccgcgagaggttctattgtgggaggatggctctgaggctggagaggagaaaagtcctcacctcccccgcactggcagccagttctgcctgaatgataggattgctccctagcacctaacatccacctcccaggactgtttccggagggaacaaaaccatcacgggcagctgttgtgccagtggaagtttgctgcagggcacaggtggctgtcaacccagcccatctccagctgtgtccctgtctcaactacacagctagggtgacagcaccgtgactgaacatcacagggagagacatggcccccatgaaaggcccccaagggctttgggagagatttctccatcagtctgctcccttagcctctgagaaactcagggagaaaaccatctgaacgaagaaagggacaaagaaacccagagacctgagcttgcactgtgcacatttggaggtctcccaagaagccagatgaggtgtgattacatggtgtgaatgcctgagctcctgaaatctcaggcatgctacattgctcgtccccctgaagtcaccttggaaagccagttgctgcgaggctgcctcgactcaattatattcactgcccagagtttcttttgaaaccagcagcgcatctcttggagcattctcaatgatgataaaagttctgcatttgaagacaaagttcatttttagaaacagccaaaagtaatttagtgcttgctcttgcaggccacagtcactcctaaatggggtcaacatttcacactttctaaaatgctttgaaattgctcattccattgatcttcacagttggttctgaggggtcaagaaaagcatcctcataaaggtgcacacagtacccacaaagtaagccctgaatctctaagtgacggttggctaatggtgttggccgagtttacaaaaaaggaaagctgagcgcaggtgatggggtctgacttcaagtccaagtgggtgcccccccaggtgctggtatttgtgaacatttggaggcacagttttagggttatgagattggtggcctcaatttggccccagtcttcctctgcaggtcattcccaggactgagctcagatagacctttgctcagtcaataaacatattctgagccccatactgagtgcctgcttcatgctgggccttggggatgcaacagaggacactgtagatgggctggaggtgtggggatgtaggacaagtattttcaacaatgttatgacgtagaaacaagcatagggggccagggagcaaaaactcgggggcggaaggtgaactctagccctaccagccataattgtgtgacctcgagcaagtttcctctgatctctgagccctcgcttcctcacccgaagaatgagaagagcaatgcctgtcttcagcgggatttaaatgagctaaggtatacaaagtgccaagtgcaatgcctggcatatagtcaagacttgataaatagcagtggtgatctttatcaatttgaacctctatagcctcactggaacaatgacttcccaaggtgactattttgcaggcgctgcttacatgactgtacgatcctgtggggttccttaccttaccccacaccttgatctctggctgtctcagccaaacttcctaaacaatggagaatgggcaggtccgttgtgggggtgggggagggggtccctgaaggactcccagcaatgccccagcccttatgcgacaggacagatcaccctgcctgatgttgcccagatcttcttacctaatgactctagcttctctctgagggccccagagaggaaaagctcataaaatatgttgctaagtattgatgcaatagcaacagcaaagggagaaaacagcaggaggaagcttagtcttgagtaaacccagcaggtgacctatataggcatcaaggctccaagcctcattgtgcaaacacacctgcttcaaggtcccaggcacagaaggctcagatccgtgcactgccttcagctctgggttgaacttacagctggactagaggatgggaaggcatcaaaaggaacccagcccaccaggaactaccagcttaggtaatctggctgcctgccttctttttagcagggtgtgtgggaggaaacttagaccaggggtccagacaccagggaactggccccctctctgcctctgcagatgactggcccagtccatctcagagtggtctggacaagttgtgtctcttcttagggccttaacttgataggcatggacgagttggcctctgaagtctctgcaaatcacatgtaatttatgggaaggggcttgctgtatcgtaaaatgcttacaataagtcatctgggccaggtgaagtggctcatgcctgtaatcccagcactttgagaggccaaggtgagcagatcacctgaggtcaggagtttgagaccagcctggccaacatggtgaaaccctgtctctaccaaaaaggcaaaaattagctgggcttggtggcgggcacctgtaatcccagctactcgggaggctgaagcaggagaacctcttgaacccaggaggtggatgttgcagtgagttgagatcatgccactgcactccagcttgggtgacagagtgagaccctgtcacaaaaaaaaaaaaaaaaaaaaaagagagagaaaaaaaataaaaaaagaaaagaaagtcatccagtgccttaagcatttcacaggttgttggggaaggtgggagaatgtaagtgtggtctgcagacgtcaacatggtcactcttccttgtgtacctgtgttcctggaaggtcaccaccttctcctagatctatcttcaggtcaagccttttgtgaactgctcagtcagccctggctcagaggcttgcagtcggttactcagctctgtgtgccctcagagccattttcaggtacatccctgtcattctctgtgggctacttacgccatcacactcagcagcacccatagcctgagtcagagtcagaaaacccatctttttatccagtctttgcagttttgaaaactgaaatctctggacaatttcaactagtcataacttggaaccacaccgaccatgggaagtccttgtcaaccggcacagatcaaaatgtcactccttgactctcaaagcacctttagaaacaaggcagaagaacatggtttaccaaaaaaaattttttaattaagtcagttctaaatcatcaccttgctttttggcttatgaatgtattctaatctttttcagctcagttcttatgatttattttgaaattatctgttttttaagtctcacaaaagacattttatcagaaaaaaatggaatctaacctaattaacgcaagcaaatgatcaagccacatagtaattgtgtgcaggtgtgataaagcttttctacagattttgggaaatttagagctgattagaaaagcgccagagaccaactggtctgtgagtctccggttaagacaggcgagctggagacctgtgaaagtcgaatgcctgctagggcagcaatggagccagcaccagtcctaggccgcctgtccaggcagggtactgtcctttgcccaggttgccatcacatccctggcatgtttctgtcttttcccaccacacaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaaggtaacgcatcccgcagttggaggagatccacgaatccgaggtagccaatggccttctggggctgcagggtgtctgctgggctccaggttagtcagctacgaatggagcagccagcggcccctgtggttaagccatgtattaatgctttggaagtttctgtctctatgaacagagtgatgccaaccaaatgtcagggtggtgccaaccaaaatccttttacgccccaagggaggaaggagggaggctttggcagttcatagctatggcacaatatcccttacaagtatataccacctcacacagtttgaccgtctaaaaaaaggcagattttcagtgtccatcttatagaagcagaaagtgaggctgggagagatttgtgacttgcttcagagataaagtatcatagatagtagtggtagtgctgagtcttggtcctaggtttcctgatactgagtccagagccaccccctgttttctatgttgtattgttcttacccacctcacccccactcccacaacaaatcgcttttcaaatttgacctcaggagggtggcaatgaccacgggaccctaaaccttggcccatggccctcccacagctgccacggggtgggtggaccttctggaatcctgacaacagtgacaggttttcttagaagtctgagcgtttgggaggaacagtgactccttgcccttgggtagcagggatgggaagggaacaaggtggagcagataaaggttgtgctgtggaaggattagaatgcaggtgtgcccacattggtaaaatccttcaagctgtcatgaaaagtttggacttacaagccggattaacagggcagggtggttatttgcttcacataaggaactaatagaaactgattaattatactgcccatcttgaaagaattctgtctccagagaaactgagaggtgtcacacctgtcagaaagcagcatcccctagcaatctgtcttctggcagaattttagcagaaatcttttcaatatcagaagcaactgcctggctgttattgaccttagaaactcaaagaaagggctttttttgtttgtttgtttgtttttgtttatttgttttgtttttagacaggatcttgctctgtctgccaggctgaagtgatcatagctcactgcagcctcaaactctgggctcaagcaatcctcctgcctcagccccccaagtagctgtagtcccaagtaactaggactacaggcatgccattatgcccagctaacttttaaagttttttgtagagatagggtctcactatgttgcccaggctagtctcaaactcctggcctcaagcaattttcccgccttggcttcccaaagtgctgggattacaggcataagccaccatgcctggccaaaagagctaattttggaaatcaaaaaaaattcacaggatggaaatagttaaaaaaaaaccgttttgcagaatggaatggaaaagagagagaaggcaggtgtagtggtcttagagtctggtcgtctgccaagtagttgctagatgaccctggttaagtctccctccctttctgaacctcggaggtcactgacggtgagggttggaccagctgatgcaagggcctgtcctctccacatttggggcagggatggcaaattccttcagtgctaaaagcagaggcagcttcctcctcacagtcttacctacaagagtatgtaatactgtgggtgctggggcatccccaggccacccagcatgacagcctgagggaagggagcacctaagcccatcagggtagggaaagggccccgcggcccacagggtcagaagagaggacttaaagcgtggggaaggagccggatgcatggagagaagccaggggaggcatttccatctgggggaaccatgtgagtcaaaatatgggggcgaaaaggtgcctgttttgtctgcagaacaagaagtgtggaaggttcttttaagggacaggtgatgcagggccaggttgaggggtctgaactttatctaaggcaatgaggagccacggaagatttttgaagtcacatgtgacacagaagaagagtgatttagaaaacaaaacagaacaaaacgaaaaacagctttccaaagctttgtctggctggtgtgtggatgatttagaagaactagagaccagaccagaggaatgaaggggatgctgtggcagtagaaccccaggctattagatgacggggaggatcctaagcgtttgtttagccaataccctggcttcccttcctacctattattgtgttactgtcatgattgctactgttgttggcaatcaggtggcatttgtattcttccactgcccctcagaaggacacctgtggctgggagcagtgctcacgcctgtaatcccaacactttgggaggccaaggcgggaggatcccttgagtccaggagtttgagaccagcctggacaacatagagagaccccatctctacaaataatttaaaaaattttaaaaaaaaaggacacttgccctcccacatttttcggagtcgggaggaagcagcggtatctttagcccctgtgagcccatcctcctgggaatctgcccagccagagagagtcctggggcctccttgccccctgctccggagcccaccctgaccgggggacgcttcccacaggacctggcccaaggagggctcagtcaagcccggggctgcagatcctcccaccagctcaccctgccttggcttggcatctgttctgaggaaggttcagaagccatccccactccccctcactcggatcccctggcttctccttccagaggcagaacatcccataaagatctcgtacgctcagtatgagaagtacctgaagtcagacaacatgatccggatcacagcggtgtgcaaggtcccagatgagtctgaggtggtggtggagcgggacatcatcctggacaaccccaccttgaccctggaggtaatggggctccccatcctgtgggaaggggttctgcccccagccagcccagctcccaggagccccactgtccctgtgagccacagctctcccagagggcaaaggagagttttttcttgctgggaggggcagagaactgggcccagcttcggtccagcctctgccaaatagccaagagctcccactcaggcccgtgttcctgctccctgtctggtgagataaacgcgtgcatttgcctggctgcttctcagattctagttcagaaccactgggggcatcagctgaggaggggcctgggggactcttttcagctcattcccttctcactcagctactgagcatttgctgtgttctgggccatgccaggcttgagatctgctgtgttctgggccatgccaggcttgagaatcacagacaggcacaggtgtaggtctcacacacagccagctgatgtgccagggccacagcccagccctctgtcatggacagatcagaaataggcctgacccacagcatctctcccctgtctagaccctggagttacagaattgtggactcttaggagcctagtcacatgctcctgtactctcatttcacacaagtaaaccaaggcccagagagaagggaacagctggccaccgccagagtcaaggctaggcctcagaacctgggactcccagcccatgcccctccaaggcgtcctggtacatcaccagccagcaacagcatcttcaaagtggctgagaacaaagacccctctttctctgctcatagggcttcctttactttgcagcattcactcccaggctccttctcaggagcccaggaaggtggggcttgcaggtctgtgggaggcccctcgtgccactctgtgtcttcctcagcactggtaggagcacctgtgcggactccaagcctgtccctcaccctgtagccccctgtgcctgatccccacagcccagggtgaagggtgctggaaccagggagtataggtctgaagggtaaaaggctggacaaggacaggcagacaaacggacagagaacatgaggttttcccttggggcccaatcaagagcctcatgggccaggccctgccctctctcatctgctgtacccaccgtctgccccagttgtctagatagaaattgcctttccctgtacaatcacaatgccacaggtttcccaagccccagaaaccaggaagagccagataatcatggctgccctggcccgcccctccttaagctgtaagctggctgcaggcgttcctgacctcagaaagggcagggggatctaggatgctggctctgatgccgggcctggttctcccacatagctggcctgcaattgcacccttttactgtcctggttagtttggactgtgcttcaggatgggggagttggtcccctaccttaggggctagagagtcagtgactgggcagccagtctgggggctgagaagggcagtcgttcaggccttgggccatgtaaccaaatggatctggcattgtatctaaacccctccattgatcagtggtgacactgagcaggtcccttaatctgagtctcagttgctccaactctgtcactgggacaataaattacttcccttgcagagtgtcatttcctcagggaagcctttcctgagctcccaaattaggctcccaaattcatctcaattatacaccctcagaacattctgtccttttccttcaaggcatttgtcccagctggaatattatccttctttgtgcaattatttggttgtgaatccctacccaaccgtaaactccatgagggcaggcattacctctgttctgagttcatcactgtctcccttagcacaatgtcttagtggatagccactatttgtaaaagagaaatagccccttgctcggggcatgactggaacagatccccttggctctggacttgcattcttccctgcacaggaaagtcagtccaggcttgtgccctgcgtgtgacagcctctcctgcttcacaagacatttctgagaaacactccccatctctctagacatggtggacagcagagtgcccattccaactcctgaggctagaaaatgatactgggtggctgccagttcagttatgagaacattctgtactaaagtgatcagtgtttaaaagaacttagtttttggccaggcgcggtggctcactcttgcaatcccagcactttgggaagccgaggcaggtggagcacctgaggtcaggagttcaagaccagcctggccaacatggtgaaaccccgtctctactaaaaatagaaaaaattagccaggcatggtggcgggcacctataatcccagctacttgggaggctgaggcaggagaattgcttgaacccgagaggcagcggttgcagtgagccgagatcacaccactgcactccagcctggctgacagagtgagactccgtcaaaaaaaaaaaaaattagtgtttttccccagtgtattccccattatgttcccttatccaatgtcctcaaaccttcttccagcattatcttttattcaacacttttgctatacatcttccagatttccatggcaagtctacttatctttaagatactacaatatctttagaaaggaaatcagaatatataaggctagaaatgtgccatcactgactctttttaaaaatttaatctttttaaatgactcctgatcttccttcttcgaggcaagttctttcctccacctaagccttcacctaatcgagacattcttgtctctattgaacggatcaatgcctagctcactcagagcaggcacggatttttaaactggagaaggtgatctgtatgaaaagataataatttgggtaaaaccccattatctaacctggtactgactggcaattagcactgaggaccttagaccacaaaaccaggccaaaaacaatctgaacattgtttccaaagggtgatgtcctcccaattgatccatcatctgtgacaagcaaactcaggtttttggtggcttttatcctttcctctgggtacatttacagagttgggtcaataggagagagtggtaagcggcattaaaaaaagaaaaaaaagcatggaaatctcaaattaaatatcaccatgaaaaatgtggcaacatctgtatagctttcttataacccaatagcataaaattatgctgcactcttcaaattatgtcatacacttaaatgagtttcatggaagaaatgaaaatatagaccatgatgtgtaaaatgcttcaattactcacaaattactgggaggtattgcagacctatcagaaacagcaaaggctttagatccagctgggctctgctgtttccttgtgtgtgaatgttccaggttattgaatcagcctgaacctcagctctgtcactgtaaaatggttgctctgaggattagtgacaagaaaaacaaaacacagcaacaacaaaacccagcaacctccggtcatcctcaaaagaagaagaaatccaatagccataaaatgtccatttctatgtccaaaatgctttcttccccatccttgatctcatttgaccccttctgggagggaagagatgattgtccttctttaccagatgaggaagttgaggcgcaaagagatgacttgtctgcccagaatgaattacggctgtttcttggcagaaacacaacagctttcatcttttggtctgaataaatagtccaaattgcttttctgaccccaaacccagccttcatctgttctgatcactgagcaaggaccgtgtggtattagagctccgctcagactataaatggtgcacagggaacctctgggctctagaagtttagaaggacattggtagactggggtgtcagcagaggagagtagcctgggttgagctggggggacccaacccctggaaaaagagttaagggagctacagtgtgagccagggtgtgagcagctgtagggcctggggctgcccttttcaacacctgtggggcctcccagagacggaggttcaagctttaagggaagaaacaggacccataagcaggaaagccaaggaaagtaatattaaacccagcaagtggctgggcacagtgacttacatctgtaatcccagtgctttgggaggccaaggcaggaagatcacttgaggccaggagttcgaggccagcctgggcaacacagcaagaccctgtccttgcaaaaaataaattcagcatgaaaaatgtcctgaccctcacagagcccacagtggggttgggctgtcctgggaagcagggtctgaactggagtcggggcagggaagtaacagtgttgttggctgctgcagggggccccttccccctcaaagctgaggttctcatccacagcacaggataatgtcctgggaccatcctgtgtattggggggcagggggcgtcagacacaatgtgcctggcacctaggagggctaaatggtctccccttcttcatcctcagtgacatcacccccttcactcagtcaccctgcccagccctcaccaaggtgcaggcaggggctgagcagctggagtcctgactcggcagcccctctcccccataggtgctgaacgaggctcgtgtgcggaagcctgtgaacgtgcagatgctcttctccaatccactggatgagccggtgagggactgcgtgctgatggtggagggaagcggcctgctgttgggtaacctgaagatcgagtgagtcctgggcctaagtggccggtgcaggagggcgggagggggcgggggggccctccagatcccctgggtgggacagacagagctccctctgaccttgggttctttactcttttgggggtcttggaactctagaatctgcttttgcatttggtttgggggttcaccaaacttgaactcctgagaagaacaggtcaccagagctaagagctggccttcagggcttagaatatttgggagatcatgggacccccccctcctgcttcccctgctgaagagttccagggctggaggggccccgtaacccagagagacagctagagggagctaaagaagcagtggccttgcccagcctccatcagaacaggacaggaggtcacaggaggcccgtccagcccaaggtccgtgtgtctcgtatcaacactgatctgtgccctccccatcagcgtgccgaccctagggcccaaggagcggtcccgggtccgttttgatatcctgccctcccggagtggcaccaagcaactgctcgccgacttctcctgcaacaagttccctgcaatcaaggccatgttgtccatcgatgtagccgaatgaagggcgctggtggcctcccgtacaaacttggacaacacggagcagggagagctcaccatggaatgaaccccccgcccatgctgtccggcctgggaaaccctctccatctcccaaggctgccagacatggacctccgggctccagcacatccccctctcctctcccccaggttggggctgggtccaccctgtcctatgacttgatcacttttgcacattccctggccgcttctccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagccacctgccccagcactcacaccctaactcaaaataaatgttaaataagtgcgatcacacagcaccgactctacctgactgctgttgcacctaaggtggtgaaggagagaggaggctgtggccgtgaccttctggagcagggaataaatttgaggaggccatgttctctgtgtttcaatgtccaaagggagtgggcttgatctgcaaggctgtagatgcaaaactagggaaacatttcaagccagtttaggaaaactttctaacatgatgtccaaaaatagatgaggctgccttgggaggtagctcctggtcacagaaggcttcaaacattctctgtgtggttgggcaaacttttcaggcctctctacatgcatcagagtgagaggggacgtcacagtttttgctggaaccctctggcagagctggtcccgggggtggcccagcctctgctcacatggggctccacgctcctcttgtggccaggagcaaatgcgtccttccgccagccacagcgctgttaactcaacctgaaccttctctgcctttatacacactctgatggttcctcagcctttgtcccttaaaataacctcaaacaaatcccattagctttcctgtcgcttgtgctgactaatcccattttgacaactctgcctcattttctgaactcaggagacaagtagaatctaaatagaaacctcaacctcacatccagctcaaagcttctcccctgggtgcagcgcaggccttacttacgcctgcagagcaggcactgtccatctctcaccttccttcccttccttccccgaactggggagttgctagatccctcagagttggagcagagagagaagaagaaaagtgacagttgtctgtatcactggtgctgatgtaatgcagccaatgatggtctctgtgtcgccagtgtttaaatgcaggctttctgtactgcttgttgcctgagcccaggagttcaaggctgcagtgagctatgattgtgtcactgtacttcagcttgaatgacacaataagaccccatctcttaaaaaaaaaaaaaagcggtcagtaaattagggatttggggttgaatcacttaccatccagctgccttgaacccatcctcatcccatattatcccaggcaatatggattgggtacatctgggtggatgccctcaaacgttttgacttccaaactcctctggaccctcagagcccatagacaggcctggcctccttcctattaagatccagtaacttctctccccacctcctatcccatatgggaagacactgaagaattctctctcctgcagcaggggccctactcaggatttatttctgcctcttctcttggcctccaggctgatgtcatgttaagttgcagtgtaactcagttggggatgtgccatatctgataaagaaataaagagactatagtccaaaggatccgaaaaactaggatcatgtgacagcaggatcacgggagaactctgggagtggatttgagggtgcttaatcaaggaagccataacaggagcctaaacaatgaagaatttattgacttggggccattcttttgtgatacgagatttaatacccaggtgaggatcctgagagctggtgcaaactggcttagtggctccaaacatctggaagaagtgatgacttacgctaagtacagttgaaatggctgaattcctatgctgcatgatagaggaaagaattaaaaggctcagggaaatgggcgtgctggggttgacatattatgaggggccaggagacatcttccaaaggattgtgttccctcagagggcccaggggacccacccaccattcaccaaggccatcagaaatgagtagtgacagaggcatcaacatcactaagaaattcagtggtggcatcctctacatttaaagcaaaaataatagcaacattgtagaagtaaaatgtatgaaaataataacacaatggccaggaaggaaaaaaaaacactgatgtaaatttcttatataatacatgaagtaataaaatattaattgaagatagactgtgacaag

SEQ ID NO: 16130 - DNA, 13554 bp, Human
gaatgccaaagtaaactgttttcctctgctggtatctggagcactaaggtccatgatttatcattaaaagaggaggggcagaggaatggttacaccaactttcttttttcttttttcacctcaaatttttactctgaaacaacctttaaacacccaacaaataaatgaaaacttgttgctgcatcaaaaccatcatcgaaatgaactgaaatacccttcattattcaacctacagtgtgtgcaagggccaccagaatgtgttctaggagaaatggctgcaaggccagggggtattaggagaacgtttctggcaggaataactgtccaaaggcaactgggctaagctaggagctctctatcactaaagaacctggagcaaaaactggaagacctctcctctggaatgccgaagaggggatccaagtattgggcaggagatagagaggtgccctaaaatcctttcccacccagggtgcatagatatataccccatagggtcctgcaggagacgatctgaagcagaacttatttgagctgtttgggattacacagtcttctataaaactggcccaatcagaagatttcctagtcagcttgttgtccagaaacaggctttcctagctctgcggcggttaggagttaaatgcatcaccgttggctccccagacactgctgggactcaaatgggtgcaagagtgaaggggaaggtgggaaaaagatggagaagcaggggggaaggaagccacagatgtcatcttttcaggatgctcagaattagccctaatgccctatagataaaggattggtctgagaaccaatcaactccttatttctgtttggcagccaccttcctcttccccgatctcctcttatttcaggtcgggctgcagcaaaatggcccaaattgatctcgaatctttccaatttaggccatggagacacaatcgatattgtatggaaagaatctcaagaagagatacttctttgccacatcatgaattctcattccgtcattctcatcctttgattggctgctttgatcaaacgagtggaactctaacttcgaacagaaagagaaaaacagggtcagtaaattgtgccatcacacaggaaaatacctaaactagtcacactgttttgattcaattggctactgaagttatagaatgttgtttactcttctctcctttgtctactccccagccaacaaaacaaccgaccttagctgttttgaaaataaatgaaaattccaacatgggtttgaaataaaattgcatcataaacaatcggtaggtgtttttcaaagtggtttcagggaagtgccacggagtaagcaggcgaccaccgaggctgctaaaatatttcctgtcctgaccagggttgcgtttctggagaatatttaacagggagggttttaacgcttttaaagatgttgaaactaaagaacaaatattgaccagagggcaccacaacgctcctgaaagagagtaaaatacatcctttataaaatgaaaaactacttggatgaattattccaaaattcctgcacaagtggacctcagaaggcagacggaggcgccaatttggcatggccagggcctgggcactcacgcaccagggagcctcgcgggtccgctctcgctctgtgaggccacggtcttcccgccaggttgactcgagcctcctgccagagccactggccccggaggccaccctagaccgcagctggcggccgctggcacgagtgcagggtaactgagccagggccgctggcgcatttggcctggccgaggccaccccgcgcggccgctccactgtgcccgaggctgtcctggaggtgaggccggcccacagggaccctgcccgtgcccgggctccggtgagtcagggcgcgttatgcaagtgcccccggcgcctccccttcggtctttcaccccgcgcggttacgaaagcgcgaccccctccccccggcgctataaagcagcggggcggccgcggcgcgctcgcctccctcgctccacgcgcgcccggactcggcggccaggcttgcgcgcggttcccctcccggtggtgagtcgcggccggggcctcggggccggcggcgggatgggccggggtggggtggggtggggtgaggtgggatacggcggcgggggtcggctgccgggcactgacggaggcgcgtctcccgcagggcggattcctgggcaagatgaagtgggtgtgggcgctcttgctgttggcggcgctgggcagcggccgcgcggagcgcgactgccgagtgagcagcttccgagtcaaggagaacttcgacaaggctcgcgtaggtatcggcccagggggcccaggcggcccaggtccccaccccatccccgccctccccgcggcccgccgtgcgcccccggacgccaaacccctgctgtcatccttctcacagttctctgggacctggtacgccatggccaagaaggaccccgagggcctctttctgcaggacaacatcgtcgcggagttctccgtggacgagaccggccagatgagcgccacagccaagggccgagtccgtcttttgaagtcagtggccgccggggcagctgcgccctttgcgctccagggttccccaagggccctgcctgctgatcgccacgtgggcattgtgaagggaagggagcaccgaatgggtggagggagggaggaagccctttgcccggcttggctgaggatccccttggcttttgcagtaactgggacgtgtgcgcagacatggtgggcaccttcacagacaccgaggaccctgccaagttcaagatgaagtactggggcgtagcctcctttctccagaaaggaagtgagtagtcagctctgtgggactgtcttgggaatggggcgcctaccgggccaaatcgctgggtttcttctccagaggtacctacccttaggaagaatggcctgcggaaaggtctggaagtgtcaggaacccgcagcaccacctgaggttaggggaacaagattgggagcagctacctaccccctccccaaacctcagctcaagaaacctggcctaagctcaaaaggacctttcggtttgtcaggtgtcattttccccaccagccactgtgccaaggtgtgtgctttctccatgctttctcctcctgtctttcacatcaccactccacctagctctgcatttcctccgtctctttgggctgaatccctgagacagcttgactatctggggctcccacagaggccgagagagccctatccaaggacggagggaacactgtgcataggggtggatgcctcccaagtgcctggcctgctgatgctgagattctgagccaggcacagtgtgctgtggctgtggcctcttccctttccactaagctgtgaaaatcagatgtggaggggagtgatgttgaggacttgtagaagaacatcctaaaatttggcctaatcatgagaaaacagtgtctacatgctctttttcccatttttttccccatttatcctaagtttcaaatcaggaatctacttggtagctagagaataatgcaggccaggggacacatatcatggaatcttagagagggagagttaaccttttggagggggttcaatatgtagatgaataaactgaggccaagagaactttgcccaaggacatgcaacaagtttgttagagccaatgtcagaagccaggcttccaaatctcaggccaggatcaggtggccctgaactgcagggactcctaatccagaccagcttttgcaaagtattgtttgagctcttctgtgagataggaccaagggttgttcagggagactctctctgctcggtgatccagggtagaagtgtcctttattgtaaccctttgctctccatatatggcacaccaccctcttggacttcctctaaagttgtgtgttggatgaaattgcatttttaaattttatttaatttttaattttaatttattattattttttttttagagacagggtctcactgtcacccaggctggagtgcagtggcgccatcatggctcactgcagcctcaacctcctgggctcaagccatcctaccacctcagcctcctgagtagctggaactacaggcatgggccagcatgcctggctaatttttgtattttttgtggagtcagggtctccccagcttgcccaagctggtcttgatctcctgggctcaagccatcctcccatctcggccttccaaagtgctgggattacaagtatgagccaccatacctggtagagaaaaagcttagaagctttatttttatttattatccttggaaataataaaaattatttcaaatagtgcagcaaaacatcccaaagtgatttatttagagtaaaatatacttttctgataatggattacaaaaatcaataccagaggtacaagattattaatttttagaaagaggaaacacatatgttctatagcattttgagatgtgctccttaatggactaggattctgttggcaatgcctttaggcacagggtcagagaggacccaatgagaagggagcattttgtttcttgcctcctccccctatcaaaccagattagtttgcttttgtctcttgtatattggtattttatcaggatttcatttggagggcgaaaaagtactgccatcttgaaagtgattgctatagatattaagtgagatgactataatatggaaggcttaaggataaattccttcttaggttacatttcaaaaaagaagctgtgcagtgttgtagttaagcccgcccggttaaaattagacctcctaagttcaaatcccaactccaccactacttgtggaactttagatatgttccttcacttctctgtgcctatttcgtcatctgcaaagtgaaacgatcatagaacctacctcatagagttgtgttacaagatgcaatgagtcaacaggcagaaagcactcagaacagtgcctgagacatgagttctttgtaagtgtttgatatgatggctgcttagttatctccctggtcgtgaaatcatagctttagattctgggtctagaatgggaggacccatggagaccactgggttcaagtctcttgttttagaagtgaagaaactggggcccatagagaagtgactggcctaggggcacagggtgaatttttggcacttagtgacacctcttaacccatggcttgtaaaaaggcacaaacaatgcctttgttttctgagtatctcgcaaatggcatggcttgatgcacctaccttgttctgttttacatgcttgttttggggtcatcttaacaaactctactttcattcctcgtgccagtttcttccctgaccatggtcttgctttaaacactgacttggacagagggatttgaaggccactccaagagtgggctgcatcctcagcctctcccctgctccacacactgcatctcaccaaacggatgtgtttaaaatgaggtgcgcttatggagagaaagtaactcagggccaagcgatcatgaaatttgttgtcgaattattttaaaattaaatgtgatcaatctctacagttgaatgtcagtgttaacagactgatgtggcttgctgctccagccttgggcatgctccatactggtcttcccttctggctccaccagcagcaagcaggatgtctcaggggttgaggatactaccatcagcaggtcttggttgaatacaggctagcctccctgagatttgacttccttcactatgaaatggggataaagaatagtttctatttcatagaatcattggaaggactaattaaggtaatttgtgaaaatgcttagcctagtgcatagtaagtgctcaataaatattagttatatcatcattgttttgtgctcttgtagaaagacctggacaaagactctccttgtgtccttctgtcagatgaagtctgtcactctgctagtaaaggggcccttgtcagactgaataacaatgcaagcctgaatgtttacattagtgttggtcaaagtcagggttcctgctccatctatatctaaatacactagggtgcttgttaacaaatgcacatttctggactcaaacccagaattatggagtcagaaattctaagggcacggccctggaatctgcattttaagtatgctccttgggtatgctgtttctgcacaatgaagtttgagaaccactggtctagataattcaatctgaagagcttggcttactcaggtatcaaggcctcagactccactcacttttctggggcctgttggggtattttgacaatgcatcagaaatagcattgaatctgttgcctggctggctcagctggactgttaggcctgagaaccacagggagcttcccacctggtcttgctgctttagatgattggagcatgcaggtttagggagctgaaaggacacatgccaggcccacagcagtgagcaacagaacagaccaatggaaccaggttgcctgagacagcgccctctaccaagcattttctttggttttgggactggcagtccaaaccgctaaaccagtctgtgtaggtacagtatacacacagctgcagcatgaccccacttcctaggatggtagaggggaggcaggggctcccagccacacagccactgcctccaacgctctctgtccctagctccactgcatgcggttagctggagtctggaaatggctgggggtgtctggttctccagaggagccctgcccagctgccgggtgtgaggaggttagagaaccaacctcattctcgcagtgctctggcagttcatctcttgcaaatactcttaaaagggagagcctggtcaaggtcactatgatttaaattcctcgtctttgaattattcagccaaaagagcctggagattaaccaaaccaacttaggccttcttttaaagtcaagaacagtagccaattttactaaatccaagtattgaaagttacttaattcctctgtcaaaatttaaatgatggcgaccattttggaggaaaaaaaaaaaaaaaaagttaagctgccgatcggccaagctaatagctgcctggatcatgagtcgaggtaacatttcaaaggcaagtgtttttgtgtctgagggtgcctgtgacagacactgtgatcctcgtaaccagggaaagaatgacttcatccaaggatgaggaagaccacccagatactctggagcctgtgaggggagtcagtggttagggtgaggcccagcaggcagccctgtggcttctgttcccagcctttctgctgaataactttatggttcctgctgagcagtcatggttctggaacatctcctcagccccacctctgacactgttaccctggaacagcctcaaggcacaggagtggctcattctcctggcaggcctagggtgagttgaagagaggggctccacacccactcctgtgacagcccccctgcagagcctgggtttgggctgaaccccatcctaggctggcactccaggggttctcagagaggcacacccagaggcaacttaggaccagcattccaggtggccttacaccctctaacgctgggggatccagttccctctgcgcttctccaactggaacactgcagagggagcatcaccccttgctccaacacctgagcctgagatggagacacaaagcctttttgtttcttgcccctctcccgtcagtgtactgattgtctggagacagtgtggtgtagaggtgaagcatgtgggctctgggatcacactcccttgcttgaatcccagttctgccctgctctttgtgaccctaggtgaattattaagtatctctgtgcctcagtttcctcacctgtaaagtagaggatgatagtgtgcagttttggatcaatgtgagaggtaaccgagaaaacaaatgggagtgtccatacagtgactggcacataattaagtgctcagaaagtcccaatcatggtattgtgtcaacaagaaggttaaattaagtagagatgtggcacttttatctcaatacagggtgacactgttctttctctgtggcaaatcgctcacatacattctttttttctttcttttttatttttttaagacagaatctcactctcactcaggctggagtacagtggtgcaaacctagctcattgtagccttgacctcctgggctcaaaacgatcctgccgcctcagccgcaagtagtggagaccacagacgcatgtcaccccacctggctaattattttcatttttcatagataccaggtctcactatgttgcccaggttggtctcaaactcctggcctcaagttaccctcccacctcagcctcccaaagtgctgggattacaagcacgagccatggtgcccggccacacatatactctaattaacattctttcctctcctgccttcgttgatatttttaccactttcatttactcttattcttcatggcttacatttcagccttgaggaatacatataatctaaattcagtggctcagctctgcctctgtgagttgtgaagaggacaaggtctgagaaggaatatctgatgccagatggtgggcctcttgtgtcctcaaggcaaaacctactctttgccggcacaaagaagtgagtagcattaataagcagaattaggatggagccagagaagccgtgaccatgggcgtggcatcctccagaggactgagagagcggggggcagcccggtcagtgagttgattaggaaccagcgatagagatcgagaaagacataagccaatattgggggtaacataagttggtggccatcagatattagccacaaaagacacagatattattggagagtagatggtgaagcgacagtagaacggtttattctgtggttttgatgagcccacattcttggtggttctttggaaagatgctgtcacattatgctgacataatcacagggacagatgatgattgaagtgaatgagatttccctgactccaagatttttttcaataaaggagaacaagatcctttctgatttgccaaattttataaaagttgtcagaattctctgaagtgtcctgcttcctaaagaaataaaaccagcttctggaagtcactgtgttctcaggcctggtcgtgagtttctccgacatctgagcccatgagggaaaggcattgatcggcatggtggctttctggcttgcagatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggtgagtcaggagcagggtgccttctggctcttcctgcagggcagtgggtttggactaaggggcccacgtgctagtgaaattcattttgtccgtaccccagagaaaacaggggttcttgggagcccctttctgaggccaaatccagatcctgcttggccagatttttcactggccttctcatagggctcatgcaggtgtgggtaaaggcctttgtccagttcactggcactaacactgccgtgggctctcttttctttttattctgcttcctcgggccatttctgtggtcacccctggctacactgccccaaaaaaccattgtgactgaattaagattgtttgggattgagcagcccagtaaagaggtgggcagttcatgtggccattgacgtaaaaactccacagggggcatcaatgtagtaagctccaaagagaatgatttcaacgcaccttcttttttctatatgaaaccaaatagccatgacattgtctagctgggtttcctcagttgggggttttgagattctctggaacaaccataggatcttttaggagatattacccttgtctgatcttgattttaaagccaggaacattgtgcaggaaagagctccatttagtttgagtggacactcactcattgctatgggatactgggtttcaaaatccaaatacagtaatgctaaaatgtagagaaacaaaatgggccaggcatggtggctcacacctgaaatcccagcacttttggaggccgaggtgggctgatcacatgaggtcaggagttcaagattggcctggccaacatggcaaaaccccatctctactaaaaatacaaaaattagccaggcgtggtggcatgcgcctgtaatcccagctgctcacgaggttgaggcaggagaattacttgagcccgggaggcggaggctgcagtgagttgaggttgcaccactgcattccagcctgggcaacagagcaagattctgcctcaaaaaaataataataataataatcaaacaaaatggagcatttctgttggtcacgaactgacccactacaccaaacagatgggaacttagaccaaaatcaaattgattttgaagcttcacccttcaaaattaaatgtagggccagcaaggattccaccacagcagggcaccgtaggaagcagattatgcacattgtacagatgagaaaacagaggctgacaatgaggaagaaagttgccctaaatctttaataggtagctgagttggatgcaaacctagagttttgtgactctgaagtcccttgtgccacaccatctggtgacacatgacatgagacatagaagcactttataaaaccatcaccagtgtgtcccaggtcaggctgccttggctcccacttcctgaaagctgagggtggcctccgacactttgaaatgcaataaggcagacttaagagaaatcaaaggaagccctgttcatccagcaagtcatattctctccacccccattacgtccagagaaaattcagtgggtttcagaaacagccttgaaggtgtttatgaattacagccacctgtatccgtaagggttgcaatctgctgtgatgcatttgaattaagaagcatttgaatgaagccagctctaaggccatcatgatgttcattatctacataaaaactgggtccactttctgtcgttaatggctttgttttgtattttccaggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctgaaaaggaagtttcctctttaacttagggaagccttacctaccagcctggccaaagcactggtgccaaaagaggaagtgagtagacaggtcagtccagtgagcccaagtcctcagtcagccctaggcctgtgagtgaggtgggcgggctggcagctcaccagtgctggatttgagaggctgagccacaggggacaaagtgagctctaggaaacactccttagccctttattgtctctagcatgcagctcacctctttcaggtgtaggcaaaatgttgatggggaggagggaggcctctggggaaattcgaagatggggctctggaatctcattctataggaaagatcagagcaccccctacccggaatgcagggaggggctgggtagggggtgagttgcaggggctgggacagagcaccagcatcctgcatcattagcagcacgtgggaaccctagtgtatgggtgcaaggccacttgcctcagttttccaggcgttcccaggggcctccatttctcatcttgaaaaaagcagcaaggctttggtaccagagggtcttggtgtaagtgcaaatctgcttcagatatatattagctgtggatttggggctggttacaaggcttatctgagcctcactcttttcttgggagataagggaaaatagtccttgcctgatgggctgcagtgaggattcaattaggcaatgtcccttagagctctggggagctgtgaaaccggtgatgccaggctgatgtctatgaaatgcactgggagtgaggaaagggtcacagatctccgcctgggtgttggaatatccagggaccgtgggaggctcccgggggccccatgctagtgttctccaccaaagacagaggagacaggtgatgtgcatgggagagctttgccttcctctctcacggaaccacaggctgtcagagccttgctccgcagcttcagtttgacaacctcagagaaccataatgatataggagttaaaaagaaattactcgggcagatagtgagggtatggaagtccttggtaagattttccttttaatgaaaagcagcccctaaatccttttctaacaaaaagcagctgtaaaatcgtgctgcagacatagacaagcaagttggaagcttgcatgggtgaatgccagcagttgtgtccattggaatgtactacctaagactaagcatgttcaaaatggcggctccgtcttctctttttgccagctatgagtgcagtaaggagaagacaagatggccaagtggaaagtccatttgcataatcagatttgggtggggtggccagcctttctcgtgcactacgtaaacgtcacacctggtcaaaccaatctgtgagccctatgtaaatcagacaccacctcctcaagcctgcctataaaatacgctgtggtccaccacttttcccttttcagatgcctctgtctcacgagagagagagctgctctcctctctcctttcttctgcctattaaacattctgttccttaacccacccacatatgtccgtgtccttaatcctcttggcgcaagatgacaaaccccggttatttaccccagacagcaatgccgcttcaataagatagccacacatcacttccaaaaacaggtttaattgatcaaatctattaactaaagtgagcaaaacatctctgttcgtttgtcttcgagcttgtgatatccatgaatctgacttcagaagcaagctgctccagaaactgcataagcagtcactactgctggtgctgatttcctcagcaacaaagatttgttgaacacctactatacaccaggccccgtgctgctgtgcattccagccactggcccagcctccaagtggtggagtgaccctgggttcggtctttggctctggtttctctctatctctccaagggatgtattataaaaccataggtctataaacaccatttatatctccaaacaatgtgcatctccaggcccaagctccacatctctgc

SEQ ID NO: 16131 - DNA, 47181 bp, Human
tcttagcagcagatgtaaccaattaagatcatttgcactcatactggattagggtgggccctaatccaatgactggtatccttataagaagagaggaatgtggacagagatgtagatgcagagggaagataaccatgtgaagacatggggttatgcttccgcaaaccaaacaacaccaaggatcctgggaaccaccagaagctagaagaggcaaggaaggattcttccctagagccttcagagagcacatggccctgccaacaccatggtttcagatttctagcctccagaacagtgagagaatacatttgtattttaagctacccagtttggtagtaggaaactaacacagtaacctagcactgtgtgcaccacagcttggtggatagagcatggattggaaaccacttagacggactgggtggggtgtgcctatttgggggagatgagggagaggagaataagttatttactcatccagctacactgaccaacttgtagacaatgcctccccatgactttatgtgattgtgtgtacactgtgtctggcgagtgtgtcttcagctttattttttccggatatgacgatgggagttcttcaggttggtgaaacttagaaggtgagaattccatttaagcaactgttctccctatctcttggccatcctttccacccctagatctcagatggtgaagctgtgcttagagaggttcaaaccttgcccaagttttcacagctagttagtaggaagcagaattcagatccagaattctctggctgcaaaaattctgccctttcctttatatcaagttctttctcaagctaaagaaactgacctcttttcagaaagatacggagtgatttgtttactttcttaagcatttcttctagatttgaaagtaacatttatttgaaaaatatttagaaattattgaaatgttaaaagtaaaaaaattatggcaataactactgttactattgggtaaatatccttccagtctttttttcctataaacacatattatcagtacaatttgaataatactgtaaacagtgttgcattttgcttttttaatttaacattatcttgtaagcattttctcatgtcaatagtttttgtaaacaggattttaaattactaaataatgttccatcatatggatgggccataatttaacattttctattattgtctacttagtttctaccttttttacaatgataaatatacagttaacatttttcataaacatctgtcctcttattatttcttgaggacaggggacaatactgggtaaatggatatgaagattttaaggcatttgatgcataatgccaattgtttaccaaaagggttctacctaccagcccaatcagagtgcctcacacggcaccctcacccatactgtcatcaataaagagctttgctatgttctgaaaaggcgcgtgccgcgattccatcacacaggctgccgcgtccagaggatggcagggggcgaggcgaggcagggaaaccagttaggagaccgcggcgatgatcccaggggacgcgctgggggcttgaggctaggcgcagggatggaggaactggaacacgcacgggattcgtagaatattcgacgggggcgggggatcgactctgataagataattctgcactgcgtggggtgcaggagagggaggagactgcacgttcggctccggcctcctccgcgccgggctcggcaccgatccgcgaagttggccgaggcgtgagccccgcccacccctttaacagggacactcccctttaaggcgggcgcccgcgcgcgccccggccccgcccttcgggggcgcgcgcggcggccgcggcgccggctccgccgggagcgcacgtgcaggcgccgggcggaggagagggaggcgggagccgggccgcgggaggaggggaggcgccgggggcgcgcgcgcgcgcgctgggcgctgctgggctgcggcggcggcggcggcggtggttactatggcggagtcggccggagcctcctccttcttcccccttgttgtcctcctgctcgccggcagcggcgggtccgggccccggggggtccagggtgagtcctgggacggggggcgggggccgggatggagagggcccggcaagggcgaggcctcgagccgcggccgctggactacagcgcgccccctccccacgagcacaatatggccgggtggggggcgcagaggagtcggggtgacccccagtcagcttccccgatctccgaggcgcagccgcccggcggcgacggagctcacgccgggcccctggggacccgagccctgttccaggcggaactggattcgggcagttctcaggggtcgcgctcccagcgccctcgtgttccagagaggggagtctgagcctccagctccaagatttggaggtccgtggtttctgcccttcaccgtgtccaggggcggggggctttcttccctccctccaggtgctcctggggggcgtctttctcccgccaagactgtggggttcgggcggtggggtcttagcctctccgagggaacctgatgttgagagtccgcgcacctcagactgtaggggaaggggtctctaacctttccttcaggtcctgcacttggcgtgtttcttcccctccctccactgcctccctaatgttctgggaaagggagtcacatttccccttcactcaatcccttgagttcagtggggcaatcccccctccgccctccggcactcatgccccgtggaggctatttggaggaagtgggacgaacaggcccctaaacctttttggagcctggctttggaatccctaaccctatggaaccgagttccccaagggttgatgtgaatctaggtgtatttgctttcctcctcgcctcccccaccctaccccggggggcccattcagttaatcactttgtggatgcctttcaggtgaaatcctggaacctgtctccaaacccccaagattatttaaagatcccaccactggactgtattcccggcccttggtcagtacttatttaccttcctacacgatgcctcttcccagcccgcccaccctcacacaccccttacctcccaatccccacagtctgcggctcgccttataccacccccccactctcctctctgtagaagcgggtacctttttgcgggacacttcgctggctgtgttgtttttgaggctttgggggctgagaagagcagatgaaaccctaaaatatttcatttaagagagtcttggcgaatgtgttttggccttggggtagcagatgaaggttatatttggcagttatattgaagcgattattgacccacagatggatctgggagagatgatcaggattgtattcgctcctgacgtacaaagcctgatgctttgacttctcagcagcccctaaccttccagcaatgggagataaagtgtgttctgtggctctcttctcttacactaaaaataatgattctcaggtgggttcagtcgtctttaataaaccagacagtcaagaaaagacaccatgccactttggaatctcaaaaacaagttcattatctccggctttgatatttgttcccagtggtggagcctgtgcagcggggtctttgttcacgggctaatgcttctcctaagcacctcgtgtgtgttcttcggcctcactgctctgtggcttaggtatctgtgctgtggggtttgagaaacatggtgaaggtgtatgaacagagcttgacatttgtggtgagataatgatttgcatgaataaggatgttcgtcgggccttattaagggccatgtttttggaatgtgtaacataatgttctctactgggtagtaaaaaaaaaaaaaaagggagattgaacctctaggtttgtcattttatgtgtgtatgtataaatctttaaatcctcatataggaatttttatcctgcccctaatatatccaggatttttaacagtcatttccctgctgatttgatgtagtgtttgtggggtttttctggttgtgagcctagttaagaatgtttgataatccaagtggttctgaatggggcagagttcatttttttgtaaccttcctaaaatggatgtttgtgggggttaaggtgggtgagtaaaatagggagttcgtttctttttttggtaaattggaaattaggttgtgtgtccagcaaacattctccagggcctttaaacttcttggccagacactacagttttttccaggacacgtctagttgccaatagtgtatgctatggagaccactgctgcaaagggcttaaagtaaaacgtcagttctgggaaaatagaggctgtgggataacaagaagttgatttttttcccctcccctgcatttcctatatagtgctcccctacgtgggctggaggagtgacagagccagacagctctgatgcctgatacttggacttgatgtgaggggcagtaagggataggtgtttctattaattaatgaattaactaggacttagtaaaaggccagtgataaggagaatgagtttcagttagaaatagcatccgtttgataggtgtacatgttttaaggcctggctttggaattttcacatttaaaaatgtaaaattgagttagtagcaggagaacatgacattcatttcttaagacaaaagcaacaagagagatatttgacattctcataggaacattttgaaattttgtgagcggactaaaaatctaatttcaagccaagccttgtaattttgttgagtggacatggattttaagtacagtggaagtgcagtcttgtagagacctctgattagttttgtttaaacagctcctggaacagatgtgataaaacatattaaaatggctactctggttaaaggttaaagccagatggagggaggaggctggttttcagccctagaacttagctgccttacaagttgtccttgaacaagtaacttaacctttctgtgactgcctcagttttccctctgtaaaaataaggaaatattttgtgtcactcttattgggacatttgtgagactgacttactgatagccagttggcggggaggtatttttagacacagtttctgacttcagtgaataagcaatgctgggttacttttttatcttaaggagcagaaaaacatactctgtgattgatagacgtacagcatgtcacagtgtggttttctttttgtgcttttttgtagacccctttcagatttcctcaagttaatttctgtctctggcaggctcttacatcgtcgactaggcagcatacctgtgctaatcaaagacagtctggagggagtgacctgctttaggctttattggtttggcaacgttttaattcttacgcaactctgggtatgtttatggcactatgtaaatgttacataagaacatggaggctgagaagtggccagaatggtgactgtgaacacaggaaggttagactgaggactttatccaaaaggaccttgggaatctgcaatcagtacaggaagaacctgcacttattttcctctaagaacctttttagatgattatgtctttcaggtggactgctgtgttataaataggtttattctccaccggtgagctaattgtaaccttgctaccaaaatatgaatcagtaaacgatgagacgtgctgcttcttccagcatgtcctgttgaagctgcttgttgcattttggaacatgagttgaattgggttgcagtctgttctcataatagctgaggagcacagggtgttgaggtggaatggaattatcagttcgtggtgctttaggtcatcttaatttttgaaggttaaattagaatactgaagtggctctttataattttgaaatctctattgtttactgttcaatttttgctcagagtagcagtgaacattaattctgggatctcgcctgtttgtcttcagttcttgtgttagctgttgttgtaggagttggtgtaagagggtcttaatctcattttcctctctgtattcataaaaagggaatcctagagtcctttctcaccagtgcttctgatgctggacataactgcaggcagccacagcccatcagttccacttggactgggaatgcgggaaccttttaagtccaacttacatttctctcactctgcaggcactgcctcatggccaggttcagatacctgctctgagtttctgttctcagtttttcactctcatgcaggtttaacttgagctttggcttcagaggcaccatttctgtccatgtctgctctctctcctctgttatggagaaatggtgtgctaagcaaaaatatgatttcagagagtatctttctttcctttactctgtagagttgccatactttggtttagctgtgaagtttccatcccaggcaatctttatctgctctctagggttcagagacagtgccactttaggcaactctgggctttttggttttctttagtgtccacccagtcttaagcctgcatttgtctccctaaatattttgaatttagcataatgaaagtaactgcctttccctttaaaccataacatcacacctaatatttacacagttaacatataggagatttctttattcattggattgggtatgtgcctggaacagtttttggcatggggaaataacagagaacaagatgaacaaaagtccctaaatctctattatggaacttataattgcaatggcttagactgaaaataaataagtaaacacaattatcagtccatgagtgctgtgaagaaaataaaacaggatgctgtgccatagtgtgcctggagctgccacttcacctctctatcagcttcattgttttatctgtaaaatggggctaatacagtcttgttatttgtggtagttccataaagttgaattgtagaactgaattaccaaatcttcaaccattgctcctaggggaaatacagggctaggttcctgcgagcctctggtcactttttcaacctgtcaatacataaccttattttatgtgtttctttttttttctttttttgagacagggtcttgctctgttgcccaggttagagtccagtgacatgatctcactcactgcagtttctgcctcccaggctcaagcaatcctcccacctcagcctcctgagtagctgagacctcaggtgtacaccaccacacctggctaatttttgtatttatttactttttggtagagacagggtttcgacatgttgcccaggctggtcttgaactcctgggctcaagcaatccactcacctgggcttcacctgctgagattacgggtatgagccactgaacctggcctgttttatgtgtttctgtttatttttatttttaatttttatttttttgagacagtgtcctgctctgtcacccaggctgtatagtacgagagtgtatcataggccaggcacagtggctcacgcctgtaatgccagcactttgggaggccgaggcaggtggatcatgaggtcaggagttcgagaccagcctgacaaacatgctgaaaccccgtctctattaaaaatacaaaaattagccaggtgtggtggtgtgcctgtaatcccagctactcaggaggctgaggcaggagaatcacttgaacctgggaggcagaggttgcagtgagcggagactgcgccactgcactccagcctaggcaacggagtgagactccgtcaaaaaaaaaaaaaaaaaaagccaaaaacatcatagctcactgcagcctgaaactcctgggctcaaggaatcctcctttgtcagcctcccaagtggctaggatcacacgcacatgccaccatacccggctaatgtttaaattttttgtagagatggggtctcacttgttgcccaggctggtctcaaattcctgggctcaaattatcctcctgccttggcctcccaaagggctgggattacaggcctgagctaccatgcctggctttgtttctgtttaaagacaccttatttaatatatattgttggttcattaacattgaactttactgacagcagcactattaactcatgcctgaactaagcttctctaacatgtattttctctgtgaggcatatcactatcttcttgcacttaggaactctagacagcacttcagcactacttgtgggggaccattttatacagcaaaatcatcaatgaaaagcatgacactaaatatactgcagaaaggataacttgtttacagtatgccagctgaaacaagaaggcagggtgttgccttgtttgacctcagttgggaatgcatgtggtgggtgtttcagatgtttcactattctgtgcatggctgtcagtgagcaggaaggtaccatgaatgttgatattggggttacaaataaatttgcattaaccatattttgttagaactgtatacaaaagtggtagaaataaaattgtagaatttcactaaaccagaattttaatacatgtagttagaagtcccatttccagactgcaaactaaacatatgcatgttgagtacctaccatggtgatctagggcagtggtccccaatctttttgacatcagggactggtttcgtggaagataattttcccacaggggaagtaggggagatatgattttgggatgaaactgttccacctcagatcatcaagcacatcaggccgaggtgggtggatcacctgaggttgggagttcaagaccagcctggccaacatggtgaaaccccatctctactgaaaataaaaaattagccgggcatggtagtggcagcgcatgcctgtaatctcagctactcaggaggctgaggcaggagaatagcttgaatccgggaggcggaggttgcagtcagccgagatcacgccactgcactccagcctggggaacagagtgagactcctcaaaaaaaaaaaaaaagaaaagaaagatcatcaggcacatcaagcatgttagattctcataaggtgcatgcaagctagatgcctcgcatgcgcggttcaccgtaggtttcccactcctatgagaatctaatgccgccgctgatgtgacaggaggcagagctcaggtacccgcctgccacttacctcctgctgtgtggcctggttcctaacaggccgtggaccagtaccggtctgtggccccaggggttggggacccctgatccaaagggtcccttgacacatatttattgagcacctgtcatatactaggcattgttacaggtgttagggatacagtagtaaacgaaaggagacaaaattgccttctctcagaaagcttaccttctgccaggtgaggtggacaataaacaaaagtataaaatgtaaagcagttgtgcctactacagtccaccttctgctcctcacttccccaagattccccatgtttggtgtacacacacctgcttcaggtattcagtcaaatgctagtctttgtagatagaattaaggtctcaatcagttgacctttagccatctaaaggaggttatcatggtgggtctgtcttgattgaactagccctttcaaagcagagagatttctcagctgattgcacaagaggaaatcagatgttccagctggcttggaagcaagcagacgtccatgttgtgaactgccgatcccaacagccacatggcaaggaactgcaggcaaactctaggagctgagagtggttcccagctgacagctaggaggaacatggggacctcagtccttcatctgcaaggcagtggatcttgtcaacaaccagtaagcttggaggaggacccaatcctagatgagaaggcagccctaactggcactgtcggtgctgtgcctggacttctgacctgtaggaactgtgaaatagtaactaggtggtggtttaaaaaatgtatgcattgggtgggggtgagtcaaatggtgatggtgaaaataggtaaagcaagagaggggaataatgagaaataccccaagataggcatgagggtacttgagacctggtgcccagccatcccatcactcacatataaaaataaatcctttgaccacatgtggctttcatctgactataacttttttctagatatttgtgagtggaggggagaggggattgtggatgctttggaaataagttttttaggtgcttgggatgtttgagttgaggaatctgggaattgaagtattttctgggttttttttttttttgtggtagaggactcaccttgccccacatccttgtatattgctttggtatatgtttgcatattaccttttatacctgtagaagataagattgaattgtaatcagtcagtgttcatttctgatatccaggatgtgcctagcaccaagctgaatgctgagagggatcctgaggaaagagtctgtccttgccctttggaagtttacacacagagaccggccacagtggctcatgcctgtaatcccaacactttggagaatgaggtacaggggatcgcttcagtccaggagtttgagactagcctgggcaatatagtgagacctcgtctctacaaaacatttttaaaaattacaagggcttggtggcgtgtgcctgtggtcccagctacttgggaggctgaggtgggaggatagcttgagaccaggagattgaggctacagcaaaccatgattgcaccactgcactccaccctgggtgacagagtgagatcctgtctcaaaaaaaaaagtttacacacaaatggactttttttctgcttgttggaactaccacaaactatgaggagttcaggtgacaattgtaataaaagcatctgatttgctgaatgtttactatatactaaagtattatgctaagcacctgtgttgtatcatttactctatgtagttattctttgaggggctaggggctcttattcccattttacagatgagaaaactagggcatagagaagttaagcagtgggtccaaagtctatccaagtccaaaacatgtgctctaaatattgtactgtgctataaactgtgagtactgtaaaagtgaccttctaaccaggctctctgccttcaatctcccatttgttttccatcctacggctagatctaactttggaaatgcaccctgtttgtctgacctagaggttgtgtggcttctaggatcaactctagaccccttagcttagcattgcaatcagtttcatctggtcttagtctccctgactcttcttgcctttggctggaaccttggcattgttcgaactgtcaatttactctgaacccagtgtagctaatattttttcacagccctttgctttcccttttccttttctctggaatgcttctccccacttctcttcctagccaaacccagcgtcctccagtgtggaccttcgtcctcttgtgttctcccggtcagtgattccatcctctctgcttttcccctcagcctgtattggtagttggagttgcactgtttatagttgtcttctcccactctccatgcccaaagaattggtgcggggagctggcttatttgttatatggcttcggcctgcacagagccttgcatgtttcaagtacttaataagtttgtttaattgaattaattcatttcttttccatcctctcagtaaaatcctaggtaaataattccaattctgttttgctctaatgttattataatcttgtatatatagtattttaaacctactcaaaaaatgccgcaaacatttgtgagttacttggaacatcataatctctctttctacctcacctctttcatctctgtttatcctaccacctacccattttattccagccaaatgaacttgatctctcaacctcattagttttattctcagtttggctgatttcttttttccttttccattgtcccagttgcctgaaacaatcattcctatccctcttctcactcaaaactgtgacatacacggtctcctctccattcgtccatactataataaataggtcaggaagaaaataccagggataaatatccttccctgctctattgagccagaagtatgtttattcagactcaacaaagaaaacagtggttttacatgttcatcataaactgatatcaaaggagaaatgcaatttcctgattgtctaaatatgacagctgagtctgcacacataggtcccaggaacattggacacactccctcataatgaggcccactcatttcagtcttaccttgacattctcttgggcagcaggtgggcccttgctagatgttcaggtatttacagtcagccataaattaagttgcaatgacaggtctccttagcataaacatcaaacgtctcttctgagtgagaacaaagctttcattctctaactgagacttaaggttgaacttgtttaaacagctctctagggctgggtttgtctccaagtagaatgtcagaaaggcagtttgtagaatggatatagtgtggagctggctttccaaacacctttctcttatgcaaaccccattccaagaccttttcccagattggaattaaataccaagcttatcaagtgtcttattgttaaatctgtgtttctccccaccccccaccatacaaatagcttcctttattaagtcagttatattttttttcataagtactttttaccagtacatttgttgttgttgttgttgtttttctgtataccaccattggcacctgtaaaatttgactttattatggcttgtgggtacttgaaagctttttgttttaatgtatttttaaaatctaattttgatgattgtaaaaggtgaaaatgtaacttgggtctttttttcttttaaccaaatagcatgtgattgctttactgctgcaagatttttctatttaggctagttagaactttgctagtacagtatcagttcctagttattgccttcctgccccccaagaaagccacacattgcctctattttgtgaacagtttagtgccagacattttttaacctgattcagattttcataaacattttggcagttgtctagatcagtagctattaacaattgtctttctttttaagacagtggaactcttaaaaatgaaaatgtagaaatgtatataaagtgagtaaaagctgagcaactctggcagaggcccctctgcccctgaaattattaggctgagatctgttgagtgaggtttattgagcacagtgctatttgccaggtgctgtactagataccagtgagaaactgttgaaaaggacactggtttcctctttgtgagttcagagattcccggacacggtggagagtctagagattcaggaagaagatagtttgaaaaacactgtagtttttttttgtttttgttattgagatcatattgtatatgttgtttggcaaatagggatttatggtagtaattttaaattgtagcaaaatacgtataacataaaatgtactattttaattgtacaatttagtagtgtttaagtaccttcataatgtgcaaaccatcaccactattttttaattttaattttatttatttattttttatgtatttattttttttttgagacaaagtcttgctccgtcacccaggctggagtgccatagcatgatctcggctcattgcaacctctgcctcccaggttcaagcgattctcctgtctcaaccttctgagtagctgggattacaggcatgcgccaccgcgcccagttaatgttttgtatttttagtagagacggggtttcaccgtgttggccaggctggtttcgactgtaagtgatccacccacctcggcctcccaaagtgctgggattataggcatgagccaccacgcctggccgacatttcatatacatagaatcttaatgtgtggcttctttcatgtaatataatgtttttgagtttcatctatattatagcacgtatcaatagtttcttttcagggctgaataatattccatcataaatataccacattttgttcattcatcatttgatggacatttgggtggtttccaccttttggctattgtgaatagtactgttgagaatattcatgtacaagtctgtgtttaaacatttgtttcagttattttgtgtatatgccttggagtagaactgctgggttatagggtaattctagatttaacttattaaggaaccatcaagcttttttccacagcagttgtacccttttatgtcccagcaatgcaccaagggttccagtttctctaaatcttcaccaacacttattaaatttctttttcatattgttatggccttcctagtggatataaagtagtatctcattatggttttgatttgcatttgaatttgcaatacattagagatgatgttgaacatcttttcatgtgtttgcaggccatttgtatatcttcggagaaatgtctgttcaggtctttttccagttttgttggttttttaaaaattatgttttttagagaagggttcttgctctgtcacccaggctggagtgcagtggtgtattcttagctcatcgcagccttgaactcctgggcttaagagatcttcttgcctcagactcctgaatagttgggaccgcaggcatgcaccaccttgcgtggctcctgttcagtttttaattgggttgttgttgagtttgaaaagttttttatatattctggattctagaccattttcagatgtatgatttgcgtatattttctcctgttcattgtcttttcattcttttgatattgccctttgatacacaaaggtttttaattttgatgaagtccagtttatccattttacttttgttgcttgtgctttggtgtcatatctgacagaccattgccaaatccaagttcatgaagttttacccctcttctgagagttttagaagtttaagttttagttgatatatttaggtctttgatctattttgagttaatttttgcacatggtgttaggtaagggtctgacttcattctttcgcatgtggttatccatttgttcatcaccatattttgaagagacttttcctcccccctgtatgttctaagcactcttgttgaaaatcagttaatcatagatgtatgggtttatttctggattctcaattcggttctgttggtttgtatgtctatacttagcaccattctgtttgataactgtagctttgttgtaagcttaaatcaagaagtatgagtcctccaactttattttttttttctcccaagattgtttggactattcagggtcacttgcaattccatatgaattttgggatcggctttttcatttctggaaaaaaacaaaaaaaaggccactgagattctgatagggattgtattgactctcatctgatgtatataatttacatatatgatcatatgtttactctatgtgtaatttatgttggtggacaagttcggttctcagtttttcagtatcaatttgcaaaaagaattccttttgaaaaatagtatgcctaagaaaccctggaggaatatacatcaaacatgtagtagtaattatctctggggcaggaattagaggggctctcaacctctacattatatatttctgtggtgattgaagttctttttaaacgaggaaacatggattaatttggtaagcaggggaaaaaaagctagtaaagataaagtatatttaaaaaaaccctgatatatgatactcataatagcacaactaacatttatagttttggacccccccaccaagtagaattcctcaaaatgaaatattagaattgaaatgcttagtagcaagtaagaactttgatgtatttgattcaatgtcagcagctgggtgggaggacaaccagtaggttggagatattagagtacagacctgtggggaggatgcggctgcatcaaagcacaatgggaggtagaagctttactagataaagacagtaccatgtgagatcgttcagcgaggtcctttccttatatggatggtatagttgggctaggataggtatgatgcagaccatctgactgggataatgagcttggagaagccacagaattaggccggacgtcagtgattagagactgattatccaaacacgaacaagagaggaatgtagcagttttggttaagaacccatccttaggatacgcagtcttagaactacttaaggaaatacactgaatttgatcttgcatgttggatgaaatcgattacagactaaatttcaagtagtctggaagagggaatacttagtcttttctagactaaagatgtgtgtgtgccagaatctgtgtagctaatggtgttgggttgaggaggggagtgtggagatagagggaatacctacacaggacctggaaaagtagaagaggaaaatactactaaaaaaaaaagaaagaaagaaaaaagaattaacatcacaaaaagagacaactggaagttctgtgccttgtgagggatggtagggatggtattcatcacttgttagtattctagccagaaatttgagcctgaatcacatcaaacctctaactctagctaatagcttatagaaaatacagaggagagaggaacatgttaaatgacaccttggagagtcaacccaaaaaatccagaatgtgggaagctgcaggacaaatggcctagattcttcaacagataacttgcaaggaaaaataacagtgcaagcgggaacctatagattgaaaaaggttttaggagatctcttagctgagtgcaatggaagaacctcatttagatctggattttcattttattttatttttgaggcagagtctagctctgtcacccaggctggagtgcagtgatggagtcacagctcacttcagcttcagtctcctgggctcaagcaatccttccacctcagcctcctgaagagctgggacgacaggcatgtgccaccacacctagctgatatgtttactttttgtagagacagggtctcactgtgttgcccaggctgatctcaaactcctgagctcaagagatcctcccacctcagcctcccaaagtgctgggattacaggtgtgagccaccgtgcccttcttggatctgggtttgagccagttgttaattttttcaaggtaataaaggatttttgaacactgactggatatttgattatattaaggctattattgtcagttattttaggtatgataatgatattgtgggaaactgcaatttaaaatataacttgcggaagattgcaatatcaatgacaaaaaattaaaggcacttaaaaacattaaaggtaggccgggcgcagtggctcatgcctgtaatcccagcactttgggaggccgagacgggtggatcacaaggtcaggagatcgagaccatcctggctaacatggtgaaaccccgtctctactacaaatacaaaaaattagccggacgtggtggcaggcgcctgtagtcccagctactcggaaggctgaggcaggagaatggcatgaacccaggaggcagagtttgcagtgagcagagattgtgccactgcactccagcctgggcgacagcgcgagactccgtctcaaaaaaaaaccaaacaaacaaacaaataaaaacattaaaggtggtgcggtggctcacacctgtaatcccagcactttgggaggccgaggctggtgggtcacctgaggtcaggagttcgagaccagcctggccaacgtggtgaaaccccgtctctactaaaaatacaaaaattagttgggtgtggtggcgggcgcctgtaatcccagctgctcaggaggctgaggcaggagaatcgcttgaacccaggaggcaatggttgcagtgagccgaaatcgtgccattgtactccagcctgggtgacaagagcaagactccgtcttaaaaacaaaaacaaacaaacaaaaatattaaaggttgggggaaacctgctagagaatcggtggctggtactagtgggaatgtctggcatttaattgtacacttagctgtataggcacttggctaagagctttatatactgattatcttattcttcagagccaccctatgaagttgattctcttagttttctgcattttctaattgggcagcccgagtcctgtgagcccaagaaacttgcctagtgttgctaagctaacaagtgatggaaccaggatttaagcttaggctgtctgacctcagagcccaggctgttaatcactatgtaattatatctccctaaaggtgctctcagtgatagaggaggtagcagagaaactaaaagaattatttctggctgggcgcggtggctcatgcctgtaagcccagcactttgggaggctgaggcgggtggatcacctgaggtcaggagttcgagaccagcctggccaacatggcgaaacccggtctctactgaaaatacaaaaaactagccagacgtggtagcaggtgcctgtaatcccagcaacttgggaggctgaggcagaattgcttgaacctaggaggcaaaggttgcagtgagctgagattgcaccatggcattccagcctgggcaacaagagcaaaactgcatctcaaaaaaaaagaattatttcttcactcgtattgagaagcgtgctatggaaacatacaagtccaaattatttcgaagtgaacaagttgtagatgttagatacctcttgaggtaaaggtttaaaaccaatcttatattaatagttggcttgtaataaatgttattttattctaaatttaagtagtgataaatatatgggacgttttagacctaaagaagtgggtctttgtggcaaattgtatttcctaaatgactgcaactatatttcccatcccacatgtttttcttacaatgtgactttgacactctttccaataggcagggtctacccatgtcccttccttgaatttgggtggaggcttgacagctttgatctatggtatatggtggatgtgatgctttctggtatctaaggctaggctgctagaaggatacagtttctgccaggttcgtttccttttgggttcttgctctggagaagggcagctgtcatgctatgaggagcctaagctaacctaagctaacccacacaaagggactacaggttgaacatccctaatccaaaatgctgcaaaatccaaaatttttttagcaccaacgtgctcaaaggaaatgctcattggagcatcttgatttcagattttcagattagggttgcccagtcagatatatatgaaaatattctaaaatcccccaaaatcagaaatctgcaatgctttctggtccgaacattttggataaagaatgcttatcctgtagttggagaggaccgcatcaagaagaacgaaggtccccagccaacagccagcatcatgcgccaaatgtaagcgtgagtaagccttcagatgattccagccccagccttggagtcttccacctgaagccccagatgttgtggagtagagataagctgtccctgctgccctgcccaagttcctggctcatagaatccatgcatagattaaatggttgttctatgccacaagtttttggagtaatttgttatatggccatagtaactgggacaatgttatttttcttcccatctcaaaggactttaatgttgtcgtcgtaaatggccatttttgagcagatgtttagtgtggacctactagaattcagccctggagatgcaaaggtgaatggaacacagtctatttctttaaatggcaccacagccagaagactgttaaattgacctgttactcctatatgtgtaaagagatttccagaaagaccctggttgctatgctgatgagacctataataaaagtgggctactgaatctaagaaaacattatactacccactcgagagaaggtggcagtatggtttctctaaagcccaggcaggctaattggaattttttatagaggtaagtatgcatgtgaataaagagaaagacttgatctggactttgaaagaccctaataaagtctgtacaggtagttattttaaagtcacaaagggattaaaggaatttacactgtgtataaagaactatcttagccagcgtggtggggtatacttgtagtcctaactactgaggaggctgaggcagaagggatcgtgtgtggccatgaatttgaggctgcagtgagctatgactgcacctgtaaatagccactgcactccagcctgggcaacatagcaagaccctgtctctaagaaaattttttaaaaagtcttaaaaaataaagtagggataaagcaccacttccataatattggtagagtcaccaatatgaagtaaggaattcatggtgaaaccttgaggtttccagtggcattgttatcccaggctgtaacacactaaatccctggagatgaactgcaggaagacatggtgtggctctttggtcagaaaaccaatagcgcatttgatacggggagggtaagaatgtgttgagagtgatgtgaatgatatttgcagggtgctgaatctgatcacatgaaggtgttcctagtgtggccgtggccctgctggctctgtgtgccaagtgttgtcagaaagagcgtggtagaatgctgtgtggtgttgtggggaaaagatcgaacttagaccctggagacctgagttggagatgtgctccatcgttttactggtttaccgcttgtgagccccttaacttctccgaggctttactatccataaagtgagacagctatacctgcctcagctcgtgagttcctgtggggatcacaggagaggatgaaagtgaaaactcttgatacaataacacagcgtagctctgcacggtgttttcttatgggaaacaaactgaaaacatcctacctgaatataaaactgatgtctctgatcctgcaatcacagttgtgtagagttatggtctttgttctatccgtactggagagggttgggataagggccagggaagaataattaaaataatcatggttgtattaggctattcttatcacttggggctgtttggtgaatttctcatctggaaagagtgctgagaagcagtttatgatcaagtcataaaatcacgaagagtaagggcagaactagaaggttgcccggtgaaatttgaaaatctctagcgtacctaaacaggacagtgctccacaatcagtactaaatttatgaaatttattattcccaagtagtaattaagttaaaattcataattactatagcttcaaaaaagttttaggtgcgctcctggaccttcatctgttaggacaaacttagacgttgtgtgctgtgcctcttccctttcacagggggcgccatcatgctgcacactcccacacccctcctggtgagggtctgaggcgggatgttaggctaaatggccatgaatctgactgtgtgtggcggtttttgagaattcttagctgggccatggtgtcactgagtggcctgtcttttctgagttccagctgtgttaggcgcctctataacacggagctagacagtctgcccaggttggaacttgtcagccttactcaaaacacagcctgtctcatgaatcaaatttgcatttacatcctaccacaaaccaccttccaatcatactttggaaccgtgttcaaaccctgccaaggtggttttgtctttagtttaaatttgactaacttgttaatgacaaaagtctatgcaagtagggcttttgttctgaccacttcctaacttgtttatgtgtagagtgattttgttactcctgtgatttggttttccgagttgtgttatttctactacgtaattcttccgccttggaataaggagagttttaggtatgtttatatacacggtgtgtaaaatttttaacctgatgagtcactatgaaacagattctaaggggctgttatcattagtccagatttattttttcagagagaattgaatttagtgtgcgtgatttaatgaactaagatttacagtaaatttagatgtttttataatttatcacttttgtttcagtggaaaatgaatgttaacagaaggctagccaaaatgtctgtctttaaaagatgtttaggaaaaggcatataaaacagagcagaattgtccagtgttgggtcagtgatcaaacagtgtgaacttaaaaacaaaactagattcaaacatagctggaaaggattttagaggtcatatagttcaatcccttctttctggttaatcatgagaaaaatgaggttcaaagaggttaaatgacttgcccaaagccatgcaactagttcctgatagagctgaaacttgaacagcagtttcttactgaaacttgccacttcctaattagtggttaaggagacacatttttacttgggtggtggctttttgttttgtttttaggttttacattgagggggggattaatatttattgaatatctactagttgttaagtactttaaaaaatatattagctgggcgtggtggcacatgcttgtagttccagctactcaggaagctgaggctggaggatcccttgagcccaggaattcgagtccagcttgggcaacataacaaaaccctgtctctaaaaaatagatatatatttcttcatgtaattcttacatagccctgtgaaatacagtcacgtgccgtataacagcattttggtcagtgagggaccacactgttacatgatggtagtcccataagattataatgctgtatttttacttcaccttttctatgttagatacagatgattcttgtgttacagttgcctacagtattcagtacagttacatactgtacaggtttctagcctaggagcaagaggctacaccacttagactatgccatctaagtttgtgtaagtacacgctgtgaggttcacacagcaacaaaattgcctaacgctgcacattaacagccccactttacagattaggaaacgggtgcgagaaggttaataccttgctcaaggtcatgtggttaatattaaagctggcatttgagcctttctgacctgtcctgctatgatccccactgtggctactagtgatggtaattctgaccttttcaggggtatgggcagcggtggtagttatctttaaaatatatctttttcagacttctcactctgtaaaatatgtaattagacatagatatgtgtagagtggcctttctcagaggacccgcagctcttagcagttgcttggctaatcttcataccatctctgtaagataaacggtgttttctggttgggtagttgaggcccagataggctcagggactcacccagcgccttatcacaaacccacacggcccagcccccagttccgttcttcgtcctgtctagcatagatttcaccacttttgttctttcctgtcttacaccaagattgtttaagtacttcccaaaaataatgagccacgtgtgggtgtgttcgttctccagaatgaatcactgtgaaagaggttgtgaactaacgaaataagcataagtatctggaagcagaggctcctgactattcagtccctctaattggtgggctctggagtgagcgcttttctgaaaggcaactgtgggtttgggcttgtgtctcactgtgctcagaatagtcctctcttgaagttgttacttttcccttcttgcttcccaaaatagaaccaatgttgttctctttgctggacatcacaacacaaatattgagaggtatgctttccatagagaaccccttttaaagtgcctgaatgtccccactgccacaaaggggaatgggagttagctttcttaagattccagtgtgagtaaaagagctttggatcaagtattctgtgagtttcagaagtaaatgtaaaagcagaaagaataagagagggagcaaacaaaggtatttggaagggaaaatgaagcgattccttagtcttttttgtgtctaaatgggttagaataaaaattcaggagaaatttacttttaaaaatcccttttatgatttggatcctagtctaataggcacctactttaaatgttctgcctttaagaaataacactacccaaactctgaagcaagaggctgcatgttttggaatttctcccagaagaaagggatctgatgaaacgtgaaaaaatacaacaggccataagtgaagatctgcactgtctacactgtctatccacctgccagggctgcctccttggtttcctcgggtgggactagcaaggaatcggctcatttatagaaagcctaaggaaggaggggttgggcactgagatatttagaatctgtctttggatttgaaaagccaagagatgcctttcagaatattggaggaagagacgaagatagactgtgtacagcctaaattggtgagttatgacagggtggcttttcatgggactgcccataagtgtctcatctccagggtccatagtgtgaatgcattcccacttgttatccagatagtatttacttagtgtgtgatctgggactcagttgggcccccaccacctccacccgccaatgtgtgagtgcttccttcagcacttccgagccccagcctcagtgttctagtgggcaaagcaacactcctgcccatgccaagaggtcagagctaggttagtctcatgggagacagtgttggggagaaccaactgctgctgtctgtgctattcttgttagttgaataaataaaggatttcagattccagggctgctgaagaggctttcagaggcgccaaattcatttgcagtaatttcctgtcaaatgggacacacttatgtatgatagttacccagcaaaactcattaatcccagaggtgattgtgtacactgcctgtttgaaaaaaattcgtgtgtgtgtgtgtgcgcgcgcacactcatgcgtgaatgcatgtgcatgctatccaggggcctttcaggatgggttaaatgtattgtgcacttttaatgcattatctcacttaattctcacaataacttcatgagggaggctctcaagttctctttggaggatatcatttttgcccctcgtgaatgagaggggcacctgacttggacttctaaaggcaggaggacaataatggagtggtcagggaaagcttttcaaaagaagtgacatttgagttgaattttgaaggatatgtaagaagtaggcaggaaaaaagcattgcagcaaaagaatgtgtgagagcatgcatgctgcaggaagccgtgggtgtgcttggttcctgctgggggagatagggctggtgatagctccaggaaccctaggtggctctgcatgaagtggggggcagccccacattctccaaaaggaagatgctttcctcttgtcaggcatctcaatttgaagaaaaggtagttcctctgtctctcacaggcataaagtagagcacttagaggataatagtggagcttcaaaagccttgtttgtgagctaaataaacaggtgaagttgtgctcagttaaggatatctttttggccccatctctataaaaactgttttggaacatcaagtatgctaagggattatattctaagtttggaaaaggacctgcaaaagatctcaccattgatgtcaatgtctgctccccaatttcctgcagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtgagtgcatgcccttgttgggctagtggctcagcttggagatagggtaccccgtcatttcatttttttctactcttgcccactcacttggtttgacgataaagatgccttttggatgttcccgaaggtgacaaaggctggggtttctcagcagttgcttttgtagattagagggtgaggaagcagattttcaagttagtcccagaggtgcccgcagtgtttagagtagtggcttagcagccataggcagcggtgaggagtggaagaaccaggcagggattcccacgggaggatgtgggactgatccagaaagagatggccccagagccgagcaaaggtgactcctcaagggaggatgatggttagatgtgaggagggaccagaataggaaaaggccagtgaccaaagccgagaaacaccacataccatccttttgcaagcctaccattcaggaggcattactgtggagcccacaggaaaaggagagaaactaaagcagagcttagaggagctgtgggaagttaaagggcagaaacaggcatctgtgtaggggcctgaggcggggatagtaccacgaaatgcgtgaggtgacaaagtgggttgtgggtttgactgtggaaagaggtgccttaactaaagaagttgggcatttgagagcatctaggcagacaagactagcccagaagattagagagatcaagggagcctgaacacatcgacagggaaaggggtctttttcactcttcactttgaggggggtgtttttactctttcccttgtttttacttctcattctttccctctcctctctcacttgactcaggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcaggtaccaagttcttcagggcatcatgtctgtggttggctttcatcagtttcccagcaggatagagtgcttgtagagaaggctggaggccctgcatttgtttctaccagcattgagtcatttggtttcctagttccccttcttttggagtctgacgtgtaataagataagataatgggttcacagaaaatctctcattccgtgggattcccaaggtctagtacacaattatccactacagaagtcctgcctctctaagctttgcaactgtacgtacatctattaaaattcagctggtcccacctgagcagtggagtgctcaatttcagggccccttttgagaaacaggagtgtgccagattcctgtgaggtggtgacagctaatcattgatctctgagcaaccacaaggggagtttaaggacatccagtaaagcttagagttgggatttggtgaatcattgacttgtaccagttgcccaagggtttttggtgggggtgaaaataaaggcagtgtgggcctccagcatagcatcagcactatttcctgtactgccttttgttgaccaagtctttctcagatgagggaaatgaaccaaacactggaccttggcataagacgagaatttaagataaaggagctcggggttgtttaggtctcagggtatagctcagctagctattaaatgtgaacatgaatgcaaaagaatttttttacttacttatttatgtatttatttatttagaaacagagtcttgctctgtttcccaggcaggagtgcagtggcgcaatttccgctctctgaaacctccacctgcctggttcaagtgattctcctgcctcagcctcctgagtagctgggattacaggaatgcgccaccacagcgactaatttttgtatttttagtagagacaaggtttcgccacatcagtcaggctggtcttgtgttcttgacctcaagtgatccgcctgcctcgtaaagaatttttttaatgaagataaaccattatttttgtgacaatggtattgcattcctttttttttttttttttttttgttttaagatatggtctcgctctgttgttgcccaggctgcagtgccattgtgcaatcacagctgactgcagccttaacctcctgggctcaagagatcctccaccttagtctcctgagtagctgagatgtcaggcatgtgccaccaagcctggcaatttttttttttttttttttttttgtggaaggtttcactttgttgcccaggctggtctcaaattcttggcttcaagtccattcttaaaaaagaaaaaaaacatccacaaagatcactgttgccattctagctaaaacgcagaggatcttatttgtgagaactttgcgtgtttttatgtatgtttccttgacgtgggacaagactgttgttctgtggggaaattatgccatcagtcatgcccagacattctgcttgacacgggagtactttgagctgtgacatctcctgaatttcagtggctttgcttttattaagctctgcagtagagagcaccaaaatgatggatatatttaaaagctgcatatttttagaaacagcaaaaatctagggcttgttccttgttgaaagaggtagggcagtggttagaacctcctggctgactgtgggaattgatttgctgctagaggagggtagattgggttttccaaagtctttttaagacccagaccagctgaaacaagggaagggccatggtagttgtttagtcgtctgtggtaaaatggttaataactatttccctctgagtggtttagtatattcttcattcagaatatgcagagcttccaaggtgttaggtttctaataatgtggtttttaaagtagtaagtccatgctgctcatatgactttcaattcatttaaataagtatatactgaataccttctgggtgatatggttttaaacagattagaaagagcctgacccggccaggcgcggtggctcacgcctgtaatcccagcactttgggaggctgaggtgggtggatcatgaggtcagaggagatccagaccatcctggctaacatggtgaaaccctgtctctactaaaaatacaaaaaattagccgggcgtggtggcgggcgcctgtagtcccaggtactcaagaggctgaggcaggagaatggtgtgaacctgggaggcggagcttgcagtgagccgagatcacgccactgcactccagcctgggcaacagagcgagactccgtctcaaaaaaaaaaaaaaaaaaaaggctgacccaggattggatcagagagacaggaattgttgggaagagtctcacagaggagggcacatttaaaggagtcttgaggccgggcagatcacatgaggtcaaaagtttgagaccagcctgactaacatggtgaaacctcgtctctactaaatacaaaaaattagccgggtgtagtggcacacgcctataattccagctacttgggaagctgaggcaggagaattgcttgaacccgggaggcagaggttgcagtgagcccagatcatgccattgcactccagcctgggcagcaagagcaaagctccgtctcaaaaaaaaaaaaaaaaaaaaaaggccaggcacggtggctcacacctgtaatcccagcactttgggaggccgaggcgggtagatcacctcaggtcaggagttcgagaccagcctgaccaacatgatgaaacccccatctctactaaaaatacaaaaattatctgggtgtggtggcgggcacctgtaatcccagctactcagaaggctgaggcaggagaatcacatgaacctaggaggtggaggttgcagtgagccgaaatcataccattgcattccagcctgggtgacagagcgagacaccatctcaaaaaaaaaaaaaaaaaaggagtcttgaagaatgagttggaatttttaagagaggcgagagggcaaagaacattccaggccaatgaaaataccttgagtaaaaagacaaaggcatgaaggtccactgtatgtttaaagaacttttatgatgaggagaccagcatgatgtgcttgtgctggggaagcagggggacgtcaggctgccccaggtgtacaggatcttgagggctgacctttatcttctaggtaaggggcttctactgaaagtttccatgtgggaaatgaatgttcattttttcctttggaaggaattctggcagtggtgtggaggatgaattcattcactaccagccttctgttgggaagggtggggtgaggcggggtgtgtgtgggtgcacagggcaagagcaggctgagatgggaggcaaaagacctgttggaagtcttttagagaaggtccaaaagtaggacaggcggacggagatggagaggcgggggctaatttgagaaacattttggtggttctatactgttgtcattaaaagcatagattatagagtcagacagtcctagattttaagccctgctttgccacttactgcttgtatgaatttgaatattacataacctcctctttgagccttagttttcttgtttataaaatggggatgataacagcgccttaccttccaggtggtttggggaagtgagataatttatgtaaagcccttagcatggagcctaatacatagtaagcatgcagtaaatggtagttcccatctaccagacctagggattaataatgtattaattatttgattgggggtgggagtaagacagttaagagtcacttgtgatggtaagggtgattggatatatagagatacattgaatgagtcaaatgaagcaatgttgagttttataaagacagtaaagttaatcttagactaaacatagatggtcctccattctacatctggagttcgcttgtgagcagagcattgctctctttggagatgggaacccatgggccgcacagcactgccctctagtggctaataagcagaacagccagaaggtggcccccagcacatgagcccacactttcatgttctctgccctctttccttcctccaccaaaataaagcagatgtgggtggatcggcccacaggtggctggctgaagagttggtaaatctggtcaaacatttacattcaaatctatcatccgtgcttactgagaggagaaattgcctagataaggagtagctaatcatacacgtttcctgtttgtgttcactctttccccatctctccgcctggctcagccctctggtagattacctagaaatgtgtatgggcagcagcagctctccatggttaatggacagcgtaggatgaagacaccatgttaagggtgtttccgttgtgccaattagtgtgggagttggaaaatttgtcaaatttgcaatgtcaggtttcttcctattctttggttcacagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaaggtaagggctgggcttggatacagcattcccagatagaggatgctagagaaagtgcatagctatggggtgcacagctctgtttgccttcatcattgtaacccgtagaaagaaaacttgagtaaggtcaaggtttccatgctttccttaaagtgtggagccttttattccatgaaaaggttatacaaaaatccaggttatcaagcaaataaacaagcagttcttactcagataaacaagatacaccccctcaccctacctgctcaatttctctttctccactcccccaaacccacctccattgtagttcctgcagggggtcccgtaagcttattttgaaaatcactaggatgggctgggcgcggtggctcacgcatgtaatgccagcactttgggaggccgaggcaggcagatcacttgaggtcaggagtttgtgaccagcctggccaacatggcaaaaccccatctctactaaaaatacaaaaatgagctggccacggtgacacctacctgtaatcccagctattcaggaggctgaggcaggagaattgcttgaacccaggaggcggaggttgcagtgagctggaggttgcagtgagctgaggtcgcgccactgcactccagcctgggcgacagagcgagactccgtctcaaaaaaaaaaaaagaaaaaaaaaatccctaggatgaggaattgcggcctcaaccctggcaaggaggataacgacagaaaagcctgtagtccacgaagtgtcgccttcggactctgctcttggtcagtcctgtccctgaggattctttccttcttcctctcccttttattgctttagtttttgaatctcttatgtgccaggcacctccctatgtttgaggacctcattgactagcaaaggatgacgagtaagggtgattagaggaggtaaacacgagttgttctgttgagcacaaattggggctgactcgcacctgagcccagttgagacaaaggtggcaagaactggtcaggaagaaaaatcttccttgcagggaagagcactgcagacatgtgcaaaggtgaggtttggggcccagcaagtaacttggatggctgtgggtggagagggaggcagaggccagattatgaggggcctttttgagaggattgtattccattctgaagatagtgggtagtaattaaaatttcattcattaattctataacatttattgactgctgtgggccagacctctgctggctgcttggaccatcacacataagagcaagacacagtccctcccctcacagagctcccaggaagaaggggacagacacgtggacaggtagtggcacccggagcacagagaggatgctgtgagtggctggttcacattgtggaagggtctctctagcagttgtgacatgacttgctcctgtggcatggtgcaatttagaagttagtgtctacaaagcctacagaagatgctatttgtttttcattcctgaaacaacagcagactgctcattcctcacattgccatgggaagttgtaatggtctctgctgcccccaagctgaggagccttagactccaatacaagggaggaaggggaagagcaagatttttattcccactgagtaagctattcctttttaaaactatcaccttttgataaaatttaaatcttatatgttttaaaaggatcaaatcatgtcttctctttgaacttgttagcagggtcctcaggactttggggctggttagagtgcgagaagcagtgtgttgggtgggccccttgtttgtgataagagaagccaagatgtgtgtgtttccaggatccatccctttattgattctggcagcttgtgtgagtagggatctggctttcaaaacccaccttaaggccagggaagggaaacaatcagactccctcgttcttgcctttttaacatggggtatatatagtatggtgccctggaatcagcgccagcctggaattttggagatttcaactcaatttccagtcttccaattgacaacggcatggcttaattcgattcctggctttggtgtttctttttctccctcctcctgctctcctccttcctgctgtccctagtgtaaaagagaaaataaagtgtatgcactctaccttccattgctcctctgaaggatgagatgcctttctgggaatacttggaagtggtctattcatgcactgaaaagcattttttggcctggaatccaataatccataaaggagatctttcctactcacagagatatcatagcctggtaagaacaacagactgaaaagaaacattacagatgagacaggtgctgtgtttgggctgtgttcagagggtcgctgggacacaggaggccctccaaggctttcctgtttggtggtggtagatccagctcattgtggttctcccgtgcagatgagcaagtcttggtcaggatcaaagcagtgctgcacacaaagctggtgatagctgttaccttccccaggcatatgcctcctctttcctgagtacctcacatttcaaatttgacataatgttcagaatcctacagttcacctaaaggaaatcaggagcagtcctaagaaagaaatggtgttcccctgtccttactgaggtcccaaactggtagaccactataaatgaaaggatgctagatggggcttcagggggcatggaggtgggaaatgtgaattcaggagtctaacctgattttgtgttgtatacactcatccttaccaaccttcactgttttgctgatagttacactttttctgggactcatctgtggttctctgcagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaaggtgagtggactagcgcaggagcggcgaagtggtgtaggcatgaaaggtccgcagtgtcctgatttagttcctagaattcctttttactgaggaagttggggctggacctcaggaactctagtttaatttaaaggaaaggaggtttgagcttcacttaagtgaggtatctacagggtgttcccttcacctctgtcttgatagaactccctcaggaaccctataatatcaatattcagctacttgtcaatcagtggcttgacatagtcatttgttacgaaggagtaatcatcttagaatcccacaatagacatgagaaaaaatggaactaaaaagataaaccagtgtactgggaacatcagtttagtgatttccatgttcattgatggggacagctggcttaaaggccacttggtggattagattctgggccttactaatctgggaaggttttcctggaggaagaagacctgaagctctgctacttgttgattatcatgtcggctctttgggagatcctggatcttgtcacaatggcaggtgtgatccctgatgcctggttgaccagggccacaatggaaaatcacccgtgaaagttggatcctattcctatagcctgtgcggtgccagttctcatcatcgggcctgtttccttctgagaactaggcattgcagcaacttcccttcagtccctcagcacttctgtacctgagcatatttgctcagggaaggcgagtagtagtagtaaatattaatacaaatattagctaaatacacatgtccttctatggtcgtaacttagctacatgaatgcatttaatcctcacaacagtcccatgaaataagtagtcattctgattttatggatgagaagactgaggtacagagggctaaagtcacttttccagggtcactggattagcaggaggcaaagccaggactcaaacctatacagtctggctgcatagtctatgcttttaacatttatatcatctctttgtaaagatccctgtttttttctctgccagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacggtaggagggcctgggactctgcccttgctaagcagcttctactgagtatcccatctgtgccgtttcccatatgcgcaggagaaggaggtgttgaaaaaggaggcgaggaccttgctctcagcccactgaaagttgaattgaacatgcactccccacaatggaaagttgcatcactgcatctaacagatacaagtgctgagagcacagctccataaactgtatgcacattggtgttggtggtattaaggtcggagggtagagaaggacaatctagagcaggatttagaaggatagcaggcaacaggtgtggctcgggaaagagggaaaacactgtcatctcctgtgcagagagctgtgaaggaggcagggagcatgtgcttagggactggagaccagatttgccaaactatagcaaaggtaacccaggatagagatttggggcacccttcaagattatgggcctgcttcccacttcatgcagaagtgaggtaagaagtaaggagctgtgattgcaaattgacttcatgagttggaaatgggactgccttttaatagagtggaagaggtggaaatctgctgaatctaaatgaatttaattaagattatcccctgatttattgtgggggctggggtggctggaatcatagtaattactcataattactactcagagtcattaagggtgccgctgaccacctctagaattaattttgacatatctatagtcaggtaagataacaaaagcagttcggaatgaaacttaagctcaacccatcactgtgactacattcaataaagtgaaggaccctggtgtcaaccaaatattaggtactgttactgcccctgtgacccacattacaagtacttctgccaagaagtcaaaacatgcttcaaataaacaaatctttactctctctttgtttttttgatatggagtttcgctcttgttgcccaagctggagtgcaatggcacagtcatggctcactgcagcctccgcctcccgggttcaagtgattctcctgcctcagcctcccgagtagctgggattacaggcgcctgccaccatgcctggctaattttttgtatttgtaatagagatggggtttcgcgatgttggccaggctggtctccaactcctgccctcaggtgatccgcccaccttggcctcccaaagtgctgggattacaggcgtgagccaccgcacctggccaaataaacaaatcttgatggttaaaaatagagatacacatcagagtagcctggtattgccaaatctgtgctgaagtatttagaatcaaatttaaaacatgggagtttgcaatgaagagatgtgtacacttcttctgccccaagggactttatcagggtgatactcttccacattcagagggctcctgaatcaatactttgatttaaagagagcagtcatcattttctgtgcgtgaccatgtttgttttgctattgcagatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgttaaaataatagtgctaatttctaaatttataaaagtgcatagatttttcttaaaagtgagttttttctcccatagttaaaaatcgttggcatttgcagctgcttattcatgacagaatccagtaagaaatagtatcagatttagcagaaacactttttattgtcaacttagtatatcagtattttatgataatttccatatattctgccacatgatcaagttccaggacctctagagccctactctcagccatttatctgtgatataagagattccagggcagtgaaagtgattgaaaaaaagaactggtggtgctcacttcgccagcacatatactaaaattggaacaatacagagaaggttagcatggcccctgcacaaggatgacatgcaaattcctgaagcgttccatattttttaaagacctagtatttgatagcaccacagggtgactatagtcaataatataattgtacattttaaaataactgaaagaatataattagattgtttgtaacacagtgtaaatgcttgaagggatggatatcccattttccctgatgtgattattatgcattgcatgcctgtatcaaaacatctcatgtaccccataagtatatacatctactgtgttcccacaaaaattaaaaattaaaaaaatctaatctacaaaaaatatgacaagtcttccagcagaactgttttgtatattaatacccttttccagcttccatttatgacatgtttggtaaaatccaaattatggaaatagtgcccaggtagtattcatggaattgtacctcttaaattttgatcagtatatgcagtaaaacagactaagaggccaggcgcagtggctcacgcttgtaatccccagcactttgggaggccaaggcaggcggatcacgaggtcaagagatcgagaccatcctggccaacatggtgaaaccctgtctctactaaaaatacaaaaattagcagggcatggtggtgcacgcctgtagtcccagctacttgggaggctgaggcaggagaacgcttgaaccctggaggcggagtttgcagtgagccaagatcgagccactgcattgcagccttgcgacagagcgagactccatctcaaagaaaaaacaaacaaactaagaaaaatctggtcacacaggtcttaaactgtgaataagtttatttcttcttatgacatccagaaattgaggctaaatatataataatgctaacatttattcaccacttgctatgtataagctcatttaatctttactactacaagtaaataataagtaggtgctattatcatcgccattttacaaatgaagaaaatgagtcacagagaagttaggaaatttgtctaaggtcacataactattttagtaaacaagggttcagactcggacaggctgaggccagggcttaagcctgtaactaccccttagataattaccaagtccaattctctatttaaaaatatttcccaggctgggcactgtgtcacacctgtaatcccagcactttgagaggccagggtgggctgattacctgaggccaggagtttgagaccagcttgggctacatggtgaaactctatctttacaaaaataaaaaaattagccagacataaaggccaggcatggtggctcacgcctgtaatcccagcactttgggaggccaaggtgggcggatcacctgggagttcgagaccagcctggccaatgtgaagccctatctctattaaaaatacaaaaattagccgggtgtagtggcgggcgcctgtaatctcagctactcaggaggttgaggtaggagagactccatctctacttaaaagaaaaaaaattgtctcattagctcaagacagcagggtttttttgttttgttttgtttttctttttctggaaaagggcttgagaaaaattaattggctttttatttttatttttttgagagagggtttctctttgtcacccaggctgtattgccatggcacaatcttagctcactgcaacctccgcctcctgggttcaagccagtctcctgcctcagcctcccgagtagctgggattacaggtgcccaccaccactcccggctgatttttctgtttttagtagtgatggggcttcattgtgttggccaggctggtctcgaactcctgacctcaggtggtccacctgccttagcctcccaaagtgctaggattataagcgtgagccactgtgcctggcctaaattggctttttaaaactatctttttattatggaaaatctttctaagtttgtagttcttaaagatgaggacttaaaaaaatgcagtgctattaccacactttaaaaaatgaacattaggccgggcgcggtggctcatgcctgtaatctcagcacttttggaggccgaggtgggctgatcacaaggtcaggagtttgcaaccagtctggccaacatagtgaaaccccgtctgtactaaaaatacaaaaaaattgccaggtatggtagcgtatgcctgtagtcccagctacttgggaggctgaggaaggagaatcacgtgaaccaaggaagtggaagttgcagcaagccgagatcgtgccactgcactccagcctgggcaacagtggagactccgtctcaaaaaaggaaaaaaaaatgaacattaggggtcaggtgcggtggctcgcacctgtaatcccagcactttgggaggctgaggcgggcagatcacccgaggtcaggagttcaagaccagcttggccaacatggtgaaaccccgaatctactaaaaatacaaaaattagccgggcatggtggcaggcacctgtaatcccagctactcggaggctgaggcagaagaatcgcttgtacccggcaggtggaagttgcattaagctgagattgcgccattgcactccagcctgggtggcaagagtgaaactcacacacacacacacaaatttagtgctttttttttttttttttttttttgagacagagtctcactgtcacccaggctggagtgcagtggcgtgatcacagctcactgtagcctccacctctccaggctcaggggaacctttcactccagcctcctgagtagcttgggactacaggtgcaccaccatgccctactaatttttgtattttttgtggagacaagggttttgccatgttgcccaggctggtcttgaactcctgtgttcaagcaatccttccacctcggcctcccaaagtgctagaattagaggtgtgagccattgtgcctggcaaacattaatgtcacttaacatctagtcagtgttgagatttccccagtctcctaaatttttaaagcagtttgttcaaatcggggttccaataagttttatcccctgcagttgatgaatacacctcctacatttcttgtctacatgttccccctcattttttcttcccactctgttttttcggagaatccaggtcatttgtcctgtagaatttcccaggctagattttgcagattgcttaggtagagttcacatattctactcttcctggtatttcctatgaattggtagttagatctggcagctagaatcatttctgggggttcggggacacgtatccttcacaggggttcctctgtccttctgtgacaagttgcgtagcattggttctctatttttgtgtcgttaacgtgctgtggtgatattgtccaaaactaagcgaatgattacttcccctacatatgtatttggttcccatgatatatagttggaataggagaggcagaaaaaatacttgattctttccacttatttaccatttttcaaaataatgaggtggttctgtagcctcccacagaggtaggtgactgaaatttccttttttagactttaaaaatatttgtttccattgaagttatttgtcttattgttacttaaaagttcccatctttgctcagttgggagcttatcaagttggtgccttttgatgtgacccccagtagtctttgatagattccttgctttggctatgaaaaaaaatgttcctggctactcttttgtatttctttttgtttagttgttttgtttgagacagagtcttgcactcttgtccaggctggagtgcagtggcatgatctctgctcactgcaacctctgcctccagggttcaagctattctcctgcctcagcctccctagtagctgggactacaggtgtttgccaccatgcctggttaatttttgtatttttagtagagatggggttttaccgtgttggcggggctggtttcaaactactgatctcaggtgatccgcttgccttggcctcccaaagtgctgggattacaggcatgagccaccatgcccggccccttttgtgtatttcttgttccatacttagaattaactaactttctaaggaaccttagggggtagtggtatttacagagcacagtgtaggttttgtcaccggcttctgagtaatcttttcctgctgttgataactcaggtagatactttcttttctcccaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgcggctttcccatcagcctgatttctccaccttagaaaagggtttcttgacaatggggtcaggccccagaggagccccctgagagtgtcagttattatttactattacgtgctattttacatatcccaagccctttagggctacagtctcttgtcctggaccctgtagggtgccatttggagttcacagcctagaagaagaaaaggctttgggcctggtgtggtggcataggcctgtaatcgtagcgctttgagaggctgaggcaggaagatagcttgagctcagaagttcgagacaaacctgggcaatgtggggagaccccatctctacaagaaataaaaaattaggcttggtggcacaccacctgtagtcccaggtacttgggaggctgaggtgggaggattgcttgagcctaggaggtcaaggctgcagtgagccatgattgggccactgcgtttcagcctgggcaacagagcaagaccctgtctcataaaagaaaaaggacaaggctttgtctccaagacacagatgagggaggtggtcaacaagtgacaactgaacccagagctgttagacaccaaactaggaaagcagctctggagcccgagctgagctgagctccatggaagagtgaggaggaggtgtccataagagaagccctgagaccagacagaggaggaggacatgcctgtgaggaaagtggtctttccagaaactcagaagggaggaggtgatgtgtatgacagggctgggattgggatggagaatgtgaatttgggagagacggcagatgaaatcaggggtgtgggggaaacaacatttggtggaaagagttgacatgaggacatgtttgtgacatacgtactaataaacatggaattctagggtcttaagagtgttcaggggaacaggcttcgcctagctaagtgctcatgggcctccttttcacttgcggttctgcatttccttttacttatttttttcccaactctatcgaggtgtgattgacaaatgaaattgtaacaaaggtgtacaaagtgctgaattgatacatgtatgtattgtgacatgattaccacacaagttagtgaacacatctgtcacctcaccttgttgcttgtgtgtgtagtgagagcagttgagacctactgttagcacatttcaggtgtacagtattgttgactctagtcaccttgccgtccattagagccccagaacttacctagtcaagtagagaggttggctctgcctttaacgagtctaaccactagagggcatttctgcatttcagaacagaattgcatattagctgatgctttcgtgttgcatcatagagcagcacttctcaccgcactccttggaaccctcagggcagggtttgcttcagagggcaggtgagaccaaaagagctggccgttagctgcagcgtttgcctttcacttgtgtaagctgtcccttaaaaaggaagagccgcctggcgcggtggctcatgcctgtaatcccagcactttgggaggccgaggtgggcagatcacaaggtcgagagagcgagaccatcctggccaaccaatatggtaaaaccccatctctactaaaaatacaaaaatcagctgggcgtagtggtgtgtgcctgtagtcccagctactggggaggctgagacaggagaatcacttgaacccgggaggcggaggttgcggtgagccaagattgcgccactgcactccagcctgggtgacagagtgagactccttctaaaaaaaaaaaaaaaaaaaaaaaaaaaaaaaaggaagagccagggaacaaagggagccttgcagagcatttccctaaggtcggccgccgggtggatgtggatctgccagactgcactgagcgggaggtggcagggaaatgagtgagagcctagggaccagaaaggcttctccagggcatgaccgagctgatggctcctgggtctctgcacaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccatgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacat

SEQ ID NO: 16132 - DNA, 47181 bp, Human; identical to SEQ ID NO: 16131

SEQ ID NO: 16133 - DNA, 47181 bp, Human; identical to SEQ ID NO: 16131

SEQ ID NO: 16134 - DNA, 12061 bp, Human
actgggcgcaggcagttggtctgtgggaccagtgaggcatgggctgtggctggcagtaggaaagcgggagaggctgagtgcagtggctcatgcctataatcccagcactttgggaagccaaggcaagaggcttgagcctgggaggtccaggctgcagtaagccataatcatgccactgcattctaggctgggcaacagaacaagaccttgtctcaaaaacaacaaaacaaaacaaaaacggggagaggaaaggacccaagagatgttccaaaaaagaatttcaggaaacagtgaaaagttgcaaatggggcatcaggagccaggagcagagattaggtggcaggcagggggtgcagaaatgacaagttctgtctggaacagatgaaatttgaggtgcttgtgggacctttgagtgggcagaagcgggggctggagacaagggtgtgggaaaactgtgatgggggttgagggtggaaatcgggccggcagagcctccggggcagagaaagtcctatggggtgaccagatgagttgagaactgggtgggtgggtgcaggctcaatggaagcagaaactcatggatattgacttacatgggagaaggggaatggatgggggtcgcagtggggtggcagggctctcttttccttgtttttgtttttttgcccttccctcttctcttacttttccgtgagggctccccaggctcaggagagatcagggtggaagggtgacggccaaaccagggaaggctccaggtggctgaagcctggtctgtgcccagcagggccctggcgggctgttcctcactccaccgggcaggtgataactggtcagagctgcctccccacaggtgctggaggtaggctgggagggccggtgctccctgatgtggacagggggaggggtattgataagaggcgtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcggtaatttcccaactagggtgcactccccctgtaaggggctggggaggggacggtgcgaaaccaagttcagcttgtggagcggagccagagctgttggccgagcttgggcctggccaacgcctgccctcgggaaggtcctgtgtagggagactgcctggagggactaagcgagggctctaactgacgtctcaggggcagcctctcagcctgagaccctgctggggaagccgcgtcctgtgcactagctgcgcctagggctgaggtgagggcgcaggctccccagggtgtgtccgaattgcccgcctcagcccgcggcctgtcctgaccgcccagcagcggcagcagcgacaccctagggctccaggaagggcttgggaaggtgtaaaggcggggctaggctcggagggagccggagggaccgggcgcggttggctcccgggagcaactggagagtgaggagatcctcatccggggaagccccgcggccgcgtctctacagcgccccttctcgggctctggccctcccgctggttattctggacctgggggcccccagctgggacccgagtccggtgcggggagcctagtgggcctgggagctgctatttttagcgggcgcggcgggcgcgaggagcctatttatagatcaaacaatccgcgctccctgcgtcaatggaaccccgcgtgcgtcacgcgcgcagacattccaggccccccctcctcgccccgccccctcgggctccccgggccgcacctccccctggccgcctcccgccggaaccgcaccgccccccgcgcccttgtatggccaaagctcgacgggcggcctgcgtcagtggcgcccccgcccctccccgtgcgtcacggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtaggttcccttcggggaacgtgcatctgtttttaggagcggtgcatgaaggagatgggtgtacgcgcgggcagagaggatgttgtagggccggcatgcaagagggtaggtgtagtgtgcagctgtagcacaacgggatgagaacccaggtcagactggaaactactgggtgcggggtaggaggtaggggaggttgactacctgcaaagtggaagctgtagggggttggggttggcgccgggagtagggacttgtccagcaggcggctggccttagttcagtctcctagggtgcccaactgggcgcacggtgctctgaacttgggtgggtgtggatgggggtcacagcaccgtgggggaacaggtacacagagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatgtaggtccatatcttgtgttgttaagaacctgcatgaagggggagggactgatgggggttgatccggatgtgggacgtccaggtggagaaacaggatttgaataaggcaggaacaagcgcccagttctgcccaactgctgtctttcctccttcacccccagcccatccctggccaggctgtcctagtgcaggcagatgtggccaccctcacctctcgcagggtgctgcatgcctgtggactggtgccactgggtgtgtggggcctgagctacaagggtctctgttgtcttggttgtcaggctaggggtggaggtgccctgttcagggcctgtggagttagaaggaaggctaggaccagagaggacttcctgggctcttggccaggaggtggtgacagcctttgcccccatcactgcaccccttgattatggtactctgttcctgcttgatttcttctccagcttccctcattgactggtgaggccagagttacgcagaccccaggtgtgtaggttgggagggagactgtcctggagcctcctctgcattattttttgaccattctgtgaatgtaaggatctgcctgaatgatgctatctctgttcaggctctcttcaggctcctcgggactggggctgtgtaaccccctttgcctgagcctctggattcttcagggcacagaccctgctttagtggagggacccaggcaggggcagaatgtcttccacccacccaccagcaggcttctccttaagtcttctgctggactctcagagttctcttattaagataactgggggcagcagaacattctttttaggtactgttgtccattctcctgagagtccagggggctgtggtctccttcctccccccttgccctgtccccagcaaatggcctttaaaggtctggagccaggttaccgatgaggaggcctaggttcccttcctctttgcttctgggagcatctcgagcagtgcagagtggcttcccagccccagatggcaggattggggtgggtttgggatctgctgcctttgctcagtgtgcagggttggggtggaaatgggggacaggctagggcctctgcattaggctgccttcttaggcaggtgggctttcacttccagctcctcttccattttcacgatgtccttcttcctaggcactgcgaggggaggagaaaaggggctttgcagaggcctgggagtattcccaggaagtgcctggttggcgaaacaaccagggagctgctcctgggagctgggctgaggctttgctgggctgcctctcccactcacccttctcccggcccccaccatgccttccccatgggggaggggcagggggctggaggaacacagcttccccctgttctagcagagaaatgctggctgtatgcctcccctagggttcccaggctgactagggtgtggctggccttctgatggagcccactcatgctgggccgctgcccaggggctttgtggcacctaggtcgagatggtactcaggccaggggtcaggattcctgggtgctctggtcccggtgcctctgtctcatctttaggctgggattcctgccaccttgctgctctggggcccaaatactttgagacaaggctataggcttgtcccactgactctcctttccctccctggggtctcctctctctccagagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcacgtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaaggtgaggtcccaccccgtgtctgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtgagagccactgactgtctgcccagcccctttccctgatacacctgcctgtgaaccaccctgatcgctcttcgtgcccatctgcctgccaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccggtgagtgaccagcaccacaccaggtccaagggaatgggcgtcagggggttgactggttctcaggagggcactgtcccagggagtttggtgggccgggatctagcactttctgggcccctgcactgccccgggctcatgccagcagtaaagtagggaccataggaattgcagatgggctcagctgcatccagctctaaagcgcaagacagcctttggtcccagactgtcaggatccagactgcaggtgtcatgtatgtggcctagggtattggcttgtttttaaaaccttcctgtcaattatgctgcatatagaaaagtacacaaatggtaaattttcataaaccgcacttacccaaccagcgccttggtcaagaaagagcacataactgccccccagaacccattattgtgcccccttccagtcatttgccctccccaagggtaaccactactttttatttaaatattttaaaaataagatgggaatctcactatgttgcccgagctggtctcgaactcctgggctcaaatgatcctcctgtctcagcctcctaaagtgctgggattacaggtgtgagccaccacgcctagcccttcactgtgacttctgacagtgcagatcagattggttgtgcctgttttggactttatgtaaatgtagttctgcaggatggaatctggtgttgaatgcagaggttttcagatttctctgttttttaaaggaaagaatccaccctcgttcattttttcacttaaattgcacaggggacccaacgatatagaacacaatcagaggtactctgggctgagggagtgctgagttctgaggctgggtttctcagaacagtctagattttaaaaacccaatgatctagccagaaaacgtaggttaggattttatttcccgtttgtgaccctgggcaagtcattagcctcctgggcctcgggttctcacttggagtatgaggataatgagggttactgcttctcagacttgtgacgatgcttactaatggccaacatgtgaatgcgcttttgtgaagtgccagcagagcatgaggggtggtcaggggcagcagttttaggggcctgggggaggctggggctttgggggcctggttctcagatgtacagctaatcctgtacccttcccgcagaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactgagattcagtctgtctctgatgccccctccccactcccccaccagacacaccccatcattacataagagatgggctgctcaagatgaaacttggatgttaccagcctgagctgtcaggcctcagtgtactcatttgtaaaaggcggataataatgacacctgcttcacgaggttgttatgcaaagcacttagactaatttctaacacgtgggaagcctgcattagctgtgcctggctagctgtgcctggctcattgctggggtctgcagtggctgactagcccaggggtcactgcagggccctagcaatagacttagccgcagatctcagggttgtcatgtttcctaaactggacatatattctctgattcttgatttccacatccataaaacaagaatagacccagcctcacagagcttttacggtcagaggagtgtgtgtgtaatgcttagcatgggctgggtttaagtaagcccaaattggtagtagctgttacattcagggttttaacatccccattctcaacattcctccccactctcctgccaccccagcaagaagatccagggatctggcggccctcaccttctcggcaagaagattgtactgaagtccctacctgtgcccgtgtccccacgtaggccctccaaccccctaggctcgtcagttgtttagtcagctggcttaaaatgcagattcctgggatctacccccagagactcagatctggggaggtgagggggccccaaaccttcagttctagcaagtacccaggtgcttgtgatgcaggtggcctggggccacccttctgagaaacatgtggatggacctaacctgaggcccatgggagttggtcatcatgcagggtctggcaccttcctgtgctcggtgctcacccagcctcactgtttgcttctctaggacccagcaggaggcctgaaggcagtgccctcacacgtgttcctcacagcccttggcccaggaccccccaagtctccacctccatggctcctgggaagtggctggctgaggggcagctcctactggatggggcccgacagaatagggctctcagctgtggatggggggaagcaggggccttccctggtgctccagccacagcttgcagggagcccccatccacataccctcactcaggttctgggagcacagtccagcctcaggcctgctgaaggtccgagtgaggctggggtagggagaccacggtcccgaccctgggacatgctcccagcagtgctgtggacttccaaacatgtatccctggcatcgcccacccagccccagacccctgagcgaggctttgtcagctgcacccgcgcctgacgacatggggccatcagtaggtgggcttctgtttgcctccaactccatgctgctctctgagaagtccctcctcctcaccgagcctcagtttcccatctgttcagtggggaggtgaggctggttaggagcagagcttgctgggaaatctcccgccagctggctggaccgagtccttttcctttgtgtcactcacctccagctccctgcctttagcacagacagacgtgaggacaggacaggcactggggaaggcaagagggctgctcagatgctcagggaggggccagggctgggagtggagtggggccgagggagcatctctatatctatggatgaggctggcgggtattagggttcacgctggcagattcttttcatcagacgcttgtgatttccagccctagctgccatcccatgaagacagcctggctattcccacctcacaggggcaccatgggagagtggtgaaagcaaggaccctggagcccgaggcctgggtttacatctgggctccagctcttactagctgtgtgatttggggcaagtttgttaatctttctgtgcctcagtgtcttcacctagaaataagaaaacgaatctattttatgaagttactataaagattataggagtgaatacatacaaagtgtttt

SEQ ID NO: 16135 - DNA, 17657 bp, Human
cctgggtcctctcttccagctcccaaaatgtactctatttttatctgtttcacgaacgctggtccagatagtcttccatcccccactgactgttagaagtgactctcagcttttgtccatctcgaagtttctgtgctcagtgtgcctctcagactaaaggcttcctttgggaagccccgactctcgcttctcaggacagagatccaggggttgggggaggaaaaggttgaccagaagccatagcggagcagggagagagagtgtgaaagacagacccgcggccaggctcccagttctccagctcgtagagggcccaagtggccgctataatctgaaagagcagatatcgtaatcccatagtacttcctattggctgcaggacacagttctgtcctgacactgaaatttgggtgtgtcagggttctgggaattcacaacgctcacaacttgtgaagcagctgtggggtgggggatggggagggtttcagcagaggaagtgaggtcagtcaataattgatgcctgtctgagcttttagccattatctcccccagcctctattcctgtcaaaaggtggggcggggcaggaggaggggtccctggctcatcttgtagaatccccatattagagtaagacaccttagaggtctactcctgcttctaatacccacgtctttccaagtgtctctgaggccaccccctccccagccttttcatttattcatttaattaacgaacgccttcattgagggcctcctctgagtcaggctcagccagccagcatctttgctatgagctgagataagcatcatttccgtctattctcacaaccaccctatgaggctggcacggtttactatgcctatttagcagatgggggactgaagcatggagaggtgtcactagcctacggtaacacaaccagcctgcattcctagtaggtagtttgacttcagagtctctgtggataaccaggaggctaggactaagaccagagtcctgcaggtacttagatggttggagcaaagcagggcagtgaggtcagtgctcccagcctgtgcaggagcatcaggaagagtctgtgtccccctcccctgccggtatgaagccattctgcttccctccccagctgccttgtgtcagcagagttccagggaggctccattccccacctctatctaaagctccatttgctggggtgggggccctgcctggaaggggaaggtccaaggctgctcccagcgtgtccctccatcctgactgtccctggcggggcgggggtgtctttgtcacccagctgcacaacggccaggaagggctcaaaccatcctcagggctaacccaaggccgtcctctgggcctgtatacccctgtgctgagtgcggatcgggagaggctgctgaagacaggaggggacaaatgggggacgaaggggcccgagggaggggactgaaggatttgggccaagtcgggagttcccgagggcggagtcaaaacgcatctggattttgctagccccaaactctgccctcattgctgcaagcctcctagaccgaggacccccgggctgagggtggggtaaggataggtagtgtccctccccgtcccacccccgcctgtcccttcctcggtggccccttcccggcgccccgattccaggcggcccctccgctgctgccagccgatccccctctacccccacccactactccggccgccagacgttgcctacagtctcggctctgtctcccacggctgtgggtccggaccccacgggacccctatgggacccccacaggacccccacggcctgagtccaaggcccgccccctcggggaggcggatgtgggaggcccggcccgggtgcgggccagcgacccgggagctgcgggcggctgggaggggaggccgccctgaggggctgggagcggcgcgggggtgggtcccggtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagaggtgagtcgaggtccgcggacgggaccgggtggcgggcggcctgacccccgcttcagtgggcccttccttcgggcggaccccagagtcaccgcagagtggtcgcgggaggctcagtcccagctcattagaaaggcaagctgctcctggctgaccacgcacagctcccatgaccctacctgagacttggaggggaatggacgagactggactggaaatcagaaacttggttctagtcgggtgacctggggtcagtgacttcacttctctgttctcctaccctcttcataaaatgggcagtgggattcctgtcttgctctactcacatagaagggatcacacgtcctccaggccgctgggtggacctggagtgaatgcctacttccacagctgttgagcctcccagcagagctcacctttcccagatcagtccttccagctgttgcttgaggaatctgacactatcactccaacctaggagtctcaccctaggcgcgcatggtcagtcacctccttgccacgaccttccttcaggatccaggccaaaggggatcccagtctccccccaggctgggaccccagatttttccatggaggccagtgctgtgaaacccatggctgggctggctgccccagctcctctttccttctccaaggacaggggcataatggacagttgctctcactctctctatgtatggccagcttctggctgagtcagggtctgtcctaatacctgtcctctcacctgtccccccatttcattggtttgttagaaatagctaccattgattgagtactaactatgtagacacttagatatatatattttttctcatgtaatcctggccgcaacctagtggaagaggggttactatccccttcctacagaaaaggaaacagacatgaatatgggacttgtccaaaactccttggatggtggggtgaatggcatggttggggtcttgataacatttcagtgcttactgtgtactacttatactctgctaaataattgtactacattttacctatgagataacactattattattcccactttacatatgatgggaagcctaagcctcagaaagtttaagtaacgtctcaaatttcatacctctaagtggcaaaggcaggatttgaacccaggtctccatgctccagagcccacaccctaacctctgtgctacactgtgctgcctccatggtctgcctgagacctgaaaatccaggcatcacctggatgttccactgcatcaccccgctgtgaagggctaataaatcacatggatgaatcgtaagggcaacccaatatgaacagctgggtctgctcctctgctgttggggtaaggcctactgaagtgcagagtgagtccagaaggttgtgcttgatatggcgcttctccagccctgtgaagatcactgctgtgctgagccactgccgttgatgggagtaggttttatcaatccttcaggtgtgctagggagaaaaacattgataagcacctttcgggcataccactactctggctctccccacctgaggctcagactttgactaagcctatggcaaacagatgatttctgggcagcaacaccacctttgttgcctgggtcaacatagtgagaccctatctctactaaaaataaaactgggcatggtgctgcacccctgtagtcccttgggacttgggaggctgaggtgggaggatcacttgagcccaggagttcaaggctacagtgagctatgattgcaccactgcactccagcctgggcgactgagcaagaccctgtctcaaaaaaaattaaaaacaaacaaaaacgctgtcttcatttaaacaaatctgagtagggcacccgttaataacaacagtagtgggcaatttgtacacgtccaccgagacccatgtctttttcttcctttgagggactcatctaaccccaaacaactggaggaataacaatgaccaaggaatgatttattatcagcaatttaagtttattaagacacgctcagtgactatggacaagaaactgaacatctctgagcctcactttcccccgttggactgttgtgatgattaaatcagataaaccattcaagttcagtacttagcacataattagtactcagagaaggttaactgttattattaagtatttcatagtgtttagctaacgtttgaaattagtttaacgtctgtaatttctggccaacaatagtgatgcttctgtcagcaggagatctttcacaaagttttgcttagaagtgaaaggatcctgccaggccccaggagtctgtctgtgctacagtcagatttcagggtaaatcgtacagagtcagctctgagtttggactggtcgggactcagcatcctcctgtacttgatctcacactgggtccagttaaaaattggacagtcccaattttactccatcacattcccaggattagaccatagatgggttctgcagatgcagacagcctcgctccacagtgtcaccacgtcccagctttggtgtttacccttggctgtcccttctgtagtagatggggagtatcctgggtgggagtgagtgtcccctccctctgcatcccactcccactcacccagcagggccctgtacagcaaaatgaaagcagaggaaccagacttagcgttgtgcccacacaaactgatcagaactccctggggaacttttaaaaaatgcatgtttcttgctgattccaggactgaatcagagtctggagtgagggtgaaaccagtgaatatgcttttctcagtgagcacttcaggtgattctgatgcgtgataaagtagaaggagggtggactggggcacggccagagaagtagaggtacggacagaggatcctagaggaatgccggattttagccttattgttagccactttttcctttccacctcaaaccctctcctttgcagctttctgggctagcaaaggctgccaaggatggcttcctgctagtaccccagtgggcagattcagctcctctagggtgctctctccatcccatcccaccgtcagtcctgccgcacagtgctagccagagtcctcactggctgcgggaggggcaagaggcaggaggtcaggcagaggctggggacacagctgcagcagcccagggctctgtttcctcccccagcctgggcctctggggcagaggaagcccaggcaggaaggccaggcctgccaccagccagagaggcctatgaagcccccctaccccacccctagccatactgccctcagagcctcagcatcttgggtcttcatttggcaccattcttagactatgggctttctgaagcctctgtggccatgtgcccagccctgtcaggctcaccatgtcatgccaaaggacagtctccctgccttgtgccctgcctgaggatccagtccccagacacacacctgcacatgctccaccattcagaaagtcctgttgctgtctgaccagggtccttcttgctgcagctttagccaatatcttctggttctaaacctgtgagaaatgaagactgggtggcttcagaagcactagttggtgtgggacctggattggggactatcatagaccagaattactccccctaacactctccaacaaacttctggaaaagttcaaccctagtcagccatggaaggtcaaacattcagtgtctaagtgtgtttcacttcccctgccacatcactggccctccacccaccctttcctagatggcaaggggaaagaagggggccagggaacagctccgagagggcagcttatactctggtgagcttgcagagaggtttctctacacctggcatgaccctgccccgtccgagctttgcatggttgttatagccctgagggctcagacatgggctgccaccactggatagggacagagcgaagagagcacttgattaggagtctggaaacctgggatgtacgcctgctggtgccagtgagtcctgtctgacccgggacaagtcttcttccctgtatgagccttactcctctcttctgtaaaacaaggagctggattttgtgattcacaggatgtccacctagaattctgtcatgtgggtgtcccaggcacaaggaactaagggtagcaaggaactaagggcatatttaaaaagcccctccagaccttgtggctgctgcagcccaccctgaaaatatgccctcagttccctgctgtgcgtgactcctgcctgttctatccagaccccaatctaaacaatcttgattcctgttcctggcttggcaggaccctgaatggcaggaagtgaggacaggagcctgtttatgtttgaggcagccagggctgggggggcattgagaaagggtaggcaggggtggaagctgtgagggagtgggaaagagacacagaacagaaggggagctgctggagagatgctccttctaccccaattgggtgctccctgcggctctcccaacctgcctgcagtctgagctcagcagcaggagtgcagagctagggtttccccaagctctcagtcacttaaacattgctctccacccttcacctctaacaggatggtttccatggggaagtgaaccaggacttcccctgcaggccccgccccaaagccaggcggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggtgagtactgggggagcagttaggaaacaggaacctggatacagaaagggctatctgggcccagatcagctctgcctggggctgaacttgagaagctggggagaatgtaggagcttgactggagagtggaggacagtgaggctccattagactcagtccccagctaccccagccctcctttgctctcctcttgatccagacctgcaggctggagctctgtcagactagggtggaagcctatatgtggggtggagggagagcaggtgttggcaggccaagcctgggagagcactcagggctggggctgggggcccagcccagcctagaactgggaggggaggacctaggagccaggaggggacaaaagcctgcttttcagagtgtcagctgctctgaggggagggttctgagggaaggatgactgaggatgaaagtaagagaccaaagcttcaaggtgtttgtctgaggggtcagacgagagggacagtaggacagaaatgggtgtcgggctcagcctgggggagctgggaccacagtggctgagcttccggtgtgtcttccaggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggagggtacgtccagctgccctagcactccctccccatcttcttggcccctgccctcccttccctcctttcctctcatgctctggccaataaaggggctgggggcgggggagcgggtgggcaggactctgggatctaactggcagagtggtctggcccgaggtggggggagctgacctagtggaagctgagcctcagtgtccccctccctcagccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggtatgggcctggggacctgggacacagggtgtaggaggggcagataggaactgcagaatcagaggggtcacccagagattagagccggtggggagctgggcgagtgaggagcttgcagtgacccagcaggtcccaggtcgaggatagagaagggggctgtggctggttgtggcagcctctcagtggcctctccgtacccccaggacctcctggacagtgactgcaccacagggagtggctcagggctccccttcctggtgcagaggacagtggcacggcaggttgccttggtggagtgtgtgggtgagcagtgggtgagcccggtggatgaggaccaagggctctcatgagcctggaggggtgagggagtttttggctactggaatcacaggcggtgccaggcctgggtcagaattggaattctgctgggcagggagtgggctggagacgggccagggctaggttcttctttctgcaggaccggggtggaacgagaggcagctgggggtggcctgccactgggtttgggtctggattaagttaaacctaagggtctggggttctgtgggtggggtgggcgagggaggcagcgcagcatcaagatggggggctcttccagggctctgtgtgcccagtgtgtaaccctcaccttcccctctggccatcaggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcaaggggagaggccagctgtgccaggcctggggctttgcccccctgcactcagggctcaagtttgcagacctccagacattaacagaaccctgaaggactctcagcccacctgcagcatcaacctctttttttaatttaatttaatttaatttaatttaatttaatttaatttaatttaatttttgagacagggcctcgctctgtcacccaggctgggatgcagtggtgcaatctcactggagcctcaatctcttgagctcaagtgatcctcccacttcagcctcttgagtagctgggaccacaggcatgtgccaccatgcccagctaacttttttattttttgtagagacgaggtctccctatgtttcccagactggtctcaaattcctaggctcaagcagtgctcttgccttggcctcccaaagtgttgggattacaggtgcaagccactaagccaggcccagacccaacctctgactccagctctgtctctgacctaagccacatcaacccccacccccagacctagcttagcagtgacccagtccattccctctcccccaaccccaccctgaccctgacgactccagcctcccttagccccagccccttggctgagtcacccaacctttctgcacacaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggtgagccgggcggggcaggggcgcgcccttcacaggtgggcggagcttgtgcgctctcctctcctttgcctgtgggcggtgaccatgattagcacttgaaaatttagaggtgcatgttgtttcagttctcctccgcaagaccccacgagttgtctgaacacccttttcaaacccagattccttccaccataccatcctggctccaggagttgggagaaaggaggcaggagccaggaacctgggttctcatcctggtttcgccagcctccaggtctgctctgtgaagtgggctcataatgcctgccttgcccactcacatctcgctgggttcttgggaacctagagagcactacacaagcaaagagtacctggggccatggttctctctgtggccactgccttccagcccatctccgtgcacgtctccatctgccttcccctctctgtcccactgtttctctcagtccccaccttgcctgccccctggatcccaggtttgggagaggggcaggagtgacaggcctcacccccacaggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggtgagggcccaccctacacagggtagggaaaggggaatcagcctgtggagccaggggcttccagccatggccagtgcccatggcctgggaggtttgcagtcagacctcctggcaccccttccatgctgcccaccagctggttcagctgagtgaccttttaaggtataaaccttaaaaacagataacagggtctgtgagtctggctgtgaaatcttgggtacatgataataacagaaatattaatagcagctaatattgattgagcttaaatatgtgccagatgccatgctatgcactttacatgtattatttaattctttggtatggacaaggcagtggtattgcttagtggctaagagcataggcttggaatcagacttcctgggttctattcctgatcttgccatgaccgtgcgtaggttatttgacctctctgtgcctcagcttcctcatttgtaaaatgggtgcgatggctcatgcctgtaatcccagcactttgggaggccgaggcaggcagatcacctgaggtcaggaattcaagaccagcctggccaacatggcgaaaccctgtctgtactaaaaatacaaaaattagctggctgtggtggcacacacctgtaatcccagctactcgggaggctgaggcaggagaatcacttgaatctaggaggcagaggttgcggtgagccaagatcatgccactgcactccagtctgggcgacagagtgagaccctgtctcaaaaaaagaaaatttattaaaataaataaataaaatgagaataaaaatagcttccagttgttgagataatctaagtatttagaacagtatctagagctaaatattagtggctgttattgttgtagatagaatgagtgcctgacatcatattgtccccattttacagttgaggagacgggggcacagaatgacagtgggcttgaggcagcatcagggtccgaaaccgggcagtctgccccggggccagtgctcatcatcactgtgtgcacttaaacctctctggcccttgatttcctcatgcacgcaatgcatgtgagtgcctgcactgcctgcttattgctgcctggttgttactgtgggttgccacaggggactctgatttagagggactgcgacaggtagagagacctgccctgggcaggcagccctgaggtcgatgttctctcagccctggagtggacggaggataggtgggtcgtctagactggtgggagcattgtcaacctttgaggaggctgtccatggtgagggacttccaggagtcgtgacaggttggggacaatcctcaggatatggctggagccctgcttcttggggacaaggatgtcctcatttcctgagcatctaccaggagccagccccatgccagacttcatttgtcctcggtggtcatcaactgaaaacagaggctgtggtgtcaccggtcccttggggagactcacgaggtgcttagattcctcaagactccgggcatgaattgccagagtgggctctaaggagaccgggatcgggggaaagaggaacctggaagaagccaaggctccttggaccaggctgcagggcagaaaggaaaggctgggaggaggctgcctggggtggagggggaagctccatcagccccacacggactcgcggcgcattataaacactgtaatctggtgtcagccccggcactgattaaaggcccattagacacattcaggcctctgtgcagcactgattagggcgtgagcggcacaggggccggcctggaagctggccatggggagaacagctggcgaaggctctatcgaggttgcggcctgtgtggccatggcccccagcctcaggctgggaaacaggatggggcacggggctgtctgcggctccaccggcattgttttcagaaagctcctactaaaaactgtgaacttgggataccaagaggagggggtcagtgctggctgcaggagtcagcagaggcctgtgccatccctgacactgggtgatgttatgtggacctgggtaaaaagataagtgcagctcagaggtcaagagcacatgctttggtgttagactgtgggcttaaatcctagccctgtcacttactatctgttgatcttagacaagtttcttaaactctctggccttcatttcttggcttataaagtggagctcatagtattacctacctcatagggctgctgtgaggatttcatgcagagctcttaggacagcacctggcatacagtgctcagtaaacatttggtgttattattatcaggcatgtgtgatagttggggcctgggagcagtcccgggcactgggtggaaggcagctgagggaagactggaacaaggctggcctaggaatccgagatgggtttgagtcttgcctctgccattactagctgtggaaccttgggccccccttctctgagcatcagtttcttcatctgtaaaatggaggtaatactagtacccaccccacagggctgttgtgaggacaaacaggataaagcatgtaaagtgtttacagcagaatatctggcacatgccatgtgcaaaacaaatggcagtcattaacattagttagaaacacatttattgcattatactgtccctctcaggggtagcgtgtccaggccactggtttctggcccttggatagagggtagaaaaggctctcctctgggtggtattgggcctccttagagtcccaagtgattgtcctgtccattctccatttccaggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcacggctgggatttctgggcccgggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtgtgtgtgtgtgtgtgtgtgtgtgtgtgtgtgtgtgtgtttgagagtcagggttttgtttgctcttgtcacccaggctggggtgcagtggcacagtcatagctcactgtaacctcaaactcctcggctcaactgatcctactgcctcagcctccccagtagctaggtgtagtgcacaccaccacacctggctaatttttaaaattttttgtagagacaaggtcttttatgttgctcaggcttatctcaaactcttgggctcaagtgatcctcctgcctcagcctcccaaagtgttgggattataggtgtgagcctccacacctgaccactgtggtatttttgttgctatttgtctttgtttgttgctgttttgttgttgtttgtccttgttttttctcaaaacacttcacttgtacaaagacacacacacgtatatcaacacatacaagcgtgaatatccttctgaacatacactcacagaaatatacacatgcgcatatatgccagactgttggccccgtgaggacaaagaacgtgtcttttgctcacccttatgtccctattacctatcatagtatctggctcacaataggtgctaataaatatttactgaaagaatgaatatattctatacatgtatacatctatgtgtacatagacatacatttctgtacaacatatccgcaaaaagccacatgtatgcattcctgtacacacacacatacactcactttcaggagccagaagtggggccagctcatttcaggccctgggatgggttgatgagcttcctgggatgggttgatgagctttttgggatgggttgctccctggacacttgcatttttagggcagttcccacttccacagtcccctgggcccagccatggctgatggaggggctggaagacactgccctctgcactggggtcttaggctgtggatggggatgtgggagcccccaggcttgaagaatcggccccttcctatggatcttggcaaaggtggggatgggggtaaggtgtttcacagacactgcttgcccaagggggcttgagtgctcctgaagatctgagttctctctttctgtccgccctgtctttctccatccctttctcactctactctcttcctcttccattttttatttttttgtcatcctctgttctctctctcaccacttgtctttcctctcgctctcctttccaatgctctcatctccctcctctcatcctttctctcctgcttatgtctccccattaccggccatcctcctcatcttcttcccatcttctctgacccacctccctctgcatctctctcccgaccccctcctcttctctgcatctctctctctgcctcctctcctctgcacctctctcccaacccccaggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcctcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagac

SEQ ID NO: 16136 - DNA, 76247 bp, Human
  misc_feature (1)...(76247): n = A,T,C or G
ttttgcaatcttcatggtttatataatattactcattaacatatatcctgtttccctgataagcctgttaagctcccttggagatatatattttagatttctctgcctctacagtgttacttgggcctgttcattagtaggtgttcaatacattttttattagattgaattaaaagcattcatatttactaagtactttctatgtgcctgggattggttgaggctctgttgagtatacagaagggcataagaaaaataatcattgctttcaaagaacttataatattttagtaagctaaagtcaacatataaagtacttaaataaccacagcatgacaactgctataagaaaggtatgaagtgccttgagaattctggggagggtgagatgacatctgttaggggtatcagggacagtagaataaagaaaggcttcttggaagagggtggcttttgagattaactttgaaggatggttaagattttgatggacaaaaatggggatgagggtaggatgtgaattccagattcaagatgacaggattagtaaagagattgatggagtgtgtggcaatgaacactaaaacgcagagactagacaggaggcttatacaggacatcagaaatacaattctgcttcagggatactgaagcccaaccttgtttccaatttcaggaccaacacaaaggatggtaagcaggggtggaaagttttaacatgtatcagactaccttccccaactgtagcttctttaggggctgagaattatttgcaacaattcttcccctgaccccaatttggacctacctgaagtctggtatgatagtgcatataaaacaaaaggccccatggccgggtgccatggctcacgcctgtaatcccagcaccttgggtggctgaggcgggcagatcacctgaggtcaggagttccagaccagcctggccaacatggtgaaaccccgtctctactacaaatacaaaaaaatcagccgggcgtggtggtggggacctgtaatcccagctactcaggaggctgaggcaggagaatcgcttgaactggataggcggaggttgcagtgatccaagaacacgccattgcactccagcctgggcaacaagagtgaaacttcgtctccaaaaaaaaaaaaaaaacaaaaaaaacaacaaaaaaaaaaacaaaaaaaacccaaaaggtacctttctttttcttgaggagagagggttgcttcgattttagccagcctctcttttcttataaatccaaatcaaatttaatgcattattcatgatattctaaccttgtgttaggtcagtagttctgttgctaaataatagtttgccttagatcatttcctggaaaagttcgaagcctttttgtggaattgcttcaacagtcatccttagctcaaccctgtccgtgtgttttgcttctgacttgagactcaagaagaagacctaagtcatagtgagactgtgagggagcctgacactgcctgccttcttcaatttaatgctctttaatctggccattagctcaaggaaaaacaattaattttagaaggccctctcccctcatccgcaattacctcctcctgcaatcgcgaaggatgtttgcccggaatttaaacatcatctcccaaggaatgaaatcagaataggcaaaaccgacactttcccagttttcaagggtcaggtgcagctgcaaatagaagcagagattttctagcaagcagttggaaggaccttcacgcccagaggcccctgaagggagggaggcggtttccaaggcaaccgggcccgggagcggttggctccccggctcctccccctccccgcggtagcccagggtaccgccggacagcgtcctcccgtgctccgcgccctgattggctgcgcaggcctctcgctgattggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcaggtagggccccgcctcccgcgcctcccgctcctccccggggcgcagcctcctcatcctctgcccaccctccttccttctgcccccgagcccaggcttcccaggccgctccctgagggcgaggggaggccagcccgggacaccagggggcgctccgggcggttggggaccaggccagggctgcgagagagtgaccttgggccgaacctgggatctggcccatctctgccgcatcccttgcgccgcccgcccaggagccctgacagccggcgggcggcgacctcttgttctcctcgcgtctttctgttggaaggggccggcgtctggcctcgcgttgtcctgccagaacgtgggcagaaagggtagcagggaccttgctctggtggggcacgtcttctctttgtgtttttatttctgggggtttctggttcctcagtggttcagaggaaaagccagaaaagactctggaggctgggaccaatccctgatagggtgacccggtttgtgactccctctgccccattgaacagacacctgaaaacttctgggtagggactgcaaactgggctgaggatgtgtggaggggtcaggaacaggtgcttatttaagggaattaaaaaaccaaggttaagtaactggtattggaactgttggggcggctaatgtaaggaaaagcattggactaagtgttagagtctgtagtttgaaatcctacctctgcctcacacaaactttgtgaccttgagtaagtcacttgcctctttgaacctcagtttccccagctattaaaatgggaatagttatgtctgctttgcatgcttcacagggttgttttgaggatcagacgaagtgctgtttgtgaaagggctttgtggagtaatgtttattgtgtgacactcagtgaatgagtggcagcccattgaattctcactccccgtttcctgtgcaatcagatggtgtggtttctgccttggaaagagggttggaagaggaggcaagtctgaagtacagggctctgaagagggtaatgggccatctcaggaaggatgacacgtcttggaaacaagtgccatgttgacctcagggatggtttccccgaggaggcagggaaaatatcctgagtttgcaacaaaatgaatatcagacactgactctctcctcttcttcctggttaatagtttgctacaattaatagaagatacatccttctttccttgctctgtctgaaaagaacaatatctaagattttggaaaatgcatatctaacccccttaaagcctattaaatgtattcaatctctgtttgggatacaatggtaagaaaaaataggcaatgttcttgccctcctggagcgtatcatttagtgggggaggggagaagtactatttttaatcaaatatcacacaaataaatatcataaactgtgataaatgctttgaagaaagataggcagtgccataagcgtgtataacagtggttccagacatggtctcagagaagattttgctaaggaagaaaatctgggcaaagagctaaaggatgaataaatgttaactgagggaagagggggatcacagggcctgagaggcaaagagaacagctacacaaaagacctgtggcagagggggacacacctggttagagacctgaaatgaggccagtgtggtgcagcaacaaggagcgatgaggggaatggtatatgagatgtgttctggggttataacacacagggccatttggagcccatgctgaggaagttgacatttatctgaggaacaaggggaagccactgaaggggtttaagtagaggggaaaggggagagagggggtctctcctaaccgggagagagagagagggcatgagagagtaaatgagatcatgaacagattttcttttttttttcttttctttttttttttttttgagatggagtcttgctctgtcgcccaggctggagtgcagtggtgcgatctccactcactacaagctccgtctcccaggttcacgccattctcctgcctcggtctccggagtagctgcgactacaggcgccttccaccacgcccggctaattttttgtatttttagtagagacagggtttcaccgtgttagctaggatggtcttgatctcctgacctcgtgatctgcccgcctcggcctcccaaagtgctgggattacagacgtgagccaccgtgcccggcccagattttcctactgaaagatttctttggctgcagtggggagaataggttggaatggatgtgaggatacagtgtccttaacatgcagaatgtttacaggttatattattgagggcatcatgacccttaggtttctgttagtgttctgtgaaattagtaattcttgagtacttctggagtaggatagaaaatatctcctttatatctagtttgtgaaactttcttgggtggtagggtgaggagaagaaaaggaatacaatgggaacagtaggacctcatgaaggctggagtcaggtaataggcaaatggaaatttgagagatagggaggaaaagagaatgagggtagaaggaggaaaggaaatggggatgacttgggggagagacagtcaactgactggcaatgaccaattaaaccttctatgtgctaactaggctgtgtggagatgggccttgtaaagtgagcagattgtgtaacttgatgtaaacagagaggttccagacatcacctctaaatatcataaggctgtgctgttttggaagatgtgagctactgtcctagccttctaacagttccctctgctttctttcttgcccttctgtaagactactctccacatggcagccacagggagcttttaaaaacacaaatcagatcatgtcacatcttatcttgaaacccttcagtggcttcctggtgccttttagaataaaatccaaactctttatcatggcctaccaagcctgaatacaatcaggctcttgtccaccctcccaggactgcctctcctccactctctttcttgcacctcctctggctttctgtttcttcaatacagtaagtcttgcatacctcaggtgggtcttgtgcctgtcattccctctgcccaggatgctgttttacccaggccttctcatgattcaactagaatgtcacttccttagagtggctttctctgaaccttcatcccagtcactctctttaagatggtcctgttttattttcttataacatatgacttacctgaaatattcttcttttggtttcttgtttattatcatctcagttagaagcttcttgagggcaggggacaagcagaaaatcttctcacctagcacagtgcctggtataaaattggtgctcaattgcataagtgaatgagcagctctcccgtatccaaagccagatgcctccccttaaggagctcaaggtctagtcaggattggcacagagtgacagatggccattacttcattacacaacatctcttccctctatgttgtgcctttgctcaggcgttgaagctggaaaatctttcccctcctctccgccaagaatattccattttaaccttcaaggtctggctccatatcattctattatattcgtcactcactctcccctgctcacaacacctaccaagtactatcttccgtgaaccctgacttgtggaatatacatattcatctctgctgctcacctgacagctccatttgctgttactgttaacttttattgaatgcttgccatgtgccaggcactatgctaagtgtttttcatgcattatctcacttaatgctctctataaccctgagaattatggaactttattattgttttccaaatgagaaaacaaagataataaagaggttaagtaattcttttatttttatttttattttttattttttgagatggagtttcactcttgttgcccaggctggagtgcaatggcatgatctcggctcactgcaacctccaactcccaggttcaagtgattctcctgcctcagcatcccgagtagctgggattacaggcgcctgccaccacccctagctaatttttttgtatttttagtagagatggggtttcaccatgttggccaggctggtctcaaactcctgacttcaggtgatccacctgcctcggcctcccaaagtgctgggattacaggcatgagctactctgccaggcatagagaggttaagtaattctaagtgccagggttgcttgtggccctgccagacccagggctgcatctctgcaaaggatgtgcccttaatcactgtgcattactgtggctgtgtctttgttgcctataacagtacctgtctctgaataagcactcactaagtgtttgggaaggcaggatgggaagagactgcaatgagggaggccagctaggaggccattggtataattcaggatgagttaatgaagacctacattagtcatcattttgatgagatctctgaaggtgtttatggaatttttatttatttttgagacagggtctcactctgttgcccaggctggagtgcagtggtgtgatctcagctcactgcagcgtcgacctcctgggctcaagtgatccttccacttcagcctccctagtagctggaactacagacatgaaccactatgtccagctatttttttttattttaatttttatagagacagagtctcactatgttgcctgggctggtcttgaatccctggtctcaagcgatcctcacccctcggcctcctgaagtgctgggattataggcatgaccaccacgcccagccggttattgaaattttaagagtcaatgagcttttcatagggggtagtaatagaggaaggaagtcagaaagctttaaggaaagcccctactttggattggaactggggacacctggtatcttcacagttctcctgataagcactttcagaacaagcagaaggaagtgttgaaagagaaaactggtgagattggaactctcagcatttgagccaagtggtgctggggactgaaggaaagttcagggagggtgaaaatggtggatggggaagcaagtgaatttgggcaattaccaaggcttttatgtggatcaggcctgctcagaatggaaaattttgcagaaatcttcacaataataaaccctggtaagtgggtgataattgagaaacatggctgataggagtagagttacaccccatgtcttatgatggacctgaaaaagctctaagacaagagttctgaaggagacctggattctagtgcccagtgactgtggcacatgttggagctcagtaaatatttgctgagcgaatgaatgaatggctctacagggagtgcgtcaacttttctgagggtcatagccagtttatggtaagcagtcagtaaatatttgctcatattatttaacaaaagtatcaactgtagatagcagtttctcctctcactacattgcacatacccctccaccctctcctcacacatactaggtattctttccatgtgagagaattggggaacctgtgggcattctttttatctggttttcccagatctgctagggagcttcagtaggagagatgtgggcagacttgtcaagcagagacttgagcagagaattggggacaattcagactgcaaatttacttccttcaaaatctgtagataatcgtcttagctcatggtttgccttggcagggtagacagggtcatggtagtaatcaggacacagaaaagcaattgtgtctattctaaatctgctgccaggtaacagcaacagatcttagataatggagaggttggttgtttcccataggtagtaacaagtttactggtcctggtcttggtagtcaggaagtcataatatatgtattggttttcaatttctgccataacaaagtaccacatatttgatggcttaaaaaacacaaatttatcctacagttctatagttcagaaatctgatacaggtctcactggactaaaatcaaagtgttggcgggactgtttctttctggaggttctgggagaggatctgtttcctcgccttttccatcttctagagactgcctgcattccttggctcatagttcccttcctccatctccaaagccagaaacatagcatctctcagaacctgcttttgtcatcacatttttctctgactctagtcttctgtctctctctttcacgttaaggatccttgttattacactgagattacataatggttttcataatttaggatgatctccttattgtaagatcagctgattagcaaccttacctccgtctccaaccttaattcctctttgccattataagggaacatattcacaaactctagggattaggatgtgcatctctttagaggactattaatctatcacagtgtaacctatactgaacaggagtgactccaagtggggttcagcaaaagaatcactgagaagccagagccattttggaattttaggcccctagcaggctgctgaagggttagaatgggaagctcatgggtattcaggagctcatggccactgagaagaggaagtctggaacagctgcatgagtccttgtggaattttttttttgtggctatagggtgttttcattcagtaagaaagtatttgagggcattggagagttggggacccgtgggtcagatttggtgatggactccccaaagggccagcattctgaggctctgctggatgaagaggaagatggaagtgaataaggagatgaagaactattggaggtctggtcagtaaagggcagtttggggtgcagggttctggagcgccaaggatttaagaaggtaataatgtggatcttaagctattcttactgtgggcattaatccatgattagtccatctgactaaatggtgaggttctttgcttttggcaatcttagcatactgacttactaatgttagtaaggaacacagacttgattagagttcttatctcacttagcttttgtgagatcttagcctcaatttagaactgttttgaggattaagtgaggcaacatatgtaaaacacaatgtgaggtatataagtgtattacctcggtttgctgattagaaaccttggaaatgggccaggcgcggtggctcacgcctgtaatcccagcactttgggaggccgaggtgggaggatcacaaggtcaggagatcgagaccatcctggctaacaaggtgaaaccccatctctactaaaaatacaaaaaaaaattagccgggtgtggtggcgggcgcctgtagtcccacctactcgggaggctgaggcaggagaatggcatgaacctgggaggcagagcttgtagtgagccaagatggcgccactgcactccagcctgggcgacagagcgagactccgcctcaaaaaaaaaaaaaaaaaaagaaaccctggaaatggctgggtgtggtggctcacacctgtaatcccagcaccttgggaggccgaggtgggtggatcacgaggtcaggagatagagaccatcctagcgaacatggcgaaacccagtctctactaaaaatacaaaaattagctgggcgtggtggtgcgtgcttgtagtcccagctactcggcaggctgaagcaggacaattgtttgaacccaggagacagaggttgcgatgagctgagatggcgcctctgcactccagcctggtgacagagcgagactctgtctcaaaacaaacaaacaaacaaaaaactctggaaatcatctctatatttattgattttgaaatggttgaatgtattagaactcaataaacacttgacttttttggggggggtcttggcagggatagtggtgggagtgaagtagaatgttaatgtatgtactctctgaaaacactgaaaaagatgaaagggttctttgaggtaaaaagtctgagacctactgcaggaaaggaggtgggattcatttgggcaggtccaccaccacgcaggtccagagaggagcctcaggggaagtgtgttaagagagagagcttgaggtgggctctgctccccaccttccctgttccctgtagcctctgtggctgcttccaggagctggggccattatgtaagactgagctctgcccgtgccttttaatttccatttactgtaagtgagaatctggtctgctactcagttataattcattcatttttcaaggctcatgacaatgctttctttctcaagccttgccttgcaatttcagcattttaatgtgtatttaaccctcttagttctttttatctatctagtccttgaggtaggcactcaagtcaattcacatttacgtagtgggttattatcagtgaactaagaggaagttcagaaaagaggatactcagaaatagggctttttccttcctttcttccttccttcctttcctttttcttaagcttatataatgtgtttctcaggattctaatcttttctgagtcacaagcccctgtgagagaatctgatgaaagttatggaccctctcccaagaaaaagtgcacattcacacatattcccacagatcctctgaagcccatttacaagcaccctagaaatccatggaccacaattgagagatcttttttgccataaataaatgatactatcagaggaaataatagccaattggtgaggaatctgcagcaagcacaggccaaagagacctgatgttcctttcttttcatttttaatgatttcaaacaaactttgtatgtgcctgaaatttatggaacatttcaagcatatagcaaagtagagagattttgcatagtgaatcatcatgtacccatgacttggcgtcaacaatgaacacaccatctgttttttttttgttttgttttgttttttttttgagacagggtctttctccgttggccatgctggagttcagcgtacaaacacggctcattagagcctccaactcctgggctcgagcaattcttccacctgagcctccagagtagctgggactacaagcccataccaccacacccagctaatttttgaatttgttgtagggacgaggtttcactatgttgcccaggctggtctcgaactcccagcctcaaacgatcctcccacctcagccttccaaagctctggggttataggcatgagttgcagagcctggccacacaatcttgtttcatctatgttcatctattctccaaatctcagacatattatttcatgagtaaaaatttcagtgtgtagccctaaagattaaagactcttttaaaacaacgacataactgccaaaacacacgagattattatactgaaaaaatagtttcctaatataatcaaattttcatttagttgtttacatttatgtgagtaccttgtagttttttaaaaaatacttgttttatttgaatcaggattcaaacaaagtccacacattcacattcaagcctgacctttcaaatgcttttgctaatggttattgacagtggctctgttttctttggcaagacaaagaaaatggatgaacaattattcagtgaatttaggctgtggttaaccaatctaaattaaggaaactaacaaacagcaagaaagtttttcaacctgaatttttcagatgattgaccttgctctttatattttgcagttacaattttaaagaaatcaatcatctctcctaccctccctccctctgtttctctagattcccactgtgttctctgtggtgtcaggtgtctgaagacagtaccaagtattataattaattgattcctatcctctggatattaaaaaccagtaggggagccaacatgaataattattcatatatctaattatttatttatatagttttatgagaaaacatctgatcaattatcaaagagtttataaaactaataaacattcattgaaatgtatgggatacttaccatgtactggacattgtactgggtgctgggtagatattgatgaatataagacccagtacctatcctcctagaacttttgaggggacagaatctggattttgctgattgtattcccatggtgttgtttttcaaggaactctgttttattgtactttcagtaaattggtatttggatttagaggcttgatcagattcagggacaatttatttggtaagattacctcatgggtggtgatatggtctcccattaggaggcatacaatgtctgattgtctctcctttgtgatgttagtggctgttgaaaatcagtacaatccattggggattgcaaaatgattttgttccatcattcccttttcatttagtctctcccataatgagaagcttttctcatctactctgtggtaccactctatggtataatttatctaggaaagcccagataaattatttgccagttttcaaagtaatgagttggtttattagtgttatcctccaaatgtgaccaattagttaattttaaaagtgaccttgtgaagccaggcgtggtggctcgcgcctgtaatcctagcactttgggaggctgaggagggaggatcacttgagcttaggagttcgagaccagcctgggcaacatagtgagaccgcccgccccaactccgccacctctctattttaaaaataaataaataaacaaataaaataaaagtgaccttatgaagtgaactcatcaatcttaacatattgacatggtcaatctgttgtaggcattaccctactgatgctcaaattgtcctattttttggcaagagacccctttaaattggctcctgagtcctttggacacaatcctagttgtcttcgagtgcttccttactatctaacataataagatgttttagacttaccttgtacatttcctggctgggacctatgaccagccatttctccagggagctctgattccttttattacaaaatggtattttaagagactataatgtaggtactaattatactcattgctactgattgatcattttttctaagcctttgagtgggcagagctagaaaatataaatttgtaaatttaaaaacattaaaaataaaaacgcattgtatattattgttgatacttccaattcaatttaggactgcatggctcttatttaccttttgtcttaaaactgtatctcctttctctcttgccgagaatcccagtcctcagccgcactgggagtgacagaataaattcacatagctactcatttgttttatctcacaacacacaacaagcctcagaataccaacaccaaccctacaaccaacaataggataaccaaaaaacagtttcagatcttttaaaattcttctttgtccttagagtatatgccactgaggatgttcagtcaggttactatgttttaatgttacttagaataatttctcttggaatttataccatcaatttgacctttgttttcattttgtttttgattttggggaattactttaaaatttttaattttacattatgtaaattatttacaaaataaggcatattcaaaaaagtctagtttctatctttgtctcttccatcttattccctccctcctctctaggtaactatttaaaaaaatcttttgtgactttttcttcttttatttgttatttatttatttatttagttagttagttagttatttgagatggagtctcactctgtcatccaggctggagtgcaatggcgtaatcttggctcactgcaatctctgcctcctaggttcaagtgattctcctgcctcagcctcccaagtagctgggattataggcgtgcaccaccacacccggctaatttttgtatttttagtagagatggggtttcaccatgttggccaggctggtctcgaactcctgacctcaagtgatccacctgccttgggctcccaaagtgctgggattataggcatgagccactgcagtcatcctatttgttttaaaatgtaagcaaacacttatgttccaacaccctttgttagataaaaggtagcaaattatacagttttctccatcttgctttttaaacttaatattatattttggagatttttccatggtagtaataatatataattttaaatgtctataaagctaatttaatacataaaaatcctaagtagatattagactattttatttacttccctaaaagtttgtttattccagttggcctcaaaaactttatttcaatcttcccattgggaaaatgaattgccttatgttcagagttgtcttatttgggagcatagatgataactacaaaatagtaactttggaacagtaagctggaaacttgagcaggatctagaaggaaggtgatatcgtttggctatttgtccccaccaaatatgttgaaatgtaatccccaatgttggagatggggtctggtgggagatgtttgggtcatggaggcagatgcctcatgaatgtcttggtgccatcctcacagtaatgagtgagttcttgctctgagttcacccaagatctggttgtttaaaagagtctgggccctcccctctctcttgcccccatcttgccatattatacaccagcttcccttttgccttctgccatgattgtgagcttcctgactctcttaccagaagcagatgctagcaccacacttcctgtacagcctgcagaactgtgagccaagataaacctattttcttaataaattacccagtctcaggtattccattatagcaatgcaaatggactaatacaggagacgtggggatttaatgtgctggagagtttggggaaatggcatgttagatgactagatgacctgacaatatgagcaaagacataaaggtgggaatgtgcacagtgctctcgggatcagtcagcttggctggagttgcaggtttgagaagggaaatagattgccagggaaatcagctaagagtttttttgaaataattcagggtcttgtgattcagggtattgataggataggtgccattatattcattcttttaaaacgtttaatttttattttgaaattgacaagtaatatttaagtaatattgtacatattcattggggtgcatagtgatgtttcaatacatgtaatgtatagtgatcagatcagagtaattagcatatctatcatttaaaacatttattatttctttgtgttgagattactcaatatcttccttctagctgtttgaaactctatattatagtcatcctactatagtatagaacactagaacttattcttcctatatagttgtaattttttatcctttagcaaatctctccctacacttctcccccttgccttcctagcctctaatattctctcttatacttcttacttctctgagatcaactttttttagcttccacatatgagtgagaacatgcagtgtttaactttctgttcctggcttatttcacttaacataatgtccttcagttccatccatattgccacaaatgacaagatttcatactttttatggctgaatagtattctgctgtgtatatatgccatattttctttatccattcatctgttgttggacacctaggatgattccatatcttggctattatgaatagtgctgcgataaacgtggggatgcagatgtctctttaatatagtgatttcctttcctttggataaatgcccagtagtgagattactggattatatggtggttctgtttgtagttttttgaggaacctccactgttctccacagtggctgtactagtttatattcccaccaacagtgtataagggttctttcttcttcatatccttgccagcatttgttatattttgtctttttgataatagccatcctaactggagtgagatgatacctcattttggttttgatttgcatttccctgatgattagtgatgttgagcattttttcatatatttgttgactatttgtttgtcttttgagaattgtgtattcattcttttaacaaagatttatagagcactgttatgtgaaaagtctgtgctgggtgctaggatacagtggtgaggaagatggacatagttccttcttcctcaaggaacagaggagactttttttattttttttgagacagagtctcgctctgttgcccatgctggagtacaatggtgcgatctcagctcactgcaacctctgcctcccaggttcaagtgattctcctgcctcagcctcctgagtagctggcactacaggcacgcaccaccacacccagataatttttttatttttagtagagatggggtttcaccatgttggtcaggccagtcttgaactcctgacctcaggtgatcacctgccttggcctcccaaagtgttgggattacaggtgtgagccaccatgcccggccaagacattttattactaagagaattgcagtgtgctatgagggtatataaatggtggacctagcttagtttggaagtcggagtgggtaatcaggaaaggcttccaagtaagtgtgttgaggctgagatcaaagagatcatcatctctttgatcatcatcaaaggtgggggcaggtggtgggagtggcagggagagaatggtagttccaggaagagacagcagcactaagtaaagaaggtgggtgtggttccagaactaaaaaaaaaaagaaagaaatgcctaatatgatttaaagggttggagcatgtagggaagagtggatgagagatgaaaattaattttttagagaaattgcaaaggaagaaagacttggtaagaaaagggaactagctacctgaaggcatatggtaggcactcatacatgtggaatggatgaataagtaactttgaaatttcacctgtgggctaataaatgatggtgccattggtaggaataaacaaatgagcacagggtgttagttttggaaggaaagttagttgggttttagacacatggttcttgaggtgtggcatcctagtggcttatcaattactgaaccacagtttcagactgcagttgaaattgtaagtcttaagtgaggaaaacaaagagtagagagctctttcttggaaattatggttagaggaagaaaaagactaaggatgagacagaggaggcctgataagaggagcaggatggaaaatttcaaggacagcgtgtggtaaacaggcccaaatgctgcaaagaggccaaggagaccaatctacaccaaatgggacaacttgcttcacagcacttgcaaaatgccaaaatgttatacagaggtatagatggagtggggaggtggaaaaggcatgagatttacagccacaagacctgggctcatgacacgtcctagtaatcccagctgctctggaggctgaggtaggagaattgtttgagcccaggagttcaaggctgcagtgagctatgattgtatcactgcaatatagcctgggtgacccattctctctctgtttttttttttttttaaaagacctaggctcagtcctagctccgccttttatgacatttgtgaccctgggccatcattacttaatgttctctgagtgtcagtctgctcatttataaaatgagaaagataatggctaccatatttgcatctaaaaggtattgtgaagttcacatgtaaaaatacaggtaaacaattgtgtttcccccgtaagtatctcaaaaggatctggcatacacaaggtttgtatatttgaacgaggtatgtgtattactgtgactacttatttgtgtttaaacagagaccagatgaagaagctgtggtggatcagggtgggaccagtacaattctcaacattcactatgaaaaagaagagctggaaggtaagaactgccatgctgtgtgatcagggaaattggtgaggggcagcctggtgtgggaagacctggctctgtgtcctaactctctcactagctgtcagaccttggggaaaatcacttgatttcctttagcctcactttcctcatctggtaaataaaagtggggatactaatacttgtcctaccttacagggatatcattaggatctaattgcctacatgggagatagtgctttgaacacggtgaagtccaatataaatattaacaagtaacctgttctttgagaatgtgatgtactcagttcagtgcgttaattcttgacaactgcctggaaatacaaataaatacaaaacttaaagagaaaataaaatacaaatagttttaaaaactcattttggctacaaaaccctatttttaccccatttccaatatttactgtttctattctatttatacccatttctgcctggtggtttcatctaaacaagagggaaaacaggaacacacctgtgacatactcttgagttcataacatcaaagttatataaaagcccagctgaaggggaaaggaaagaagaggcattttggatgacccactctgtccagtttaccttatttcagctcttcctttctctgcacctcacccccagctccccacataaccgttatgtggtgtcctgctttccttcttcccctggggactagttggtgtgttaggagttggacccacacctggccatggttttctaattagtgttgatgctcagtttcattagaggaaggctcatgtccagtatccaatatagctttaatgagaagccacatttggctcaaaagcctttgtgaaatctctgcagcatcccctgcaatgttgaaggctatgatacagcaactttctgatgcctgagacagcatgtgaaatgttctctctgtactgcctgttcccgtgacagttttttcatcaaagttgtacaacctccagagaaaacttgtccttttgatggggagaacggaagctgtagaggctgactcagcctctgggtctgttaccatgagaactgacgtgggtggctctgtggaggtcagtggtgtttgggtataccaaggtgaagttttccaagttattttgaccagatggaagaagagaacatgtgagttgcagcagttgggagggagtgggagaaggaaagggtgtggaatggaaggctaacatttgttgaatgccccttgtgtgttaggcattagattaggcaccttatacaagttgtccttttcatcttcatagcaccccaggcaggtaggtatcattatccctattttacacatgaggaaactgctcaaggtcatcgagcctaattgcaggtgaggctggggagagaatcctgctcttttcattctgccacacagcctgcaagagaggacagtaactgtcattaaccacccaacctcaatatcttgctccatcaaataaaatttttgtatgttgctcttgcctcttcttctgttctgataatcatgtggtctctctaccctctcattgcatcctgggggcatgttgctgtcagtttagttgttctatagcaagcaccactggacctttgccctcagcaaggaggtaaccatttatgaacactcttgtctacttgggagtagaataagaaacctgagcaagctctcttgaatcttaacaactggttccgtccacggagatcagctgagtaactggcggtgggagcagcttctccagatgacatcatctgttctttatgcatgttctactttgctaaaaaagaatgctgtctgtgatgacagccttactagtgcatagtgtgttgggagatggtcctttgtacatagacttttttgaaaactagaatcttatttatgttaacacttaaaaaaaaagcattacacgcaaatggtggacaaactagaaccagatctcaggcctgatgtggtttctagaccagctctggagaagagaagagagagttgggatttgctatagggttggctgtgctgtgggttccactcagactcactccgaagggcagccctaggactcaatgaggctgtactcagggtagtgttatctcttgaaggcatagaataaaacgagtaccattttgatggaacacagaagcaaattgtgttcagattcaatatgcatgccatgatatcaggttctgtggctgcaaaaaaaatctccaggtcttttttcccctttatgtcataacttctgcccacatgacataaactataaatcattgccttaccacattttatttatttatattaaacaacaacctctagtccaagaatatgagttttttgtttttgtttgattgttttttgaggcagtcttgctctgtcacacaggctggagtgcagtgacccagtcttagcccactgtagccttgacctcctgggctcaagtgatcctcccaccccagcctcccaagtagctggggctacaggcacgtgccaccatgcctggctatccttaccccattttaagaactatttctgagatttagtctgtgtacattgttagaaactttgtaagtgtgggtcttttgcataaattaattctatcagtaagagaagttgcattaagccattatgttgctttttttttaatatgtgagaagagtcaaaagccaacatcagaacacgttccaaagatgaactcaagaagagcaatagtccatgatgtgcttcagtggactttcccagtcccagaggaacaagaggcagttgctttagttagagggatggctttttccattttttcctggcagatcattattcctgattaactactagattaatgaactctggagtgagtttaaggccttctaatacgtttttaacagaggtaagagccatttggtcatatttataacttctaaaaaggcttacatctgctcgacatgtgagattcacctctgcagttattgactttgagttaacctgtaagcccagaggagccgagcaccctgttgtatgtgctaatgagctctgtgtgagtgctgggtaagcagtgtgcgtgtactgcattgtaccttagtaggcccaatctccatctgcagggtacgtcaaacctatggttcctgtcctgcttcacatgattcattgccagttcactaaagattgctctctgcatgtgtatatgtacttattttttaaactatagactaaaattacatctttcccataatttttactaaattagaatactttatttgcacacagatagttccaaaagactaggtttgaccttttttggaaaaaagaatgacgagttagatgggaaaaaaatgggatttgtgcgagttggtaggtagaagacgggggcaaagagcggttgaatggccaacaaagtgaccacagaattagtttaatgaagtcactgggtggccagaatccagttagatggactggattttattggtgctatattcatttcctagtgtctgtttgtcatcttttctgccaatttttctcagaaaatccaaatccttgctttagaactcccagactagaaactgatgcctgattttctgacagccgcttggtccttcttagctctgaccccctgccgaacttgatttcatttctgcctgtctctctgatattttcaaaagacaggcattgcgattggctaatgttcgtgataattgattgtactaaagtaagatttaccttacttcctacagaaccattcaaggcatctataggatgtcttcaccattatgcctcaaacctacatagtgggaatttagataccaagcaaaaccatatattattcactcagcaaacatttactaagccccttctgtagtccctttctgcagtaataagtcaggacagtgagaacaattgaaccatcgtgtcttttctgaagaataacctagcctgaaactttcataggactcgaacattagaacctggactagccatcatctggacaagcctgggaagtcatttggtctggcctccttgttttactttaatagtgacagtgagtaatttaaaccaataacatgaaatctaataatgcagtttctaatatccaatcactgcctcctcaatttctcctttaaaattaaataatactagcagtataccagcatgagcccagtggaagtatttggaatgggctcaaggagcaaggagaagtagaggttctagcctggctagtaatcctttgcggggtttgtagggaagaggaaacccatggttgggatggctgtattgaagaactgaaagtcacctctcactgaggctgttcttaacctaagtccagctctatctagctgtactagattttacaacaccaggtcatcattttagaggccaaagtggttgtttagttttaaattttgttttgttttgttttgaggcagggtctcactctgtcgcccagactgagtgcagtagtgcgatcatggctcaccacagcctccacctcctgggctcaagtgacctcccacctcagcctcccaatagctgggactacaggcatgcaccaccatgcctggctaattttttattttttatagaggtggaatcttgctgtgttgctcaggctggtttcaaactactgaatgcaagtgatcctccttccttagcctcccagagtgttgagataacaggtgtgggccgctgtgcctggccagaagtggttgttcaggatcgaattatgctttttacagcacatagattcttcatgacctgcccctgcctgtttttctgtccttgtacatctcctttccttcccttttctaccctgccctggccctactggccatccttttgccccagaaccagctctgcacattcccaccttaggacctgtgcacttgatcttcccccttcttggaatactcttctcccaggtcttctcatggcctctccttcttatcacttagatgtcccctctaatcatcttaaagtctcccttctccatcctaccccttaccctagacacgctagcattttaccttatttggttcatagtaataatcaatatttaaatgatatatttttgttttcatttctgaccccccccaagcagaatatgtgtcctgaagactttgttctgttcactattgtatccccagcccttgggacaggatctggcacaattacttgactctagtctgctgctaatgccacctgggttggtctcagtagtgtgctacagggatttcattaacatactataatggaacataatgagttaacaaattgtattttattaagatggtattcaatttagtattttcacgctatatgctttttatagtttatactgataatgtcagggtctggaatcccacatcttagcagatgacctcctctggctctatatttctgtttctatgaagttgcaagatgactacattatgttcagagatctgcctgttaaaaatgacctgagatatacacgaggcaacagagaactctcctgagacaggagggtaagaagtgcgattccaccagatactaaacattttatcctcctgcctcttaacattctagcagatctctgatcatcttatcctctaatccttactgtttgttttttattttgctttatcactttggaatttggaaaacagagagggcaaataaaaggagagacaaatagagaaaggtgttagaatggcatccaaggcactttaacctgacttggaagtggagggcactatcaaggaagttgagtgcagccttaggaaaccccattgctgggaaaagaagaagataaagagttggcaactcttcccaccaagtctccttctcggggaagtcttcctgatgaagctctccattctcaggtcagttaggactttatcaacctccccatgccctggtgagtactttatttgtcctaaacacattcactttggttacatgttctttttgtggcccctttcaggtcagagtcagaggccctcttaggtgagattatgtactcctgaggaggtcctaagggcttatgctcttcagggaggtacttaggaggtattttatttgctgaacatttatggaacaatgaccatgtgtgaaacactgtgcttgattatgtaggcattctgagagaaacgtctaacttgggacaccaaggagattgcaagagaagagtgcagaataagagagatagctgcttaactttaacgcaaaatagaaaaataagtacatgagaacagcactaaccaagggtgctgggaatctgcctgcctgcctgtctgtctgtctgtctatctatctgtctatctatctatctatctatctatctatctatctagagatagggtctcattctgtcacccaggctggagtgcagtggtaatgatcatagctcataagctcatgcagctttgaactcctgggctcaggcaatcctaccacttcagccttccaaatagctaggactataggtgcacaccaccacacctgtctaattttttttttttttacaccttttgtggagatgaggtctcactaagttgcccaagctggtctcaaactcctggccttaaacagtcttcctgccttggcctcccaaagtgttgggattacaggtttgagccactgtgcctggcctggcactgggaatttaaaggaatgaggcagcacatctgatgggggaaatcagaaaaaataccaagaaggaagatgcatctgcagtgcatcttgaataagtgagccaagccagtgtccagaaagcactggcacatttgtggaatggcagtttgattctggtagagaaaagagtatgaggtgatggtgggtacagcagtcaaggccatgaagaggagatggagtcaaaaccaggccatttggttgctgaggtacatggcagttatacatctctagatatttcccccccagaatgttgattctctgtgagcatgtgggatttccacttttttttttttttttttttgagtcagagtctcgctctgtcacccaggctggagtgcagtggcgcgatctctgctcactgcaacctccgccgcccaggttcatgccattctcctgcctcagcctcctaagtagctgggactacaggcacccaccaccatgcccagctaattttttgtattttttttagtggagacggggtttcaccatgttagccaggattgtcttgatctcctgaccttgtgatccgcctgcctcggcctcccaaagtgctgggactacaggcgtgagccaccacgtccggctgggatttccactttttatttctcttgaacttgttattcagttcttgagaggtctttcattttattttcccactgaatgtataattggtattaaaagaagaaaagattaaaaaggagattgagtactgagcatgaaggtcctgaattcatatgggtgagccatgatcagagctgtaactaggaggatttgtttgcagggttaatttaatgtgagaggcaggaaggggcccctgctttgttaaagtgggagttttgatggccctaatctatagaaagtacggtgagggagaaagggaatggagttgaaaatctaaggtaacgctcggtttcaagcctaggaaattgagagaatgacaaggccatgaacagaaacatggaatgagtataagaccgatttgagatggaggatggtgagtttgctttgtgacatgttcaatcattgtagatagagatttgaaggtcatttgtagaagtgaattttgaaaacagaagagtgtttagcactaaaaaggaagaaaagggccaaggacagaaacttgaggagctttcctttggtggcttgttgggggatggagcagcacagtcagagtagtgcaagtgaaccaggggagggcagtggcaccggagctcagggagcccagagcacccaagtggtttggatactgcctgcaacgtggtgggctctcaagaaagtcttttgaactaagctgagagagatgtaagatgatagagatttggtgaatgagtggtgtggtgtccctaatgagggaagcttcagcagagactggggtcagaagccatatgcagaggctgtggaacaaggaagtggtgaggaaagggagttaggttgtgactgtttttggaagtggtttgataaagaaggaaagaggaaacagcagaagcttgggtgggtagcactgcttgggaaggtttctttttaagaagtcaggagaaacctatggcagggatggatggaaaggagagactgaggataacagaagcaacaggataccagaggggtgggagacaatgggatagagtcatactcattaacatacccagcttggcagaggagagcaagccagactgaggaagagaagaacttcttccatctcttctcaggaaaaactgaagtgagggctgggtgcagtgattcacacctgtaatcccagtactttgggaggccaaggcaggagaatcgcttgagctcaggagtttgaaacaagcctgggcaacatggcaggacttgtctctactaaaaatcaaaaaaattagctgggcgtggtggtacacgcctgtggtcccagctacatgggaggatcacttgaacttgggaattcaaggctaccatgagtggtgatcataacaccacactccagcctgggcaacagagtgagaccctatctaaaaaagaaaggaaaaaaaaaaaaactgatgcaaagtcacctgctctcagcaggaaggaatgtggataaggttgtggatttgaagacagtggctaaggattagaacagctcctttggtggaagatgtggggaatgggtctgagatctagagtgctgagcagcagtaaccaggcagaaatgggagaagaccaaggcatggtgcattgggcatgggagcatcagcagccccaaattctgggctccaggtttggcaggaaggcaagggaaagccaggtagaggtgacagagatctggaaatctggatcaaaacaaaagcaggcttatagaaggaatgaggccagatgtggtgactcatgcctgtaaacccagtgctttcgaggtggagacagtaggattgcttggggcaatcagcttgggcaacgtggcgagaccccatctctacaaaaaattgaaaaattagctgggtgtggtggtgcacacatgtattcctagctacttgggagactgaggtgggaggattgcttgagcccaggagttcaaggctacagtaagatatgaccaggctactgccctctagcctgggtgacagagtgagatactgtctcaagaagaaaaagaagaaataggagcagaggaactagggagggaacactattgggtcacttattttctcatgttcccctctctttgtacagtatttaatgtctttttttaaccttagcctcaccctcctcatgacttacaactagtctcttttagtactgttctagattgtgtatgctacaatgtagaaaataaaataatggaagctgatcctaggatgaatacatcctaggctgctacaatttattccaggcatgtgttaagcattttgcatgcataaccttatttactgcttatgaaaactctgagtttaaatactaagcttttaatatttcttcttaaagatgagtcacagagagattagataaattgttcaaggtcacatggcaagtgaatgatggaattgagttttggacccaggtgggctgatttgagccttacctgtgctcttaacgacttttctaaactgcctccctgccaagacctgccacacttgtcatagagcaactgtattgccttttaaaaaaatcactcagtcaaattgtcattgtcattgtcataacaataacatctgaatcagcctttacagtttggaaatcacattatttctttcagtcttcacaagatccctgtgaagtttgcaggcatgtgcaggacaaaggaagagaccttcaactccaaaatctctatatctttactcctggaagtctttgaagttttgttgttccagagctgtgaccagaccaaagaactgtgatatttttttctcttaactatgctaggctttttgttgttgttgttttttaaaactaaaggagttctctccacagaccttctgcttctttccaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacggtaagggccttgggagacagggcgggtgtccatggcccaggggaatggggaggctgaggggacatgtgactgacattagcagctggtcttgattcttgagcctttttgtaggatttccaaagcttgcttctaagaagaaatgcctctaagagtcaaaaatattttcgtgaaaacttcacagttccgggcggctgggactacaggcgcccgccaccacgccgggctaattttttgtatttttggtagagaccgggtttcactgtgttagcctggacggtctggatctcctgaccttgtgatccggtctcgatatcctgacctcgtgatccgcctgccttgacctcccaaggtactgggattgcaggcgtgagccaccgcacccggccactgtttttaaattttaaaatatacaattaaattgttatttactatagggttatttttatggtcataatacaaattatatgtgagtataaataaaattcatttctaaactcttaatattttttcaaaattgttatatatttttgtttgaacatgtggcctgtctgcctgcaaacacacagactttttgattcacatagagttaaatatatattagtctaaagacaaactttaggtgtaagaaaattatggaataagtgtgtgtgtgtgagtatgagtttgtacctattttcagaagaaaagaacaatatgggaatgaaaatcattttaataaggtggctactataaaaccaaaaacctaaaaactgaaagcaaatgtaaaaaaaaaaaagaaaagaaaacttcacagttctgaccccctaaaatcaatactataataggtaaaaccccttgctagagaattagccaatctttttgatcaaattcatcagttttccagtttcttgtgggttttcttcaagtggtcttcattcataaatttttcctcccatgaaactacttctacagagtagctttttctctgagaataaagaaatctttttcttctgcattcgtggttgtctatatatatttctaaagttgttaggtaaggaagaatgctatttctgttctaagtgtgaggctagagcagacctttctctttggttgatttcctagacacaccatctcagcgtgttcagttcattcttggcaccgaggaagatgaagagcatgtgcctcatgagctgtttacagagctggatgagatctgtatgaaagagggagaagatgctgagtggaaggaaacagccaggtgaggccctaaaatggcctgcatcaagatctgcttgggtaggcaagtgtgtacccttcagcaagtgacaggcctgcctgccttatttcttcttgggagaagctgtgactgacatggggactgacattccagtgtctcctgtggagaattttggtgttggcatctttatgatgtctttggtgttacctatgccagttgacctggagcatgggattggtgaaataacatgggatattcaggggggcccctctcatttgtttggggctcagagtaagtttatgggctatcttggtattattataggtctgacttagaagatgtagacagggccaccttggtggggacctagtttagcagacatagcataggtccagacttcttctgcaggtgaaccacagggttcaaattcaccagcagtcacagagtttttgagactttaacttcctctgggacaattcaagctatctagagacccttgggattatatccagcctgactgtaggcttccggaagtggttgtagaataattatgcttctctgagactcaaatcccagaagagccctcaggataaccaaggacatgtctagggtcctctagtaactgaccagtgaaccttacggatgatgcctgagctttggggaaggagcgagatgggtaattagcaaagcatggcttcagctctcactgaaacagctcttgctgggtgcctgctgtattgtgaatgttatgggctgagagattcaaacaggccaattgacctggtaccaagtgaaaaggcaattagtcttttgttattccatcttggcaaacttctaaaggtcacacaggacaatgataaaaagaaaaatatcattttattaatgtggtttgtcagtgtatccaaatgatatagattaaatctatttttttaattgtacaggtaatgcatgctcattatagaaagtttaagaataaagataagcaaaaagaagaaaaaaattatctgtaattccacaactgcagggttaatgaggaatataatatttggtgtcttatacatgtatgtatttgacttttagaattttctttaaataagaatggaattaaactatactcaatcttgcagtgttctattacctgcttttttcacttatcaatgtaccctgaacatacagattagattttacaatgttcagtatgactatccagatatcttcctctgtggctcacatcgaagattctctcttaaaaattcctcattttctatctttggcatctagttatttgtaatgctttcaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcaggtaaggttggggaagggaaaacagagcaactttcttataaatttaagaagtgtgggaaaaaaggagtgtggcgtgacagaaagaatacagtgggttgtgtgtccttgggcaagccacaaccttcctggcctcaatgtccttggctgtgggaagggtttcaggctaataaacgactctacctacttcacaggtgtattatggtattcaaatgacatggtgttaagtttccatttgtctgtttattcagcaaatgttttattttgtatctgctatatacttgataatgtgctaggcatggggttatgaataaagttccctcgggtgcagtggctcacacctgtaatcccagcacttcgggatgccaaggtgggtggataacttgagctcaggagttccaggccagcctggtcaacatggtgaaaccctgtctctacaaaaaatacaaaaattagccaggcatggtggctcatacctgtagtcccaattattcaagaggctcaggcacgaggatcacttgagcctggcaggtcaaggctgcggtgagtcaagattgtgccactgcactccagcctaggtagcagagtgagtgtaggggtgggttgcccctacacacctgtgggtgtttctcataaggtgggacgagagatttggaaaagaaaaagacacagagacaaagtatagagaaagaaataaggggacccggggaaccagcgttcagcatatggaggagcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagttttgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcaggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacacgtttcagagagcacggggttgggggtaaggttatagattaacagaatctcaaggcagaagaatttttcttagcacataacaaaatggagtctcctatgtctacttctttctacacagacacagtaacaatctgatctctcttgcttttccccacagtgagaccctgtctcttaaaaaaaaaaaaaaagtaaaagaaagaaacggttcctaccttcaaggagctcgccttcaagtgggggaaatagccatggaaataacaattaaaaaaagtgcaacgacagagacatgcttgataataattagagaaaggggcaactggaagttgtgtggaaaaaaggagtaaagagaattaaagactttaaaatatagcatctagggcagatattcaggaacttgagccaaagtgcccctacctcttcagtaagatgtgaaggggagatatctgattgttcttcctgatgtgattgagtgttaagttattatgtttggggcctgaatggagaaacacctggatgcatgggggagttttctcttgaattggttctgtttggctggacaggttaagaaatatttctccaaatctttctctatttcaagtatccaagtcattctgtctctctgggatcataggaggacccaggggaggggtaagcactgatgggacattgggcccccctctttttcagggaggtaccccagaagtatcactctgactgcctgggaaaaatgaaattctcatgttcatcattggagtcacattttgctaacttttgactatttgtctgaaatcccatgaatgttccttaaaaggttgtttgttagggagaagaatccctgggagctattgaagctgtttaaaactctttgtaaacaacagcagtcacgggagagttttggacagggtaatgatcaatcagattttgcatattagaaagataatgatggcagcaatatggagggtgagttgatgggagaaatgcattaggctattgcagtagttcaggtgagatcacctgcactgtgggcagtgtcagtaagggatggataatttttcttctgataactttaagtgataagagagacaggaggtgatagatagagggagacatgaggtggatgttcttttttttcccccaagatgaagggtcctgaagcatgattataatatagggggaaggaaacaatgaatataaaggttaaaaatacagaaatatggctcttcagcttgaatattaaatagattttcctcatttatttcttctagtacttgaatagtcatgaatagaattagaaattgaggataggttcagatttttgggaggcttttgaagaagtgcataggactgaagtaaaagtgctatgattcttcacatcaggtacctaatatgttcataatattttagggatactgataggtaaagtgcctaaaaggaaatcagcactgtatatcatctcatttaatttcctgtaacaaccttttaacagataatatgagctccatgttacagatgaagaactgaggtatagagagattatataccttgctcaagatcacacagctaaaaagtggtagaacagggaaacaatgtgggcctttaactccagaactcatactgataactgctatgtttactgccacttaacactaggtattgagatttttttcctcctcaaatctgttgggcttgataggtttaaatgtgatgcttggtggtaattgtctggggtgagtggttagttaacttaatttttcttatagatttctcttctaaatagccctttggagttctacagttatagttcttcttgacaattacagcaatgttaaaatcttggaggaagggaatgtaggggaaatttggcagatgacagaacaaagcaggtaataatgtgagctttcaaattatacagtcctcaatttgaatcccagctgtgcaaactgctagatgtaagaccttggagaattttctagcatttgggccttaatttcctcatttgtaaaaattgttgtactagtgctcaatagtttctatgcccaataagaataatttgttacatgaataaagtataacttttcacagtcactatcatcaaatggcactttcagacaggaagctgaaattgcacctcaatgaccctagtggagctgcttccccctactccatgccctttaccccactccacctgatgttggccttcttgggttcattaaccctcaatctgagtgttcatgtgagtgcctactttccagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtaagattattaggtgatttttctctctttattaataagacattgggaactagttggagatgctgacttactaggggtgggggctgtatttgtctaatatgtttccatgtccacttaggcacttagtactttttggagactggtaagattggtggctgggactggtgctcatctctctctcacggcattcctcagataggtctcagcggacccaaggtgagggacttatgccccagggtggcctcagaactgatgtagcttttgagagatagccacattggggacaatttgagacccgagaaggtaaactggagctttttaggagcaaacaaatatcttagattagggaggcaaaatacagtagagtaggctctggagtcagacttgtaggcttgtgattgtggctttaccactcacaaaatgtatgactttgggcactctactaagcctctttaagtctcactttcttacctataaagtaagagtaataataggacctactccacctactccatttattgtgaacttcaatgagttaatccatgtgaggcccttagccagatgcatggtggattataatcactcagaattttggctactgattggttccttttcctgtggccaggaagggtctcatctacatttatttcctggtctctactcatagtgaatcaccatgtgcaggggatatgcctgggaatctatatttttgaaaagttttccataggggtctctcatatgcatgtctggtgaaggattactgccttaatagagaaataaaagagggtcataaatgtgttcagaaagaaggtgcagaagtagcaagagctctgtcctttccttaccactaactagtagataaggagaaagatgtgtgtgggtcttgacttcgtagtcatcttaacctcttttctagataggctttgcaggagaaggcagaaccaactgatgatgggtgggatgtgtcagaaggggaaaagggcagggactcaggattttgttttattttctccaaataggtcaaaccgtgtctcctcagtctgttccaactacaaatcttgaagtaaaaaatggagtgaattgtgaacatagtcctgtggatttaagcaaggtgagcagagtggtgggaagttggcttcaaggcctaaggttccttttagtggaatccagagtttaattgctggaatttgggtaaggtttagtgtttcaagactctttccctaagactagagccctttctgcataaaagggggcccatctctgcatgtcttttcccttctccttcagcctggatgaagctgactcaacagtttctttctccagattcaacatactgaaaactgggactagctgcttagaatcttccctaaaacagatctcttgatttttcaattatttttttggtacctgctctccagcagttccttctcacccccaggggttttgccaaaacaatattttggatatctatttagagacagatgtctcctaaaactaactcttggttgaagctctccttgaggactgtgactttggtatctgaggccttctgtagcagcagtgtctcactgcagcttatggtccaagccttggtctccctgcctccagcctctccttgctctggtctatctttgacactgtgtttctaaaacacagatagtgtcatatcacttcctctgctcataaggcttcccattttatttggaaaacctgaaacccccgacaaaacatttgagtgtttaaaaagggaaagaatgtgacccagagcttcagaaacatttctcttggaggaagcttgggggaatgggattgaaatcagaatacctgattttaaaatccgaacctataccttaaaagctctgtggtcccgggcaagtcaacttcacctctctgggtttcagatacttcattttttttttttctttaagtgggacgaatacaatctgtcatatcctccttctggggtttttgtaaggatcaaataaaataagaaaacatttgctaaccataaaatgacatatgagtgtaagatatattttaggtgatggggccaggtgcagtggctaacgcctgtaatctcagcacttttggaggctgaggcgggtggatcacatgaggccaggagtttgagactagactggcgaaaatggcaagaccccatctctactaaaaatacagaaaaattagctggacatggtggtgcatgcctgtaattccagctactagggagcctgaaacacaagaattgcttgaacctggcagcagagagctgtgagctgagattgcgccactgcactccagagtgggtgatgtagtgagactctgtctcaaaaaaaagtaaataaaaaatttaaaaacgatatttaaggtggtggttcccaagttgtcagatgtttcttttggactttcaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaaggtaaaggcaaagataaaactcatgcattctatccaaaattcaaatttatgtagtgctggtagaagaaaccacttaatactgaaatttagaattaattaattttaggaatggtgtttacaattcagcagaaaagccagatgtgctggtgtgtgcctctaattccagctactagagaggctgaggtgggggattacttgagcccaggagtttgagcctgcagtgagctagaatcctaggatagcaccatggcaccccagtgtgggtgacagagtgagaccctgtctttttaaaaaaaaaatcagcagtaatctcagaaaattgaggtatatttgattaaccaccatgaagaggaattctgagatttatttctaaggctatgactgcacagtatctatagccttggaaatagagaattgaagaccattcaaaggacatagcaagggccaataacttgttaaaataggaagccaagtcttatcttctcagttctgtagagccatattccaggggaacgtctctgaataaaggtatttgtttccctttgcacaattctggcatggtttgtatggtttgcagatatgcaaacatttgttcaaaaggctattcatgcgctctgaaggtggtgatgctggtgattcagagccctgctacttacagagagtattcagatgtccagaacacatttagactcctctgtaaggcttgatcatttcaacttccttatccctctcctctccccatcattttctgattagaacaataagtggaattcagacaaccttgaatttgcaccacagtgccatgttttgaaaaagcatcttttctacagctaggaattgtgtctatggaaaccctaagaaatgtaatcacattattgaatgatgccgcacaatagcttccaatgcccatagtggagctattattaggtcaaggcaactcaaagtgctccttcattactgtcttcttttttttttttgaaggtacagtgatgatttatgtacgataagagagagaaatcttatactgtttagagaggactaatggcacttctttatatttacttacataatttcctcctctgtgtgttttgccagatttttgtttatcttattgggtccagtagggaaaggtcagcagtaccatgagattggcagatccatggccaccatcatgacagatgaggtatgtgcaacttttgcttcagtcttccatctcataaatatttattgaatatttactctgtgccaggcaatatgctagttattggggataaaatactttccattgcaatatctgctgggaagtagttcagggtacttctctgagagcccagtgtggaaggaccaagctctagaggatttttcttcctatgttatctctccttttttgagtaatcaagaatgcagagaaatctttttctggggaaactattattgccaagtaggatatatagagaaatatattaaggttggcttaactttcaagagaagatggttaattaaatacattcaagctatttacataaagaaacctcactcctgttccactaaatgagaccagtttgtataaggtcatgggtgtgacctcaggcagtgtagtgtgaatgtcttgactagtctgtaccaaaacaaccagatattttgacattttgacattgaacccacagtgcatactctggtaaggactgcactgctcggtaagctgcaaagtagggctttcaaggcatatgccttaggcggcagagggaggtgtggcctgttttttatcagctttctttgattgagaggcttaattcaggaaggaccttcattagtaattccatccagtgtttccaacctttaagatcaagaaaatttccctctcaacgtgggaaagctgattaaaattttttttttcatatatcttgcctttccttccatcctttgtggagataacataattgtacaactttagactcatgtcttatctcttcttatactagcagacatgtatttagttcttttaatgcatctcatttccacgcttgttttttaaatccttttatccttgcacttctctaagtgctaaagttttctgcatctcagatccccgtgacagagataaaaatcaacaggttgtattcatttttcaccatatccattggtgattgtttcatgtaaagttacttttaactttcctgagggttttctcttctctgtagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggtaatgtatgcacatcagccaatgtggctattgtcacttactgactgcccaccatggacaaagcaaagaccatgtgggtatatgctaaatatatcaagatgcagctctgttttggtgcacctagaatatcaaaacaataataaaaatgaatctgggctgggtgtggtggctcacacctgtaatctcagcactttgggacgccgaggcaggtagatcacctgaggtcaggagtttgagaccagcctggccaacatggtgaaaccccatctctactaaaaatacaaaaattagctgggcgtggtggtgggtgcctataatcccagctacttgggaggctgaggcaggagaatcgcttgaacccgggaggcggaggatgtagtaagctgagatggtgtcactgcattccagcttgggtgacagagcgagactccacctcaaaaaaaaaaaaaaaaagaatttgcatagcataaattggctcaggtgtgatggggtcagtcaggattacctgggaatgaattttaagccaaattttgaaggaataatgtgaaatagaagagagaagggagaacatttcttgtgactacattgtatacaagtcatcaaatgaaaaaagcaagttatatagagagagcagatagaatgtctgatatttttctgacatattagagatgggaaaggaactcctactgtgtattagacagcagccaggtgctttatatatgcaaattcagccttcccaggaacatccctcaaaagatattgttatctctagttttacaaaatgaggaataaaactgtcttctagggcaagattttaaggtaaagtaagattacacagaggcagatatgaaactggaacttaggtcatatctaatgccaaagccccatttttctctttctaggcaaggcttagttaggagtcaggtactatggaacaggaagagaaattatggggtgtgtgtgtgtgtgtgtgtgtgtgtgtgtgtgtgtgtgtttcggtaaagtcaataaactgcatcaagtcagtaagtgtatttgaaagctacaaacacgggcatttttggttgcttttgggttatcccattcccactccctgctgatagcaggacgaaaagatagatgttacctttactaattttgtggtcttctgttaaaaggagaaaaggaaaatgcctggagttccaaatggaaatgtttgccacatagaacaggaaccacatgggggtcacagtgggccagaacttcagcgcactgggcggtaagtcctgggacgtttcacagcgatgctgcttattgggtagaagttatgcaaaggaatgaggcatcttctttctttcagcctacttctctgtggtgggaatttattggctgaagaatgacttttcaaatggaaccactgactagaagtattatgaatatatcaaatatcgtattcattcattcaagtttctcaaatcacctaccatgttttgtctcacctccagtccttcctaccattgttccctctgatttgaacactcttccctttcctcatctcctggctaactcctacgtacccttagtctcggttcttgtgtcacttcctttggaaagccttctaggactctctctggatgaggttaggtgttcctgctatgtaatatcacagtattgagctctgaccctcccttccccacattacagcctttatcatacttcattattattggttgatctattgtcttttctgctaggctgtttattccaaaagggcagaggctctattatattcctaggacccagcacagtgccctgaacagagtaggctctcaatgtctgccaaatgaatgaatatttttagaataatgtctgttctgtagcatggaatggactaggtatgataaatgttgagtgatcattttaggttaagaaactcccttagggtaggaagataggtactattttaggtgtgtgtgcctcagaataggcaatctactcttctaggccaacattttaaggacagatgtccaaggaggaggtaagtgagggaagcaggtccccagagtaggaggttttattccctaggtcagaaggtggtaaacgagaatgatattttgggttagtgtgatatccaggggtgtccccagagaaggttgagactatggctctgtctctgttaagctgtgctgtgtctaagaaggttctgctgggtagagattctcagggcaggactgagatcatggaaattagcttttatgtcctctaaccccttgctttcttcttttctgcctccttgcttgaggttgctttccttactcttctatcctcagcactctacccagtggaaactcagagttgttttggaattgtggaaagcattttatttttccaatcttggaaattcagggagaaaccaggagaggagacagaaacaggagagaatggcacttgactagcagtgtcctgcagagaagcatgttttctggtaggaagaatgtattggagggtaggggaagatagctgtgctctgggagggagcattggtggaaagaaggagtccttgcaatggaagggccactgaaaaggggaagcagccttccctttttaaaaaacattttctttaaagttgggagagatctgaattgggtggggaggcctggtattgagaggcagttcaagggaagcatatgtcctcagaaggggttccaggattgagactgtcctagaggaggtggtaatttttttcaggaaaaggttttgagtatggatttgatatttcaaaattataatttatcttttggatataaagggtgtccacactttaggaacttagaatttgaaagtagtagaatttagggcaacaaggttttcctcaaaccaatatctgtgcagagatgagattttaggttgctctttgtgccaaagaaaacaaatagattagcatcccaggctttgtgagaggtggtcacttataatcaattccacctgagggtttgggagaccattatattggatctcaacagttataagatcttggtaatggtgtctgatgtccccaagaaaatcccatattgccaggatcatcatattcttattcacaaaccgcaagtatcttaactcacaaattcaaatggagtttgaaggagttctcccataatgtcatgtcaggaacttctggaattgacaaagctaaaaggaagctctgggctcagagcttagctctgcttgatatgggagatgcttcctctttctgagcttctgtcatttttcttagagcccttagtaaagggcctcaagccatatgaccttcctcccattgtagccccttaggcaaggtgacataatggctgcatagagaatcacatttccaggccagctctggcctctttctcagtctcaaattatgtgggaggtaaatgtgagtcttttttgtatatggacatcctataagtttctgtactttcctggactgcacaaactaaaaccacattagtctgggttttataatttttcggactattagttgtgtttcttggagatgcaaaactgctttatgcttgtcatgttgcacaaccttggagcaagacttggataacatcttacggaatgttatccttgttggatggagaagtatttgaaggcagggtgaagtagactctaagaagatgggaaaggagacaaaattgaaatggtactctgagttctgtatgatctgaccctccaagccagggttaagacagatcttaaacctccctgatattgactaaggcagggatgccataagtaacaaagaaggaaatatgactagagtgttcctaggccggaagctccacagcaaggagggtgctctggaaaggggtttttcagggtatatttctgtcccttattggggatgccacttttgggaagggttaatggaaaaaagaatcaggagctgctatctcgatgatccccccacacttcaaacaggtttcttccaaagtataccagacaaatggatggctggcctgtttctaaagccctccagggaagggctccttaagtcaatgctccagagcctagtgaccctctacgcgggtaagtcctctcttgcatcaaacttattaaactcatatccctgtgtgcctcctgccccagaaaacttgaatgtgaagggcagtgttgaaagggaaaggaaatcccaagtacagaaagaagcatccatgcctgatgaatatctgttgtagatgtgcaatcatagtctgattttatgcatgaatgaggtatgaggctgactccataaagtgttcagaaattattttattaatttatagttataccatccatatgagcctcagatctttccccgccttttaataactgctagactgacagatgtcttccctttctatggcttcttagaaatccatttcacataaatcttttgtctgttgctcacagacactcctgtcctcctgtgtctaggggctgagtattcattgcagcatctcaggtagcctcagagtatgtgtgtgtgtgtgtgtgtgtgtatgtgtgtatgtgtgtgtagggggtcactattatgcagggatattttctcacagaattatgctttccagaggaaggtgactggtaatgaagaggtaataatcgcatggtaataagatgctatgttagctaagaacccaggaatacttgagtcttgccccagataaattattgctgcctgcaaggttattgaggggctatttacctagaggagaaagcaagacaaagtgacactttattactaactgaagcattggtcccaaaccctgaagcagaattcatgatttaggctagaccatgtagatagcttctttacctgagctaggtttgccagataggctaaaactaaggcaggtcacaaggctggctttgcttctcttccctaagcccagacccagattatgatgttactgctgtaagctgaggaaaggtgaatcccaactatacccaccagaaccagaggaaaagagcaggtgggtgtctgtcctgtgtccacctggatacccattatactagctagatgagagagagtgttccaggagaaagagctggctggatcttctcccctagcatacagatcccaggcctcctcatactcctccaggcttctaggtgacagaaggaaagaaagagcttgccaagcctccttccgtgagagagtagcttgtgtgttttttaaaaatagctttttattatagaaaatttcaaacatataaaaaaaagggagaatagtttaatgaacccccatgtacccatcaactattaccaacattttgccaatcttgtttcatctatttcttctcacttaattttatttttatgttttctagattattttaaaccaaatcaccgacatacattttacctgtaaatacttcagtatgcatctctttaattaggacattaaaaaaattatcatgccattatcaaatctaacaaaattaacaatcattctttacattgtctaatgctcagttcttattaaactttttatgattgtgttagcaacatctttttagagttcatttgtttgacataggagtcaaagtttgcatttggttattatgttcccattctgtaatagtcccttttcctttttttctatgccatttattggtagaagaagccaggtgatttgtgctataaaatgccgagtggctctttttgttattcacctgacagccctcaccctggtgcagtgactccactcttagaaaaagtgattgaattgggaacacatctcctccttagggatattttggtcttggtctgtctcatctttgagaagaggagaggggccctgaagtcctgccaccaagtcctgttgattctacctcctgattagctcttgaatccatccacttctcatcctaatctatgctccattcattatactaccacagagtggtccttccagaatgtatgtttgattatgtcactcttctgtttatagttcttcagtaacttgacatgctattaggataaagttttaattccttaaaaccatttctggccgggtgtggtggctcatgcctgtaatcccagcactttgggaggccaaggcgagcagatcatgaggtcaggaggtcgagaccatcctggctaacacggtgaaaccccgactctactaaaactacaaaaaaattagccgggcatggtggcaggtgcctgcagtcccagctactcgggaggctgaggcaggagaatggtgtgaacccaggaggcggagcttgcagtgaccagagatggcgccactgcactccaacctgggcaacagagtgagactccgtctcaaaaaaatatataaaaataatgaataaaaccattttttaaggcctttttgacttagcttctccagccttgtctattggcattcacccttcacactgtattatccactcatatctctcagcaccttgatccaccaagcactctcacctctaagtgtcacccatgttggcccctctgcctcatctgcttaactcccagtccctgcctgaagtcatggctgaaatgcccctccctgctctatgccaccatagcaccctcacaatactgcctgtctcctgcactagacttggtcctggagagcagggctgttcatgtcttgctcattgccgcatctccagtacctggcacagtgcttggcaccaagtatctgctgctacttgtcaattgcatgaatgaattattatatacatttctcacaagtaaggggggtagttgttcagagtaagaaagtacatgtgataggggcttttttatctagaaaacatttaataaaactagtaattttaataccttaagttggttttgcacatttcctcctaacagctcagaatttaaagtctgaagctaatacttgctttcgtgttaatttttttgaactttttattgaatggataatacgcatatctaaattaattctttgtatgtttaggatattcattcaaatttacctaagtcatacccttggttgcaaagagactctctgctgacctaagagagttatctgtactggggtcaaactgaagccaaagtcttaccgctgaacagagcacatttgaaatgctttcaaatgtgtgctgtttacatgcttttagggaagacggactgtgttagaagcctgtctgttgtgtttccacaggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcatagtaaggacttttaaccacttctaatgatcccaaacaagacctaaaatattgtggcggcagccaggtccaccgtgggggaaattacttggtctaggactgaagagattggatttttcctctgaattaccatggtcttctgacatcacaccaaagagcaacacagtcctctctttagaacagactcttctgcttgaacatcagcttcagtagctggttgcccagttgaattttctgttgcctcagtgatggaaaatggatatattgatgccatttcaaaataagatttaaaatgactctgtatgtgagcttgtagtgtgaatggtatcactgtgctttctgtatattttcaaatactgaattgagtcactgaagaataggagttagttaaggaatcatgtgtcaatggagctgggcacctgaattattaaagtagtatctgtttacaggagtattacatggtgtgtacacatcactcttgctaagatgaaatacaagcaaatggccatcaaggcacacaggagagcaaagtcaggaatgtagctaagccaacattactctgtactgatgggctatggactcagtgatgactttttttcctctcagagtgcaattgaatccttgtttggagcttccatgactgggattgcttattccttgtttgcgggacaggctctcaccatcctgggaagtactggaccagtgcttgtgtttgaaaagattttgttcaaattctgcaagtaagacatttgtttttctgaaaactctaaccagatttagtgattatgctgccaggattaaatgtcagggttctactcagtacagacaggcaatatcattttggattgtaagaaacctgaaaggagaccatcatttggtctgttgtcctgcccccgggtagcaccatacccaaaatagcagatctcctattgttaaagagcttgattaatattcctcagccattattgaagtcttgactttttatctttaaaaagactttccctagctaattcaaacttctccatttccattgtgagtcaatttttaatttggcctaatatcctccccctgctgtttttttttgttttgttttgtttttttgctattgatagtggggcacaagagtgctctggtttccctaattttcctatacaatcttttcttttttccttttatatttcaagtagcagctcatgggactatggccagcccctttttttcttaactgcaagaataagatcataattacattaggtagtaatggcaggaatgtatatgagacaatttctttttttagttttcgtatccttgcgcatatcctgtgaggcaaatctgtatcataactgtgccagagcactatttagaaggaaaatacaatcagaattagggataaactgggttccagtgctcgtttagatgaaatgaattaaccacatttctgactccttgtctcttaatgccatccatccatgcgttctgatgaactttggtcttgtttcagagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattagtaagtgtgctttctgcttatttttaaaaattgagcaaagggcctgagtttaattgctgatgtagagtgctaggcagtgcttacagcttctggtcaagaagtgtcttgccctttaggaaacggatctcagatacagacaaggagtattggagggctgccagaggagaacaatcaaaagtgttgacagagaagatcgactagaagtgaaacacgaaggggactcaagaaatgctttccagaccatgtcttttggttctaggcactgaaacaaaaatgggctgcaaatgtagcagggagaatttgagttagttatggggaggaacttctttttgcaaggactttgtgagcctctggactatgttatcaagtgagagaatggactctgtcctttgttgaaatgaaggactctctttctctgaaagtatgtacaggcaactcttaggaattattaggtgaagatatattaatcattcctttcagatccagaagtgtctcacactgtatcataaagatccaggagcctacttacttcctagatttcaacttaagagattatgatttctttatgtgttcaatatggtttggatcacttggaaaagaaacacggtacctggctgtgttttcaaccatctaggacactctggtcctataaacatttcttctctggaatagtattctccaaattatgactaaagatcctcttcccttagctctgtacatcaagttctggctgtacagttctgatgtggaggatctggttgtgaaatgaacaacttcagtctgaaactgtctcagaagagagagtacactttctggaggcatctgcggaccagcgacagatacactttcatctattctagttattcactcattaaccttttaaaaatcagaattaataaaaaatttattagaactttattttactagaaagtaacaatgattagggagtatcatcttcaaagcctagtgaattggctcctattggcattagagttctcatttctgtaaggttgattctttgacctctttttatcattattttctttgtttaacaaatatttattgagcacctattatgtaccaagcaccattttaggccttggaaacgcagtggcaaacatgacaaaggatctgtctttatgaggcttatatctgagaagacaggcaaagtgaccagccccggattgagtagactttggttccagaaacaaattctttgttaataaagctcaagatgatatttttttttagttgcattctactgttatttcatatggtgctgatgtgaagctagaactccttaactctttaaatgattttatgttaatatgtatgtaattgatttttaaaaaatagagtttattttttaaagcagttttaggttcacagcaaagttgaacagcaagtacagagagttagcatataccccctaccccagcacacacacagtctcccccaatatcaatatcccacaccggagtggtaagtttgttacaatcagtgaacctacacagacacatcattgccacccaaagtccatagattacattagagttgactcttggtgttgtacattctatggattttgataaatgtataatgacatgtatcctccattataatatcatacagaatactttcacttccttaaaaatctcctgtgctctgccagttgctctctccctacccccaactcctaacaactactgacctttttatgtccttatagttttgaattttccagaatatcatagttggaatcatacagtacgtagccttttcagattggcttctttcactttgtaatatgcatttaaggtcctctgttttttcatggcttggtggttcatttcttcttagtactgaataatattccattgtctggatgtaccacagtttaattatttggaattgatttttttaaacctaagtatagggctttatagctttccctattacttttcgttttgtcaatttcttcctattattctaacctgtcgagagctttttgaattttaattcagtcatgccgtatcttagaaggcatgcttattaaattcacagaccatacaaagttagtggtgttggctgtgtcagttgaccatattgggagccaggtcaggcatgaagcatgctgggactgggaggcaacatggtggccaatggcacaggtgtggtctggtctggtctggtttggctggagtaggaggcctggggaagctaatggagtttctaggtctggctctaccatgagcggccagggaatggccaaggtagtggggtattaccaaagataactcagtgtcagaaagtgcttacatcacgattccaggagactctgacttttagaacaagagcatgacgaagggtatagagaataagatattcaggcttggaagaagttattgagaagtaagtgggatatcgagacctccttgctatgtagactaaatttcatagcaagagcctaagagatagaaatcgggcaaaaacaaaaacaaaaacaaaacaaaaacaaaaacaaaaaacaaaacaaccaatcaagactcattctgggcacatcagatgccaaatgtggttatcagcacagtttaatccaagacccatgggctgatttgagtcaaacttttgtaatgactgactgaaaaattagaatgtgatggggcctacagaggggcctcagctcctcaggtctgaagtatgcaaagaagcagcaaggcagctcctgacagcctttaaaccagttgttctaaaaacatttaactgagtatttggctgttttcctcaggaatctttttaatttttcccctcagctgcaggtgtactctgccagagaatccaaacaatcacaccctccagtactggaaggaccacaacatcgtgacagcagaagtccactgggctaacctgactgtcagtgtaagtctgggagctgccagatgtcctagcattgtgaccacaggtttaggagggacttctaagtgaaggggaggagtagccctttggccaaactctggcatttaccgaaataaagctttttaaaaaacaattcttactcactttcttttatcctttcagaatttttcttgtatgttaagggagaagattacccttctcttttctcccccctacatcctacccagtgaccctgcactaaggataggtggggatgaaaccatgcaggacagggggcagatccagacatgtagggttgaagaatgttcaagtttggaggtcctctgtgataagaaaaatataagttgccagggtccttccagagccttggaagtagtattgttcagaacagttctatgtcttaggaccataagtaaccaccctacttgaaagtggcctgtgcaagacagcaccccgcaactgcataaaggtcaaggggatgctgcttgcagcctctgctcccaacaaccatgggatgacaatgagtggtggactcagtaggaaacagctatttatttggttgtgtctgcctttcatcacccagaatgcttattcctccaggaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtaggtagcatgttcatgcatttctttcacgttagaatcaaatataacagaaccttttctcagccttcatgctgcttatggggttgattggccaggtggagaactccagatgtcctgatgagccacactggcattctctcctagtgtctggcagcctctttcatagatctgtggttgggaatgaagggttaatacttaaaacctttttggtttacaagtgccagttaaggttaaggtggtagtgatggttttttaaaagttattaagtcttatttccagaatgctgttacgtttcatttccagaattctgagacacttaacacacaatagctacagctggctcctgaatacagtaaattgtcattgtgaccttggatactttaggggacccaaaaatcttctcccagggatggcttttttaatagcttatgaaatcactggcgacactgactgcagcaaccagcatgctcctgacttagtttgtatgactgtttgaaacctcagcaacctttccatgatgcagatagcattgtttgtattatgagcaaggcttttgccagttttggcagggcaagattagaggctgagtgtggagtagctacatgggccatttctttgaaagggaacttgagaaggtggagaatggctactgggacctcatcacagaaagttaacactgaaaagaataagtgcatgaattatttacatccttcagtcacatggaaacatctataataaatgaccattacatttgccatatcaaaaatataaaaggaaggtgggtgatctacagtgaccacaaagtttgtgccacagaagggccccctgaaggcctgggttacatgtacttttaccacagtataccaagctaaacctcaaacatacgaatcagtgagaagaagccacatacctttttaatttgccaaaaagttagaacagccagatatgaagaaatacattgtgtatttgtagtttatttaaagaatacactcatgctgggcgtggtggctcacacctgtaatcccagcactttgggaggcccaggcgggtggatcatctgaggtcaggagtttgataccagcctggccaacatgctgaaacccatctctactaaaaaaacaaaagttagttgggcatggtagcacatgcctgtaatcccagctactcgggaggctgaggcatgagaatcaattgaacccagaaggtggaggttgtagtgagctgtgattgcaccactgcactccagcctgggcgacagagtgagactctgtctcaaaaataaaaaagttaaaaaaaaaaagagcacagtcatttgatgccttctgatatagaactgagaagaaattcatattagtgatgatacactattgtagatagttttaataaatgtttaaggagaagataatataaaaaagggtgttcattttgctggcgagagatctaccatcagtacatcaaaaatggggatgtgctcccagtcctctattgggggataggtgctagtggccttcagagaaacctatttatgtggccagtggtgtggccttacctgcagtaaataaaaaaccttcttggtgtttcatatagaaaatcagccattgggcggggcattatttacggcatttttttttcattgcacacaataatttctgacctatacatgtataatacagcattttcttgtttttctttttcttttctttttttttttttttttctgagatggagtcttgctatgttccccaggctggagtgcgatggtacaatcttggctcaccacaacctctgcctcccgggttcaagtggttcttctgcctcagcctccaaagtagctgggattgcaggcacttaccatgcctggctaattttgtatttttagtagagacggggtttctccatgttggttaggctggtctcgaactcccaacctcaggtgatccgcctgcctcagcctcccaaagtgctgggattataggggtgagccaccatgcccaaccaatacagcattttccataaaatatatttttaatttaaatcatacaaaaattcataatatgattttgtgaatgtgtgtgaaagtgtgagacctttacatttcactacaaaacctgtgatggtttggtttttaaaggctaaacggttggtattaagcaagtaaatattttaatgaaactataactcaggaacagtttaaaatattagtttcccacttagatttcaaggcataaaaagggctgagtttatccctttaagtgctgtcaagaattcacttgggtttgtgatatttggtggtacaatgccaaatgcccacagcagcattatattgtactttgccaaaggtagacagaggaattctctatttctcagcagtcgtttccccaaaaagtataatgtttatttttagttaaaatagtcttgttttaccataccacatgatgactccctggaagttatcatgtgaagttccccaaattagtattttctcatctctgagctctttgcctgactccatttctacatttttcaggggccagaggctcatctctgccatttttccatgtatcgcctcctgatttgacttcactgattatctgctgtgactagcagtgttattttggatactttaagaatttcagatatggccaggcatggtggcttacatctgtaatcccagcattttaagggaggccgaggtaggtggatcaccggaggtcaggagtttgagaccagcctggctaacatggcaaaacgctttctctactaaaaatacaaaaattagctgggcatgggccgggcgcagtggctcacgcctgtaatcccagaacttgggaggccgagatgggcagatcacgaggtcaggagatcgagaccatcctggctaacatggtgaaaccctgtctctactaaaaatacaaaaaattagctgggcatggtggcgggcgcctctagtcccagctactcgggaggctgaggcaggagaatggcatgaacctgagaggcggaggttgcagtgagccaagatcgtgccactgcactccagcctgggggacagagcgaaactccgtctcaaaaaaaaaaaaaaaattagctgggcatgctggcaggtgcctgtaatcccatctactttggaggctgaggcaggagaatcacttgaactcgggaggtggaggttacagtgagccgagatcactctactgcactccagcctgggcaacagagcgagactccatcttaaaaaaaaaaaatttcagacgcaaagaaactttatatgatattataaaagacagtcctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattactcagtcgaatgaaacaggatttattgctgtctgcttaacatatatttgtttggttgaaaggatttttccagaaactgtaggaaaatgaagcagaatcaactgggtgaaatatagtacaaacattggattaggatgtggtgaattgtgaacaatcaggattctggttgtgactggggcccctgtctcataggagcttaataccatgtgagccagggacgcagtgtccaaggcccatggcctggagacctggatgctggctgtggaccttgggcaagtccctcatcttccctgtgcctcacctcatctgcacaatgatgtgatgacacctgccatctctttccaattatgcttcaaggatgcagtgagatttgatatgatgacccaagagtagaaggtggtgtgccatggtgtgtcctagtttagcatgctccctgccttctcttctctgacattttattcaatttgggaacagatgggattggcaggaggggagctcatggtgtagtaatactctactaaagtgtgcctattggtattaccttctaatgttgagttggatttcctaaagcagcccactttgttactgaagttgctgactcctgtggaaatccccatactaagcagccttacaaaatccagtccccatagaataatgactccacacaggcgtcaaaaatggattgtcttcaattatgttacaaagcaaacacctttttgggggatggaggatgattgggtgtttggattgaaatgtagacaaaggggctgggtgcggtggctcatggctataatcccagcactttgggaggccaaggtgggtggattgcttgaagccaggagttccagaccagtctggccaacatggtgaaaccccatctctactaaaaatacaaaaattagctgggcgtggtggtgcatgactgtaatccccactactgggttgaggcacgagaattgcttgagcccaggaggtggaggttgcagtgagctgagatcgtgccactgcattccagcctgggcgacagagtgagacttggtctcaaaaaaaaaaaaaaaaagaaatgtggacaaatatagctagcaagtgtattttgagcaaaatacatattttataataaaattttataaataaactttgtaaaatcaatggtataaaatcaatatttaagattataggctatatgttacttaatttcattaaatagaaaaagaaattcagcccttctgatgcnnnnnnnnnnnnnnnnnnnnagggctgtttctacaaggccaagttttgtataaatggaatttttttttttttttttttcagatggagtcttgctctgtcgcctggctggagtgcggtggtgtgatcttggctcactgcaacctccgcctcctcccgagtagctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaactggagcaaataatggatttctttcttgcttaaaatgtatttatatgtatgtcttattatatacaaggcagatttccctggaataaaagtctagaatgtactgcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccatttgtatggaatcccaatgaatgtatctttggaaaacataatgtgtcaaaatttgtattttgttcattgatctaaatgcccgtgtaactaatcagaaatccaatttggctcagattgggaattttcttttaaaggaaaaaaatttacagaaaagactactggaagaatcatgttcaaatgacatttcacatcaatgtttcttcaatattttggagttgacttggttgttttctcctacctacaatagaatgtgcctgctgtttctctgtcgctcactttgggcttgcaggaagtacaacgggaatagcctgagcttcttgctccctgtataatttattcactttacctgaactgccttacctgcagttcatagtgagaacacctgggcttgtaacttgcctccacttttaagtgtgatagggccaagttgctttacctctctgggcgtttttctttaaaacgaatgggttaaactagatgagctcagaagtcccttcctgccctaacattatcttctatttttattttcctgtggttactactattagggtcagacatgtgaaatgtgagggaccatttagagatttagatgttatatttttggattattacagagtatacacccaagtttaggacctgtgtcatttttagtgtccccaccccgtttctatttctgttccatttgtctttactttctttgtaatcatctcattttttttccactcttgaaactcacaactttccagtccatgagcaactttgctaccatccccctcaaaaacaaatctatttaaaacaccctcctagaaaagcctctgaaccaccttcagctaaatctgtaacgtttatagaatattttaaaatcttaattcagctagagttatgatccccaaacaagtgctgacgaagctatcacagaaatgatgtctttttcaccttgtaggtatcattgttgctaaatcacatcagtacaggccttctgtggggagacagcagggggcaggggcaggactaggggatgggagtagataaaactgtgattctatcctttactttaggtaaaaaatcctaggttatgaaacaaggttctgggccaagcacagtggctcaggcctgtaatcccagcactttgggaagttgaggcgggcagatcgcttgagcccaggaatttgagaccagcctgggcaacatggcaaaaccctatctctacaaagtatatataaaaaaaaaaaattagccaggcgtggtggtgtgtgatagtagtcccagctactcaggaaggctgaggtggaaggatcacttgaggccagggaggtcaaagctgtagtgagctgtgatgatgttactgcactccagcctgggcaacagagtgacacctgctcaaaaacaaaacaaaaccaaaaaaaacaaagttctctactcttaagttggtatataagatgacctgcacagtgtcacagagatttcccactcagtaaatcactctgaaagagtttgcataagattctgtagatttgcagtatttaatgtggatagtcaatagctacatgtggcaaatggccacttgaaatttggcttgccaaattgagactgtactgtacacataaaatatataccagatcttgaaggattggtaccagaaaagaatataaaacgtttcatcaatattttatattgattacatactgaaatgacaatattttagatatatcgattaaataaaataataatttgataaatataattatttcacttatttttatattttttatgtggctactaaaaaatttaaaattagacataggggtaacgtacttctttgttttttgagacagagtctcactctgtcgcccaggctgagtacagtggcacaatctcggctcactccaacctccacctccttgggttcaagtgattctcctgcctcagcctcctgtgtagccgggattacaagtgtgcaccaccatgtctagctaatttttctatttttagtagtgacagagtttcaccgtgttggccaggctggtctcgaattcctgacctcaagtgatccacccacgtcagcctcccaaagtgctgggattacaggcgtgagccaccgtgcctggcctggctaatgtaattctattggacatgctactctacacttacatggtttggggtaggcagtgaaataccataggtagaaaaggtaattcagtgaagcatccaaatagacagaaacaacacaaatatttttgctggagtcaggagcactatgtggcacagaacacctcccagaaagcagaaaatttttctgcctgaaaaccaatgtatatgtaagaccccaagtaaaaaacaaaagcaaatgagccccaaactgtcttccctcagctttgcctgggagctgctatctttgcacttatttttctagcatcaggatattagccacatgagggagccaagcatatttgtctcattttaggcatcattcttttgtggttccccccaccccaggtattgttgagtctgtccaaagctgggtgagataccacacaagtcttgcttccctcagtgtgctgcttctctcggccttggtggaggctgagcctgttgccggtacccaccagcccagtaggttttgatgctgcctcctgaaagagattgtatttgtttcgttttgcactagtcacagttgttgtttaaactacatcaaatttggggggagaatatttgcctgtgatggaaagagagatagatgagttattgcttcaagtgttttaaaataaaagctattctcacacacaaaaaaaaaaaaagaaagaaaaagaaaagaaagggagctcaaatcaggaggaaatggtggtttttcctgtaagtgaggtttcagccagacacattttctttttctttttttcttttttctttttttttttaagtcagtagtggtttattaaatggttgtatcacatctggaaaacattattcaaaacatttattcagcgtacttcctgttcatattttagaagatgtaaagcaatgaaatttgctctaaataaatggcattttttttgccattatttggcatcttgccaggttactttttacatccaagttcaagtgatattttgttctcaaaataaaataattttcaaggtttggaagtataatgcgaaaattttaacagggattcttttttttttaattatactttaagttctagggtacatgtgcacaatgtgcaggtttgttacatatgtatacatgtgccatgttggtgtgctgcacccattacctcatcatttacattaggtatatctcctaatgttatccctccctgctccccccaccccacaacaggccccggtgtgtgatgttccccatcctgtgtccaagtgttctcattgttcagttcccacctatgagtgagaacatgcggtgtttggttttctgtccttgtgatagtttgctcagaatgatggtttccagcttcattcatgtccctacaaaggacatgaactcatccttttttatcagccaggcacattttcaatacagggtacataaatgggaggactcagttaattagatatttagtgtacacccatatatgactagaacacattcttagacttcagtgagcctacatggcagtcacgggaggtacatattaagtaagttctgggtctttgtttcctgctaggacaaatagttaacaagtggctgttctgtactgactacttgctcaggcctgggttaagtgctagggaggtgcaacagaaacttaaaagatagtatctgtcatcagataggaaggaaaaacacatgaaacaatcagatgctatatgcaaagtagtaaacagttggatgtcccctgggatgtacgtgccgtaggagttcagaggagaaaagggccactgggccccaggatggtcaagtgggcttcatgttggggatggggaggcagtggatactcagagaatttatattgcattcagagaagaactaacaaaaccatggaggaggaactggaaaccttgggcttcaaagcaaagtgaagtcaggctaaggtaccggtgatattacgtgtggctaagatatgttttgctctcactcttttggaagcttagattaaggcaggcacgggtcatttgccaggtactgtattttattaaagccacactataaagtgaggcagtccttttatgatggatcctaaattggatgggaatctccaacaaaatagagatatgtgccatggaggaaaataaagcagtaaagaagtacaggaagtgctggggtggagggaggtggccaattttaagtggtatcatcagagaagagctcaaagagaaggtgatatttgagttgaacctaaaagacgtgagggagctgcccaagaggttacctggaggaaaggcatgttaggtagaggcatgaacaagtacaaataccccgaggtgggagtgagcttggcatgtttaaggaaacagcaacgcagtctgtgtgtttggagcagagtgggcaagcaggagagcaataagagctggggtggggagatgtgatgatgccaattgtgtggccctcataggccaagaaggccttttgaccagaagccatttcagggttttgatagaggagtgacatgacccaacttatgtttcaaataattactccagtgactgcatttaaaaaacactgcagggcaaaggcagaagcaagttaggaggctgctaccattacctgaacaggagctggtggtgacttggatctgggtgggagcagtggcggtggtaagaagtgatcagactcgggatatgttctgaagggagagccaataggacttgcaaatagactggctattgggtatgagggagaagtggagttgatgctgctgctgaggtttttggctagcactgaggaccttggctgatcccagaaaatccaagttctcagaactagagtcccaacctggccctaaatgtcccaaacagaactcttcagaggatggtctgggttatgttagcatttgtcagagggttcattctccctcatcatatccacactttatgagcatcagttgggcaattaacatattcctgttgtttaaatttgcttgcattaattcaactgtaagatgaaaacattcttctgaggatttttaagccttttacaatactaacctcttttctactgtatttaacctgccaaaacatgtgtccacttctttctcatgccaggtacgctccatggtgagtgactttgctgttttcctcactatcttcacaatggtgattattgattttttgattggagtcccatcaccaaagcttcaagttcccagtgtgttcaaggtaaacagatctcagagtacttggtgcactcatgtaatttcatacattctgatgccaagtaaatttcaaaggccttttcatatcctaatcctgagttttacagtcccctaaatctgaaccttgctcctcataccttgtcatttagaaaagcaaacttcagacttggttgaattcaagacagaaaagccagagaacagaaaaaccaaggttgtttaatgaatgaaaagtattattattattgttattaataccacttactgttcttaatatgttaatatttaaacaatggaatgtgcacatttacataaatatattcaagacactgtggaaacatgggtctctggaacaagcctcgttaacagcactttcattgagcatcagctgtataagggcactgggaagaatgaaaaaggtaaaggacttggcctgaaccttcaaggatggtgccccttccttgaagggggagaatggaactgagaggagcctcatcaggagtctagggcccctgccggagtaatcatgacatctctttcgaaatcatctcaatctgatttcattgtttgtataactctctctaatatatggtatttttcaagaaactatacaaaaagtcaaacaaatgatcaatacatggggactccaaatagatttcagtttgggagcactgactaagtagacaaagaagatagaaaagctgagctcagttctatagagccccatagggtgaggggagagaaaatctgtgcgtactcagtgacttaagaagaattatgaaggaggaaagtgggagaagttggtgaggagaaggccgacaggaataaaggcagtccctgacttgcaaatgctcccttcagttgtccctttcctttctcttttttctctctacccatgaagtaggcctgttgaaataccttcttccatattgtctgaaaatttttaattttgttgaatttgctgaaatgccaccagttggaagtttatggactaaccaatccctcttgtaagtataataccttctagaatatggcattcttgcctttgtgtgaatgagcacaatcagctttctctctaatacctagctgagatcagtgctgcaggaggaatggattttgtctaaaaataggtaatatgggaacattaagcggtccttggaaaggttccaaagggataggcctaagatagtcagaaggcactgaatttctgggacatctgtgaagaacgcctctgggaggtaggacaggggagaaagggaaacgggagaatgtcaaagaaaatgttgctcatgacaggctccattttcaggaggcagagaagaagttttcttctttttgtctctccctattgtatcacatggcactcaactcccaagacccaatctgaaggctagtactattactaggggtatcacgtcattaagggtttatttaataagtttttgtgttggtctgagaacttaactaccacttagaacattgttgttagggaaacatagattctgtaaacttttagaagctaacccattcataattttggacttggtggtgttattaaagagtatttgaatcctagagtcatgactaataaggaaccaaatcaaatataacagtctgtgctttgtttcttgaatttgggtcaactctggtccagttggtatccctggccttttatcctctagcaccacttgccaaaaaagggcgaacttgtcttcctcagagtacactgcaggggtggggtaaggatctaggtgagtttagatatgttgtgaacaccccagtaagatttataaacagttgtattacaggggcattggagaggatcctaggtcaaacaaacccccaactttagccgtcttaggctccttctcaagtctctgatggctggacccctgtttcactattgatgggagaagccccttggagcaatccagtccattcaaagcccaagagattccatgcagatggctccactttgcctttatttatgctgtagacacacattatgtggctctggagagaagtcgtaggagaatagtctaagttatttatatttgtctttagaagtcattaaatttttttgacaacagatacagttgttaattatattttacttgggttaatgttgagatacacttgttttctctctacacagaggtttggaaagtaagtggaaggaagtgcaagattaatgaatatttcacaagaaattaataattgaagattgactgtttcaaaggggattcggaactattactgagcaaaaggggcttgctgcccaatgtgctagaagccaatactatgataccaggtttttgagagaagaaaagttttttatttcaagtttactaacaaggagacaggaattcagctcaaatctgtctccctgcactggctttactgcaataattagaaaatgtttagggggtggattctgggatagtaggttattggtagaaggaaaggggaggtctggaaagtcctcaggcattcatagttatctcttcatgctacctctgggtcccctgtgccaagggggtttcagcaagttgtttcttttcttatctaccatcctgcaaacccaagaatttctgttagtcattggtgtctttaactctttgggaaatggtttcagaacaaggtcatagatttcctaaggagttgctgtatttcatgccttttttttttttttttaagaacctcactcaagaataaaaagaaatatggatattgtgatccagtttgatatgttttaccccaatgactataacttaaaatacaaaaataatatattttcccccttagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaaggtaaaaagaggttctgacctagaaggctgctgtggcaacctgttacattttcgtaaaattttagggtaagcacatctagaccagaaattgtagaatctcatagaagaggttcataaggggtttccattctttaataacaaagatttctttggagattagagtggaacatggttgtatggtatgaaagcaacgtggactccattactctcctctcacacctgtggggaaggtgattgggtagagttcctggtgatccctatatagctatatgctttgggtcaagcaactgtacagcttgtcttcctgaggttcaggtgggggcctgggccactgtttcctagaggcaggtattctcccactggtgtctgttactatagtttctaggccgaaactggaaccctaggatcctagggaagtaacagagcaggcaagcaatatccaaatctgtcaaggatctgggggtatgtggtaggaagccaataaggacacttacctctaactcccatagtttctaccatctagaatggtcaagatgtggcagggtgtctggttaatcttccagagaagaatggatctttgaatgtgtaagactcagagtcagctggaggcacttggaaaaataatcaatattggcatatataggacaggctaagattcccctttttcttctttgtttcctcctaaccaggaggggctacaagactcctcttggatccctgaaccccttccttcttatccatacaccccttcatgctttgggcctgagacccgtagctcactgttctatgccctactacagctagcctactgatggtgacaaagactctgtttccccacagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaaggtaatcatcctttcagtcattcagcaaatatcaagggcctgatttgtgccaggaatcctgccaggtgctggaaatacagtggtgccaaatacttacaagtataaatccctgccctgaaagagtttattctagagggataagacagataacatgtagttaagaaaattagttaagaaacaaacatgataactacagaatgtgaatagtgatataaaggaaatacacagtgctttctggcactatagagaactgagaggggtctattttagtaggatggtcagagaaggcttctctgaggagatgctatttaagatgaggtggaggccaggcgcggtggctcacacctgtaatcccagcactttgggaggctgaggtgggtggatcatgaggttcggagatcgagaccatcctggctaacacagtgaaacctcgtctctactaaaaatacaaaaacaaaattagccgggtgtggtggcaggtgcctgtagtcccagctactcaggcaggaggctgaggcgggagaatggcgtgaacccaggaggcggagcttgcagtgagccgagatcatgccactgcactccagccagggcaacagagcgagactccatctcaaaaaaaaaaaaaaaaaaaaaagatgaggtggagccatgccatggatggtgggacatggcatggaaggaggggagaaaagcagtctagtcaggcccttaggtgggaaagagtgatatgtgttctacgaaatatcagggccatgtggctcatgggcattgagtcaagacaagagcacagtgcaatgagaaggaaagagaggcaggggcagatcatgtagggccttgtcgacagtgggcaaggtaacctttgaagggttttaacaggagagggacatgatccagctagtttaaaaagatcactctggctgaggtctagggaagaatagaagcagacagaccagtgaagctgttgcaggtgacagatgatggtggcttggataaggaagctggtagcagggacagataaaaacgcatggcttctgtatagcttggaggcagacccaaaggtctcaattgttgactggatgtggaatggggtgaggaaaatagaaaaatcgaagaaacctgttaggtttctgacttgaccatctggtggagtgtgatggcatttattaagatggaaaagattgtatgatttttgtgaggggtggggctgtgatcagatttggagtgagatgtctgggagtcatctaagtgaagaggctagaggagggttctggactaaaatataaatttgggtataaatttgggagtcaacagcacataggtggtattgaaagccgagggaatagatgagagaactcagggaaaagagacgacgtaaaagagaagtgggacataagagcagagttagaggttggatagaagaagaggtagcaacagagtctcagaaggagctgccagagaggtgggaggaaaactagggggatgtggtattagggaagccaagtaaggaaaatgtttcaagaaagagggattgggtagacacgtcttggaaaatgaagactaagctaaggccattggatttagcaacattggaggcctcaggttatctgacaagagcagagtcagtggattgcattagtttctgctgcctgtgggtgatttagaagtagaagcaaaagcagaagctgaccatgataaaaatcattttgttctgaaatgaaatgattacatgtaagttaaattacaggcctccatgtctggctcttcctccacccctgtctggggatgggcagacacacacacacacacacacacacacacacacacacacccctctttaacagaaatgatgccttttaaatcttccacaatctcaaaaatcttccaaatccttagggatttagtgcattttaacatggaacttttttactgaccagtgacttgaggcaggagttgggggtatcttatcagagaaggaattcagtggaactatagagtagaaatccaattataggtggctaaagagtgaataggagataaggaagtaaggactgcaggcaaatctttcaagaggtttttctgcgaagcaagatggaaaaatggcagtggctagtatgagaagtggggctaaaagagaggttttttttgttttgttttgtttttggtacagatagaggatactttgaacattaaaaaaatgttttgtgggtggaaggcctgcatctgggagattggggtgagaaggaaactttacggctgtattcccaggtgccagccattctggagcactgccttgtctcccttgcctcctcttcccttttttttggcaaatcttcaaccaccccagcctgtaccacaaatgcccttcaagggtgagaactgagagggatgggaaggatttctgaaccatcttcctgtcccctcactttccactcaaccttaccacccacctctcctgacacccctttcccacctcatattccctgtccccagcccaactcccactcccacctggttgaggcaccatctggaagagcctaaacgttgctgcttctccaagatagaaccatgaaggcgcggcagtggccatccctgggctttcccctagctgcttcaggacaattctcttaggacaactattcagtagttcacaaacaacatcgaattggaatgtctaatcactctacagctggaacataaaatccaatgggggattttctaattttttgttttttaaaattttactttaagttctgggatacatgtgcaaaacgtgcaggtttgttacctaggtatacatgtgccatggtggtttgctgcacctgtcaaccgatcatctaggttttaagccccacatgcattaggtatttgtcctaatgctctccctccccttgccccccaccccccaacaggccctggtgtgtgatgttcccctctctgtgtccatgtgttctcattgttcagctcccacttatgagtgagaacatgcagtgtttggttttctgttcatgtgttagtttggagggattttctaattccacaaattagatttgagaatatttatatagtcccaaaaaaactaaattatagtccaatttagttttcagctctgagactttccttgccttgattctataggcccaatttccctacctcagagtcaatctgaagattacctaggttgatagacatgacgtgatcagaaagtcatgttcaaatactgtgtggatgttcaagtgcagtataataatgtcggtgtttccccccagaccattacctctttgataagatacgtccccactcttgccctcaagccactggtcagtaaaaaaggaagcttttttggttcacgttaaaatacatcaaatccctgaggagatgattgtgagattacagaagatttaaaaggcattatttctataagagaggggtgcgtttgtgtgtgtgtgtgtgtgtgtttgtgtgtgtgtgtgtatgtgtgcccatccccatggaggaggaagagccagatgggtgagatgggaagtctaacttacatgtaatcatttcatttcagaaccaaatgatttttatcattgtcagcttctgcttttgcttctactcctaagtcacccacaggcagcagaaactaatgcaatgtgtctgcagctattttgtgactttgtttcattcttggagatttaaaagtgtatatagttttgagtgtgctatgataccaaatttaatttctggcctttcttgtccttttgtcttcagtttattccaatgccagtactctacggagttttcctttacatgggagtttcttcactacagggaattcaggtattgtatggttcagccagggcagtttcttctcactgcaagtttgcatgtcctgtccagggagggacagctccccaagagaagcacaaccagttcttgagaaaattgtttcctagtcttgccacttaggctattttagacatgtatttggatatagggagaaaaacagccatgttggcaggagagtacagagacttccagggtggtctggcttgatgtcatggctccagttattcattaattattcaacagacaatttttttttggcatgtattaaacattagttgctttgccaggtgctagtaaacttggatctgaaaggttgatcaagaaccaaactggctttcactcatggacagatctaggttagtgccaggctaaagtataaaaatggggtgtttaactttgggagagggttcattggcagaagagataggggaatagtgggagttgctcctggtaaggagatgtcacttcttgttatactctgcatttttccatccatcaactattgctctaagtctttcaaaaagaaaaatcaggagcttgtcattgataacttgggtattccagataatataataacttaggctgattattctttgtttgaatggaatgtcctatggccattcttttttttctttttttttttttttcctatggccattcttacatactgagttctactatgaacttgggcaggttatttaatctctggttctcttttttccttattgtaaggatgatcattttttatatatctaggatgttatgaggttttattttatcttttcactataaataatcaatgaatggctccaaactcctaaaacaagtaagaaatttggttttgataataagcaaaaagatgtaattggtttattttgttttcaacaccccctgagaaagagctctcttaggagacacagcgtgggataagagaaagaagtttgaacctagaattagaaaagatggattcaaattttgactttgccacttaataaccttggccaaattgcctggtcttttaaagtctcagtttccatttctgtccagaggaaatggtgttacctacctttcagagcaggtaatgtaagagatatgaattggtctaacaaagcttctgacccagaatgccctcctgaaaataaatgccagttccttcctttcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggtgaggtggtttttaaaaaataaattcttattatcattgttattttttagtggtaaaatattataactttaaaatttaccatttttaagtgtacagttgagtggcattaagtacattcacattgctgtggagctattaccaccctccagctctggaactttttacatcttgcaaagctgaaactctgcacctattaaacactaaatttccattctcccataccctcagcccctggcaaccaccattctactttctgtctctatgtattgattattctaggtacgtcatataagtgaatcacagaatttgtccttttgtgactggctaatttcttttctttctttctttcttcttttttttttttttttttttttgagatggagtttcactcttgttacccaggctggagtgcaatggcatgatctcggctcactgtgacctccacctcccaggttcaagcgattctcctgcctcagcctccctaatagctgggattacaggtgcctgccaccacacccagctaattttttttgtattttttttagtagagacggggtttcactgtgttggccaggctggtctcaaacttctgacctcaggtgatccacccgtctcaacctcccaaagtgctgggattacagacatgagccactgcgcccagcttgtgactggctaatttcatttagcctaatgtcttcaaggttcatccatgttgtagcatgtgtcagaatttccttcctttttaagattgaatagtatcccactgtatgtaaatactacattttgtttatccattcacctgtcaatgatactgttgtaaatatgggtgtacaaatatctgtttgtgtctctgttttcagttctttggggtatatgccaggagtggaattgctggatcatatggaaattctatctttaatttttttctaatcctctagatccacaccctcctggtgggtttctcaattttgtcaggctacatataagggtttgtattcgtgtgttacgttcatgggttaaataaatagcagattactgggaactcctagaagggatcctatcaattccagatgtattaggaaagtagtcactaaattagagagaaatgtacttgaatttaataagcctgatttgcctcattccttgtccagtcaccaattatagctgatgaacagcagtccacccaggcaggattaattctttgttttcctttggctaaaatggccctcatggaaagaaagtggagcagcagttgagatgccctggacatacctttatcggggaaatcagctgtcagattttaggcgagtcactttctctctctgggcctcagtttcctcatttataaagcgagtgtcaggccaggccagagggcaaagacaaaaaccactagagacaaatgatgcaggcccaaagcaaggatttgggtaggggaatgtataggcaaaggatcagagggaataaagatgatcttctaagagaacccatcatcccactgtgaggaatgcttgggtggctgtggctggtcccaccatggcccagctccagcagaggctttctacccacctgctgtcctgtagccttcctgctgacccctagccatctgcagatgatgtgctcatcttttcaatgacagaatccagttagctgctctctaagttgtagagctgttatgatagttaaaatactgtatgtaacacatgttacctggcacaaagaaagcattcaataaatggtgactgttaggattattatgagtttgattttgcttgaaatgtcctagtctgctgtgaaaataaggctttgcttttaagtccaggaaggaaattagtccctttaattcacttttttttttaatttttcttcaggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctctacaaaaaaaaaaagaaaagaaaagaaaaaaaatcaaaataattagctggatgtggtggcacatacctgtagtcagctacttgggaggctgaggtgggaggataccttgagcccaggaggttgaggctgcagtgagctgtgatcatgccactgcactccagcctaggctgagtgagatcctatctcaagaaaaaaaaaaaagatgacttttttttcccctaatatcttgaactttaaaaatcttgtatttctaaataagcttcaacaattataaaatataaagtcaatggaagaaaactttaaagagaatattgatagaattcactacataaaatgtgatgctttcaggcatccaaaactctaatcaaaattttaaaataacagataagttgagacatgttaatatccttactattcaaataattcttataaattaataagaataatatgaaattgaaatgagcaatggacatatataatttacgaaaaagaagtacaaatgaccagttgccttatgacaaaaatttcattctcactaataatcaaagaaatgattgtgcagcatctggattttatgaaatgaaaataaatattaaaaaataaaaaagaaatgaaaatttaagcaaggagaatacttttttacttgtcgaattggcaaagatttttaaaagataaaaacaagtgttggcaagactgtaattgaaattggcttctcatacactaaaaatagtaatataggctgggcgcggtggctcatgcctataatcccagcactttgggaggccgaggtggttggatcacctgaggtcaggaatttgggaccagccgggccaacatggtgaaaccctgtctctactaaaaatacaaaaattagctgggcgtggtggcaggcgcctataatctagctattccggaggctgaggcacaagaatcgcttgaacccatgaggcagaggttgcagtgagccgagattgtgccactccactccagcctgggcgacagagtgagactttgtctcaaaaaaaaaaaaaaaaaaggtaatataagttgcataaatctctttagagggcagtttaaccttagagtcttaaaaacgtatatgccctttggcccagcaactctaatttttaaatttatcctaaggatataattagcaatgtagacaaaatattttaatttgtggtgacataaagaaaaaaagaaaattagagtaaatgtattacaatggaatattgtacaacagtttaaaaaaatttttttttgagacagagtctcgctctgnnnnnnnnnnnnnnnnnnnnnnnnnnnnnnnnnnnn

SEQ ID NO: 16137 - DNA, 126176 bp, Human
atgatcgcatgaaataaaactaccgtaattaagacagtgtggtattagtctaaagaaagcaaatagatcagtgtaacagaacagagaatccagaaatagacttgcatatgtatggttaattgatctctgacaatagtgcaaagacaattcaatagacaaatgacagtgttttaaacaaatgatgctggaaaaattagatatccatatgcaataaaataaaatttgattgtttcacatgttataaaaataaactcaaaaaggactatatatcaaaatgtaaagcttgaacatgtaaaatttctggaagaaaatatagaagaaaacttttgtgaaccaggctagtcggagattccttacatacaacacaaaagcatgaaccataagacaaaaccgataaattagactttattgaaattaaaaacttttgttctttgaagtaccctttttagaaaacaaaaagacagctgtagactgggagaaaatattttcaaacctgaaggagttttatccacagtatataaagaactgtcaaaactcaataataaattcagttagaaaacaggaaaaagcttggacacctcatttaggaagatctggatggaaaataaacataagaaaagtttctcaacatttttagttagtagagaaataaatgcaaattaaaatcacaaggagataccactttaaacatttatacatgaatgtttaaacttaaaaacacaaaccatatcaaatgatggtgaggatatagagcaactagaactctgaaacccgctggtgggaatataaaatagtacaactgtgtaaaactatgcggcaattttttaagcacatatacaattctatgacttggccattccactcctaggtactaacccatgagatatgaaaacatatgtccatacaaagacttgcacacaatagcagctttatttgaaacaattcaaaactggaagcagtccaaacacctattaaaaggtagataaacaaattgtgttatattcatgcagtggaatagtaacagcaataaaacccaacaaactcttgacacataggacgaaatttatcaatcaaaataattatgctattggaaagaagctagattaaatgttcatactgtatgattctattatcgtaaaattctagaaaatgcaaactaatatatggtgacagaaagcagaacgggagctgggaggagtcaggtattacaaccgggcatgaggaaactttgaggtgatggaaaagtttatcttaattgtggaggtgatttcaacagtgtatacatatgttcacccttaacaaattatgcacttttgatatctgcagtttattgtactttaaccttcaagctgttaaaaattaaccggagataattttcaattgttgtgtaaggtttgccacaaagtgtaatatctgcaaagaagcagacaactaattttttcttcttaagattgtggaaaaagttgtaatactacagagagctgtggaatctaaggattagttgaccaacgcttgtaaagctaccaatctgaaaaacacattttcagttaccaaagttattttctctcttccatcgtgtaaatagaatgtcggggttcttctaatttgggtgtttctaaaatttaaatccacgtgaacagattaggaaagaccacgaaatcctacgtcacctctaaagtcacagcttgaagccttgcgaaaggaactggccctagaccccaccccggcctataaatcaccagggcgcagcctcagtgcctgggggtcggcagcagccagcgtcaggcggctcccgcacgcttcttcctaggcggcaggccgtggctgccacgtgactcccgctaacaccggatgatggcgcagcgctgtgcacgcaggcgcagtgtggggcccttgcggtcgaagctcacgcggtaagccgctgcacgtgtgctacggcgggcggagggccgaaagtccagtatgtgggtccagggtcactcttctagagcttccgcaacggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccatcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgctttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatcctttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttttcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtactgttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttcttccattttttcatcctcctctctgtccagaggctgaggaataagctgattacccacaaatatgtatgtgttagttctctgtttaactctcttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggttgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcatcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtatgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtaggagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattatagttagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccatttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatttttttttttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaaccaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattcttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgtttggtttgctttgtttgcataaactatattgtttttcgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtaagaaaatgactcttgacttgaatgatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacggggggggatcacaggagggattggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattgactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccataataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatgctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatatgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttgagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttagcaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacagtttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggtggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatttaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcattctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcctggactcaagtgatcctcccacctcagcctgctgagcaactgggactacaggcgtgcaccaccatgcctggctaatttttgcttttttttttttttttggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccccccccccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctgttattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcagttcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctctctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatttatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggaatggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggaggcattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccatttaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgttaacttttattcaagtattttgcatagttctttaacttgattgccatgtggccatatgcttttttttttttttgagacggagtctcgctctgtcgcccaggccggagtgcagtggtgtgatctcggctcactgcaagttctgccttccgggttcatgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagataaaaacttttttattttattttattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcaacttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctccctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgccttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatgcaatctttttatcttgttggtgtctttttggagggatccttgacttaaccatgtagctaatgaattaatcctgtagctgtgtcccttctgccatttagccaatccattgcattttgtatgtcaaggattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcagaaatctgttaaaggcataattttgaagtttatctattgttattggaggccttagctgttttggatattcctttgtgtataattctacgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattattattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgcccccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttgaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtaccaggatgatgctggcctcataaaatgagttagggaggattccctctttttctgttgtttggaattgtttcagaaagaatggtactagctcttctttgtacctctggtggaattcacctgtgtatctctctggtcctggactttttttggttggtaggctattaataactgcctcaatttcagaacttattgttggtctattcggggattcgacttcttgctgatttagtcttgggagggtgtatgtgtccaggaatttttccatttcttctagattttctagttgatttgcatagaggtgtttattgcattctgtgacggtagcttggatttctgtgggatcagtggtgatttctgctttatcattttttattgtgtctatttgattcttctttattagtctggctagtggtctatctattttgttaatcttttcaagaaaccagctcctggattcattgattttttgaagggtttttcatgtctccagctcctgcagttctgccctgatcttaattatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgttgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctgttttttgaaattttcaccctttttgtgctggttttttctcatcttcttggatttatctacctttggtctttgatgttggtgacctttggatgtgtttttttgtgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagcggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgccgacagaggcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcacggcttcccttggctaggagagcgagttccccagccccttgcacttcctggctgaggtgactccccaccctgcttttgcttgccctctgtaggctgcacccactgtctaactagtcccaatgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatataaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgccagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacggtgagggcctagatgaggtatttattcattaagattgtcacgaagtccattataatggcttaaatatggtacagagagggatatttgtgtagacatgtgagtttattctaaaaaatatttaagattaaagttccctaacttaaataattactgtaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatggtgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagttgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctctgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgcatcaaaatgtcattcctttttattgccaaattatatttcattgtatggatgcaccacattttgtttatatattcatcagttgctggacatttgggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatgctagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaattgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtttgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagctgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgccgccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgggtcatgggcagaggttggagggctcggaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttatgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaaccttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattatggggtggttcccccatactgttctcatgactttagccctatgcctgcatgtatatttaaagttgtctggtttcattgaaccagtaccctcatggaaataaactagcatgattttcatcaatgcttcagtaatctattctttatatcagaagggtgaaagtaaacatatcaagttttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagagctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccatcacagaatacaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcgtatttaacatactattgcaagttctggtcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaactacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagctcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatatattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctagaagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcagtcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgcctgtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatacattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacactgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttctgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagattcgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattccttttgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttctttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattacaatgaaagtgcttttaccctgtaagagagttaatgtgctttctttaagtaagctcttttctagtcaccaggatctgaagttccagagttgactcttctatagattggtgtattaatacattggacatttattcattcttactttctttcacagctttctgttcaaaatcaggagtttgagataaataaagatggaatccccaaagtggatcagtttcatctggtatgtgaacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagataaaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctccaaaaaataataataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaatttaaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaagaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggctggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatgtaaactttttaagtcaacttagggaaaattgtcccattcgttatgagagtcatttttgttgaagaccataataagacttttgttcctgatctacttttgtggttttcaggagcatgtgttattttttctcatttggattttgtaatatttaattgtttgcacctagggaagataattatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggtagagacagagttttgccatgttggccaggctgatcttaaactcctggcctcaatgatccacttgccttggcctcccaaagtgcctgcctgaccagcagttaaacaagattatttttattcagtctgatatgtgctttggttggagtaatcataagaggcaaataaaaggtatactaaggtgtctctgcaggtggaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttatttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcgtctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaatttttttttgtggatcctttgtattttttttagtgtatttcacttagttctgctcccatcgttattcttcgttttctactaatatgtatcaggtcgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacagcctcccaaagtgctgggattacaggcataagccactgtgcccagccagatgatctatttgcagtgtgattatcggctcattgttttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcacaaaatagtttgtatgctttgaactttagtttacttggagtttgatatggtttggctgtgtccccactcacatttcattttgaattgtaattcccataatccccacgtgttgtgagagggacctggtgggaggtaattgaatcatgggggcaggtttttcccatactgttctcatggtagtgagcaagtctcatgagatctgatggttttataaaggggaattgccctacacaagctttttgcctgttaccagtaagacatgctgttactcttccttcaccttccaccacaattgtgaggcctccccagccatgtgagcaacggtgagtccattaaacctcttccctttataaattatccagtctcacgtttgtctgttagcagcatgagaacagactaataaagtaaattggtactatgagtggggtgctgctgtaaagatacccaaaaatgtggaagtgactttggaactgggtaacaggcggaggttggaacagtttggagggctcagaagaggacaggaagatgtgggaaagtgtggaacgtcctagagacttgttgaatggctttgaccaaaatgctgatagtgatatggccaatgaagtccaggttgaggtggtttcagatggagatgaggaacttgttggaaactggaataaaggtgactcttgcaatgttttaggaaagagactgggagcatttttgccctagagatttgtgcaactttgaacttgagagagagagatttagggcatctggtggaagaaatttctaagtagcaaagcattcaagatgtgacctgggtgttgttaaaagcattcagtcttatgtattcacaaagatatggtttggaattggaacttatgtttaaaagcagagcataaaagttcagaaaatttgcagcctgatgatgcgatagaaaagaagaacctattttctgaggagaaattgaagccagctgtagaaatttgcataagtaatgaggggccaaatgttaatcactaagagaatggggaaaatgtctccagggcatatcagagacctttgtggcaggctctcctattataggcccagaggcctaggaggaaaaaatggtttcatgggctgcgcccagggtccccctgctgtgtgcagcctagagacttggtgccctgcatcctggctgctccagctgtggctaaaagggtccaaggtacagctcggcccatggcttcagagggtgcaagctccaactctttagcaacttccaacttccacgtggcattgagcctgcaggtgcacagaagtaagaatggaggtttgggaacctccacctacatttcaggggatctttggaaccacctggatgtccaggcagaagttttctgcagaggtgggaccttcatggagaacccctgctagggcagtgtggaagggaaacgtggagtcaaaggccccacacagagtccgtactggggcattgcctagtggaactgtgaggagaaggccacggccctccaggccccagaatggtagatccactgacagcttgcactttgcacctggaaaagctgcagacaacaccagcttgtgaaagcagctggggtggggggtggttgctgtaccctgcaaagctacaggggcagagctgcccaaggccatgggaacccaactcttgcatcagtgtgacctggatatgagtcaaaggaggtcattttggagctttaagatttgtctgccttgctggcttttgaacttgcatggagcactggatttcaaacttgtatgtagtccctttattttggccaatttctcccatttggaacaggtgtatttaaccaatgcctgtacccccattgtatctaggaagtaactaacttgcttttgattttacaggctcacaggcagaagggacttgccttgtcgcagatgagactttggactctggacttttgagttaatgctgaaatgagttaagattttgggggactgttgagaaggcatgattggttttgaaa

SEQ ID NO: 16138 - DNA, 126176 bp, Human; identical to SEQ ID NO: 16137

SEQ ID NO: 16139 - DNA, 87611 bp, Human
cttagttaacaattcaaaaaaaggaaagaaaaatacctttttggaatatttttaacacatcattttagaagtagaaattacatctcttactttcagttaatagtaagtattatttaaacagtcttcccattgtgcaattttatttttgtgtgtatgtgaagtaatgttttatttttgtgtgtatgtgagataattttgttaaatgcttttgaagctcttgacagttcagtagaagaatctgagatgattcacttaaaatacctgtgacatagtctttatagatgggaaaattagaatatgaattgtacaaagtcaggctcatgacttgttaagaattatgcttatttctgcggtgcccacatatgtgagaaaactgttactctttttatgaatgttaactgattgatcattttttccactttcctttaaaattcatttaaaggaagcatggagcagtatgtatgctaatggtatattctattacatttgttgtgatctctgttgactttcatgagattttggttgtcattcagaaagctgatttttcactaagttgtacacctgttcctttcaaaccttagtatgctttcagatgatatttaaatttctctggacagtgagaagaaggaagttgtagaactgccctcatttatgaccacaaacatatgaattttaaccctttgaacattagaagaccaaaccaaagttatgacagaactgcctaagcccataagacaagcatcagttacagaaacttttactgtattggaaaagctattacacatcttcttgttggaaatgaaacttataaaagaaagactcctgattttttttctcatctgttatgcatggggataattcgactgtaaagaacatggttgagaattctgtctagtgattgttttgattttctagttagatgtttaagcagatgaaaaaatgtgctctttggtcaaaaacagtatagtttaaatatttgttctctgttaataactaaagttaaatggttcttaacttatttaaccactaaataagttaatgtgggtaaaggcagaacttatttgacagtaaacttgtttgatcataaatattctaagtttgagtttacagtagtagaataagagatatatttatgtatattccgtttcttaccctttcaaagacttagaagaaaagcagagttcttgtctcttctcttaatgtattttctgggatacctaatattgcttgatgaaaacattttactgtggaaataaaccttcattaagtagataacccagaaatgataaactcaaattagcagtttcatttaggatattgaggtagtattactttaagtgggtgtggttgtaatgcagttttgaaattattagctatatctgttatgccttacggtacaacttcttgtgctggtttatagttgaggtatgaatttaatatgttctcactttgacttgtttagtttggttggggaggggagtaaatttagagataatttaccttagacgtgttttcttttagttcataggttgagttactgtcccatcttttatcaagattaccagtgggttgttttggttataatgaatgaatatcattgcatatagaaaaagatactttatttgggaataacattttattatgtgaggtgcttcccccctttccagttttacttcatgttaaaagcatttattccttttacatatcaggctttctaattttcttcaggttacagttctgctgtctttctttaaagaatcttaaaattatttaaaaagacagtttatttgtgaatcccttcagggtctggggaattttgaatttcttccagataaccttttattataatttctagtattttagccagacatgtatacactgggtcttcttaaactatatgactataacattagttaacccttttctctgccacagttttgcctcctcaatcccatctccatccccagttttttaaaaaccttattctcctctgatttattgcagactcaagaatgaacaatccgtcagaaaccagtaaaccatctatggagagtggagatggcaacacaggtaagagttttctgatctagctttttaattaactctagtagagcacaaagaagaaagtttccatgtaactaggacttgtatttggcaaatacagaccaatttgagtattgagttgtcaaatatgattcagtcctttaggaactgggagggattatgtttgtttaagattacttaactttcttctgcaggcagcttcgttgttttgcttctgtctatcagacaaactatgcagaagttaggaaaactgtcctttgggtcagatagttttggatatgaaatatgggtttaccacttactagcttgtgactttaggcaatttccccaatctttttgagacttaatttattcaattacaaaatgaggataatatatttcaggttattgtgagtattaaaggagatgatatatgtggcatgttaagcaaaatgccagctacacagtaactattcagtaaaatgttttttcttacagatgttaatcaaaatagtaaattttatctgccctacctttgctataaattatattaaaagttatgatagtaagtagttatagacacatacccatttctaatacattcttttatttggtaatttaaaaaaattatacttcattaaaccttttatcaagagaaaattatcatataaatgagaatactgaggccccatgagagaaaggtaaatctgtaaaggatggtttgtctccacggctcatactcttgagtcagtatattgcttagaggatgtaagactatgtatctttatcatctgccagagaggatacagggacttccctggtttctggtaaaggtataaatcaaaatatgaaaccaaataagaagacagttatgggcaaggatgaacagaaagtacttgcttctaaaaactaggtttttcgcttgcagagagggatcccttttgacttatcattttaaaaatgcttaaccatgggcaatggtaagagtgagaggcactcttaatttgtggtaaatggctgagttggactaatgtagcagttttcctgcctgtatgtcttttgctgtaaactctcctatacctggagatgcttatgttaatctctaaactgtacatacctctttatgtgaaactgagctgtggggcttccatgttcacccctgttgtatttaacacacttcatagtactcttactgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtgccggtgcttcagccacctagcttaggtgtgggaaatgtttgcagagagaaatagggcagctgatccccttaagagactagagggtggggcagtgggcaggacacctgtgcctaaagaacagcttcaaagaagaaacatactttttttttccctaagggaagataagcaaatgattggaaaacactgaaaatagccattacatcagactacatggaaatccctgtatctactttaatgctactactgtaatagcagtttcagcagttaccatttattgagcaactacaacacttttttttttttttttttttttgagatggaattttgctcttgtttcccaggcgggagtgcaatggtgcgacctcggctcactgcaacctctgcctcctgggttcaagcgattctcctgcctcagcctccggaatagctgggattgcaggtgccagccaccatgcccagctaattttttgtatttttagtagagacggggtttcaccatgttggccggctggtcttgaactctgtgggcattacctgatttcgagttaagttattttgacaagttagataccattatttcaaattataggaaattgaggcacaaaaccagccaggaaataaagtcaggtttaggattcgcagcccacatgtaagtttccccatgaagtgcaataaaataaaactgaaaatttaagcaacacattgtgtatgtccagacctgtataaggtaagttctgactggagcacttgttgtaaccgtcttgtgaatttcttgcctcgttttaatatagaatgtgtggcagactggttcctatcagacttgcatatttacttaccatgtttgatatattagatataaaattacagtttatttagataattgtatgcttacaaattgatttttatttaagcatataacaaatgagccttcagactcttgagttgttagttaactattctttttttggtagtttatgaaagcaagtaaaatgtttaaggggaagaacgcttaacattatagtaaaactgaagcctcacaatttctggattcagaatatgtttgtgtagatcattttttcctgaaatgtttacaattgtaataattttgatttgtgacactttaaggagaatgatattgtaaaattattttaagattgtgttgatacgttaattctataccttctgtcattgattcgagaggcaaaatcaaatgatgcactttttgtcaaatagtccttttatgtttgcagaaaatttatagtttaggtttttaaaaaatgtattcagtaagtgcccgttctatgtgtaaagtactataatcagtgttattaggatgtacaatgcaaatagatgaaataaccctcagtctttaaggagttaacaattcattaagagataagacagataaataactgattctggatagattatggtaaataattcaagaggaggtacagaaaagtgccatagtggtgttaattaggtgtttctttgaagaaatttgtgtatgtttataggtcaggtggaaggacccatcagggagcaagagagtggagaaagaaatacaattaattgaaccaaggtaggggtgaaggtctaggatcagaagtgcagaatgaagggttgactctgaacatgaaaaagactaccccatgtctctaaaactggggagaagaagcaaatattatacagtaacagagaattgaaatggaagggagaagcaaaactgagcaatcattcacatcagattgcttcatttttctcattaaagtagttgaggtggtcatctgagaggaaggcagggataatagtaataataatggcagcagctactgttctttgaattcttactgtaggtgtctggctagccactttattatatatactttatgtcgtaatttttaaaatactcttacaaggttaagtagatttataaaaaggattgatgagccttttgagggtcagtctcaaagaaaataaatgtgttagcttatccagccaacctagttatacagctgatcattgaataacatggatttgagctgcatggctccacttatatgcaaatatttttcattaaatatgttggaatttttttgagatttgcaacaatttggaaaaactcacaaatgaactgtgaaatattgagaaatattgaaaaaaattaaaagatatgtaatgaatgcataaactatatgtagatactattttatcatctattaccatgaaatatcacaaatgtattaaaattataaaaccttaaaatgtatcagaacttacgcacacactcgatcacatacatggcaccattcacagtctagataaatagaaacaaatgtaaacaatacagtataaatcgtaattggataaaattaactgcattacctactatactactgtaataattttgtaaccacctcttgttgctattgcaatgatctcaagtattgtgagtatccatttaaaatgccatgtgaccctaatcatgtcacagtgaacagttcatccagtaaattgtgtattgcagtaaaaagtgatctctctatgtccttgagtattttgcatcctgtttagtgcaataacctaaaccttaaataatgccataagacctatacgaagtaccactggtggtgccagaagtgttccccaaagcagaggcaagtcataatgttataggaaaaatttgaattgcttgatgtatactatagattgaggtctgcagttatagttgccatccatttcaagataaataaattaagtgtaaggacgattatttaaaaaaaaagaaaaggaaattcatgaagccttcactgcagctacaccagcagacatgaaaaacttgaactttttgctaaatacctttttatttcattgaaaataccggcctggtgcagtggctcatgcctgtaatcccagcactttgggaggttgaggtgggcagattgcttaagcccaggagttcgagaccagcatgggcaacatggtgaaaccctgcctctactaaaaatataaaaaactaagccaggcgccatggctcatgcttgtaatcccagcactttgggaggccaaggtgggcggatcacctgaggtcaggagtttgagaccagcctgaccaacatggtgaaaccccatctctactaaaaatacaaaaaaattagccgggcatggtatagctgtaatcccagctactctggaagctgaggtaggagaattgcttgacctcaggaggtggaggttgcagtgagccgagattgggccattgcactccagcctgggcaacaagagcgaaactccatctcaaaaaaaaaaaaaaaaagctaggtgtagtggtgcacacctgtagtcccagctgcttgggggaagaggtggaagaatcacctgagcttgggcagtcgaggctacagtgagctgagatcacgccactgcactccagcctgggtgacagtgagaccttgtctcaaaaaaaaaagaaagaaaaaagagaatgcagcttttatgtgggtgcaggattgctataagaaagacatacctttggactctaatgtgatttgagaggaagcacagttgttatacgacagcttaaaaggcaggtgaaggatctaaagctggagaatttaatgccagcaaaggatggtttgataattttagaaagatgtttggctttaaaaatgtcaggataacggaagaagcagcttctgccaacgaagaggcagcagacctcaagttctcagatgccatggagaaaatcagtgaaggccgtctgtggtggctcacacctgtaaccgcaccatagctggaccccatctctaccctcaccccaccccctgcaaaaaaaaaaaaaagataagacaaaagaaggaaaatcattgaagagaaaggatatctgcctgaacaggtttttaatgcagacaaaagcgccctattctgagagggaaaaaatgccacaaaggacattgattagtaaggaaagacatgaaagcacaccaagatttaaggcaggaaggaataggctaacagtactgttttgtgcagatgcaatcgggtttatgatcaggacagccctatctatatcctattaaagactgctttttgccttcttttacagcatggacccttttatgatatgggcactgaaactaaagcacatggtggaagaaggattggtagcatatagaaacatttttagacaaatgaaaaagcaaaaaagtcagaaattacagtgtatttccataaagttacaccaagtgtgcctgcctctcctgcctccccttccagctttttgtcttctgccatttctgagtcagcaagacccctcctgttcctccttctcagcctactcagcatgaagacaaggatgaagatctttgtgatgatccacttccacttaatgaatagtaaatatattttctctcacttaggattttctttagcttactttactgtaagaatacagtatataatacatatacaaatatgttttagtcaactgtttatgttatcagcaatgcttctggtcaacagtaggctattagtatttgagttttgtgggagtcagatgttacatgcagattttcaactgtttgtggggtcgacacccttgactccgttgttcagggttcgactgtatgacctttctgtagcctagatcagcagtccaaactcaggaatgaagaaaatggaacattggattattgtgccaaaatagtatactatcaccaaaaaagaaagagatagaagggagtggtaatattttttataacatagttgtttgcacaaggatgcttccctttggaaagatggtatttccccattcttccctctcctccacctttggtaaagtctattctatgttctcaagattattccgtattgtagcatgtatcagaactttattttttataagatattccattgtatgtatatactacattttgtttatgcattcatttgttaatgggcagctggattgtttttactgtttggctattatgagtaatgttgcagtgaactttggtgtacaagtatctgtttgagttccgtttttcaattctttggtttatatacctaggagtagaattgctgggtaaaacagaatacaaacttattatcttacagtttgggaggtcagagtcctaaaatgagagtgttgtaagtgctttatttcttctggaggtactatggaaagtccatttccttctcttttccagcttctagagaccacctgcactccttggcttatggccccttcctccatcttcaaagccagatgtatagcattgtcaaatctgtttccttccctccctttcctgtccccctcctcccctcaaccctgcttccatcatcatatttccttctctaactctcctgtccccatcttttctttaaacacttactatcctgaacttcattggatttgcaaaataccttttgccgtgtcaggtaacaaattcacagcttccaggaattaggatgattattaggcccatctttgatgggctgttgttctgctttcccacaagattttctcctaaattaaagctgatcatctctattttagatgatagttggaaaagtaaagaagttgtttgaagttttacaaggtttggtaggaaaaaactaaatcaactattttgatgtaaagaaatattgagggaaaaaggaatattggacaaacattaaagttttgctcacttttaactcaaagggcagacctctttcatcagtactcctgacagatggttatctgccctgtgcctgggttcatgcactgacacagaacacagtactttctagtgttatctgttctctggtattacaactctgttttctacattcttttgaattttgtccttaggagtttgtcatcttttaagaaattaaagctcttctgaaagtcattgtcacattttaactcttttccattcatttgacaatttattacaaattaatttactataaagtagtaatttattataaaacaatttgttataatcatttgtactagaatatgatgatagtggctagcattgattaagtatttactgggtgatttaaacattttacatagattatctcatttaatccttataaaaacctcatgaaacattatttttctctttttataaataagggtctctttttataaataaggaagttgaggctcagagaggttcagtcacttgatgaaggtcacacagatagctataaaggggagcagaaccattctttttttaagatggaatttcactgtcgttgcccaggctggagtgcaatggcacgatcctggctcactgcaacctccacctcccgaggtcaagcaattctcctgcctcagcctcccaagtagctgggattacaggcatgcaaccaccatgcctgactaattttgtattttcagtagagatggggtttcttcatgttggtcaggctggtctcgaactcctgacctcaggtgatccgcccaccttggcttcccaaagtgctgggattagaggtgtgagcaactgcacccagcccagaaccattcttttaccctttgagctatgttgtttcttttttctttttttctttttttttttttttttggagacagagtctcactctgttgcccaggctggagtgtagtggcacgatctcggctcactgcaacctccacctcctgcattcatgaagttctcccgcctcagcctctcaagtagccgggattacaggtgtgcgcccccacgcccagctaatttttgtgtttttaatagaaactgggtttcaccatgttgcccatgctgatcttgaactcctggcatcaagcgatccacctgcctcagcctcctgctgggattataggcatgagccaccatgcctgccctgttgtttctttttgtctccgatgcgcaagataacagtactaagtaacatcagtgaagttgaataaaagactgattttgttctcaataaatttatcttatagagaaaacatatatgaaaatgtaatataacagaaattgagacgattcatgagaagtatatgtgaacccatgagaattcagtgtaggggaaaagtgtttctagctgggaggatcagagaaggctttggagaaggtggaattgaaactgtatcttacaggctgggtagggtttaaatcatgatgatgctaggcaatatatgttcagcatgaagaaacagtcaaagctgagatgggggaagaaatctgtcctaaatgtctctaattccttcaaaagatttccattatgtcatctgatttctagatcttttatcttttagtcattcacagaattagacagtattccaattcttcagacttcattgcagccattaccattaccttttgcttattattatctttgaaaacttaccattggcttattataattatttttataatgcaggtaaaaaggatatttaaatatattttaatataaatgttaatatatttaatcagattttctgatacttgttttgtaatgtgaaaagttgttttaaagcagctgactcatctgttgtaatgaatttacagtcaattaactgtctttttttcatctgaattatgatagatagatccaaggcttccctatcctgtcctttttcacttgcttttttcatttgaattgaaaggggagagttccctgaccccccttgcaggacatgcgacagggagtggctcatatgtttggctgcccacactcaaacctcttagaggaagggaagcacacagactggcaggtgcaggagttatggtaagcactttctgggctctggccacatgatagtgtctaggggtgggtgtctgcaactcccaaagcccaagtgggcacatgtttcagtgcactcttttagccttgccatctacagacagcttaagtgttagctcagtgatcctcttggtacccaagtccttgtgcggcgtccaggaagaatcaggtcacacatggacttgaaggatgaattcaggggttttgttgagcggtggaggtggctcttagcgggatggatggggagctggaaagggaatggaatgggaagatgatcttcccctagagtttggccatccagcagctgatttcctctttgaccacccccagtcgaattcctctcaacattcagacattccttctcttctctctgccacaccattctgctgttcttctgctctactgttcatgtcttctggagcctggggtctgggggttatatggagccacgatagtggggtatggcaggccaaaaggcaacttttgggcgcaaaaacagaaatacctgttcccatttaggaccatgggtttccaggcttgagggtggggcctttgctggggaaccaccctcttctacccagtatttccctgtctcctgttcatatcaaaatgatttttccccaggatagtatcactatatttcaggcaaatgaaaagtcaaaagaaatttgttaatgtaacctaatatacataaatacaatagtatttttggaataatatttatgggcttgtattccaaaaatactgtcatccaaagttcctagtaaccagtgatgttattaattctttgggatttactagtgctatggctggtattaggacattatatgctcatttatattcataaaagagcatgatcagatatcattttctccaagatgaagagaaagaatcctgaaagaccagggtaccagtgaatagacttgctattcttcatagtaatttaacaacttgatgccttgaaccagcactagttttggaaataatttccagataaaataccagtgttttccagaaaagcctcaaaatagacctcaatatagttcttgttaaaccagaatggagcatttgcaaatttcagacacttaaggattattttccttttgaacttacgtttatccagaggccatttttaatattcttactgcttttattattattttaaaatttattacatattttattgtgtagactacattctgccctggccaagctgctcttataagcctgagagtagaaatactaattttgtttggagtacctttatagctaatttttaattagtgggtcattgaaagtggctgaagcatttccagagagcctcaggagctcagtgaaggatcttggtggtttagaagcaaataccaaacacctgtaggaaagatagacctccctctagtgtttgatttaatagatgtcagttacaggatatggcttctacaagattctgatcagtacgtattgagaaacttgccctggctctgcccactggtgcacatggggattttaaaactttaggtcaggggtgggggtcaagggggagaagggcgctataattactgaagctgtgcgaataggaagtgacatctgaattaagattatacttttgttaaatgactgaataagcaattgatctttttgccatgaggtaacccagtaacaaatttagaattttaaaggtagtatccatttttgttcattactaatagaaattgagaacattaaagagagggtttgtttctaaaatgctgttttcagtacagattattagagattgtctataattttctcccttagagagcagcttagttttatttcatgttacttttttcattttttttcctaacagatattaaagaatttttggtataaaagaattttccagccatgttatactttacatcttgcttgaagccaaaaactagactacattattctttcaattagatccattatataacatcctggcatagagcaatggcaatagaagccaggggtcaatttttttttttttttttttttttttttttgaagaaggaaggaaagggagtaatttaaaatgaatacttgtatttgcctcggggctgggagagatgtggtagcattctctgagtaggaactgtactgttggggagtagacttgacaatgagatgatgaaacatttcagcactgaaaatgttgtacttggggtgccttgtggtgcttgcaggtgaagatgtgggcaattgaagatagagataggttcctgaggagaggtgtaagagtctttaacagggaaatgctacggggaggagagtggaatcagccaagaggaccaaggacggagctcttctaaggtgttgaaagggctggtagaggaagaggagcccatgcctttgttgtcgaataggatggacactgactgcatgtggctctttaaatttaaattaaattaaattaaattaaaaattcaattcctcaatcatactaaccacatttctagtgttcagtagccacgtgtagttagtgactaccatattggccagtacatataatagaacatttccattatcacagaaagttctattggacagtgcttaagtagactaagaaataacaaccatggagatcagatgtgaatcagaccagtgagctcatggagttagcatttagtgtggtcaagtcctgccataggagccttaaaatgtgacccttgaatttgacaattagttactgtgggccttttaaagattttagttaagtggtttggaaagaaattgctgtggttaagaaagtgaatggttgtgtaaagggaatgataaatgtaagcaactcttttcatggaagctctatatggggctatatatatgtatcatagtggttaagagctcagaccctgaaatcaaaccccatggattcatatcttgctcctttcacttgctagttgtgttaccttaggcaagttacttttttcatgttagagtttttcttagctgtaagatggagataaataataatccatctcatagtcttgttgtatacacggaaagcaagtaggtatgtggcacagtccattcactatcagtgttagctatctattaggaggaaggggaggatgatagagaaggaaagaatgggaggggacgttagaagggcctcctagtgaagcaatttgaatatgtttagatgctaagggaaaagagccagtgtaggaggggagtggcaaagaaagaacagatgatgcagccataaaaaggaatgagatcgtgtcctttgcagggacattgatgaagttggaagccgtcatcctcagcaaactaacacagaaacagaaaacgaaacaccacattttctcactcataagtgggagttgaacagtgggaacacatggacacagggaggggaacatcacataccaggggtgagggtgaggggagggaacttagaggacgggtcaataggtgcagcaaaccaccgtggtacacgtgtacttatgtaacaagcctgcatgttctatgtatcccggaacttaaagtaaaataaataaataagaaagaacagatgagtcagggatccatttttgaggagaggggaggtgttgggtttcagagcacgtggtggctgaagtagcctaaagtagaagattcctttttttgttgttttttaggtgagaaatgggagagtaaaggagataaagacagattcagatagtaagttttcaggtagaagggaatgtaagaaagcagtctagagaggattaggaacagtcaattagggatttccttgtgatacagggaaaacaaaactgggaatagaatgcaataaacaagtctaggattaaaataaacactatcagcaggatttgtagcaaagtgtcataatccaagttaggaaggctgacatcagataaactcagaaggtaaagagcattcattgtgtttctgaggaaggcaggaagctgctaccgtttaactggctcacatcctacagggaaagatgagcaagggagcctctgactaggttgagaggcagaacagagatggagcaaggtcaatgtttggtaattttctccaccaacaaaaatattaataagattttaggatattaaaataaggtctgtctttctggttttcttggtcttcaaatatatttcatttatgttcaatatttaagttatttgaaaagtctcaacagctggtaagtcataagacacttatttttctacaattaagaataaagttaagagcctggaatagtggctcacacctgtaatcccaacactttgggacatcaaggcatgaggattcctggagcccaggagttgaagactagcctgggcaacatagtgagacccgcatgtctacaaaaaaaaaaaaaaaacttaaaaaaattaactgggcatggtggcacatgcctgtggtcccagctacttgggaggctaagggaggaagatcgcttgagtctaggaggtcaaggctgcagtgaaccatgattgcgccactgcactccagcctgggtgacagagtgagaccctggatttttttttaaaaaaagaataatgttaatgaaaacctgttttaactgagtctttcatccagatagacttaacaatttagcaaacagccacctatagaaatcttgtcatgcatcactgataatgcattcatctctaaggtgatgtataaaagtaattttaaaaatacacatactattattacttaggaagtaaaggatatacaatccaatcattacaatcaagtacaatcactgtggagatttttagcagataagtaatacctatccattctatagatcagcagcccccaacctttttggccccagtgactggtttcatggaagacagtttttccacagacagcgagtaggggatggtttgggggataaaactgttttttacctcacatcatcagtcattagttagattctcataaggaatgcaccacctagatccctcgcatacactgttcacattacggttcacgcgcctatgagaatctagtgccactgctgctctgacaggaggcagcgctcaggcaataacgctatcttgcccaccactcacctcctgctgtgcagcctgttcctagcaggccacagattggcaccagtcttcaacccaggagttggggacccctgctatagatattctgtgtcatgaattttgattatgcttcttacttttgtagtggcttagaatctttctgtggttttgtttctgtgataagtgattctctttcaggatttccattatcccagattcttcccattttatggcagctcagatggaagaaacgctctccacacaaacaatctaaaaaatgagcagtagctaagttttcctaaaagatcttttagctattatttatgtcctgtggttgcttgactttctgtgaacttcatttggaatttgtccttgcttatcaaggtgatgtagtgatgggcacagatattgtcattatttcctatagggtgtcggaaatttagtctattggtaattttgccttgactgccttaaatttacttataaatagaaatatgtgaataatgtatttttcctctttattatgtaggtttaattgaagtagtatattattttcattacacattaacatgtagtatagtactatctcaaatataactgctgggtgatgaaaaatagccttcacaaactcatgttccaaaatttctcaggcccttattcaagaaattgttaatcttattttcatgtgcacttctaacaggggtgcatttcataacagatcataagcagccatttatacagacgaggctggctgctctaggaaagtaagccagtagagcagaaactgtcagatttataccagaactgcagtcttttattttcttttttagattgaggtgaaatgcgtaacataaaattaactattttaaaatgaacaattcagtggcatttagtgtattcacagtgttgtgcagctaccaatctatccaggtccaaaacattttcatcacccccaaaggaaaccctataccccttaagtagttgctctccattttcccctctccccagcccctgacaaccaccaacctatagtttgtctctataaatttacctattctaggtatttcatgtaaatgaaatcatatggtatgtgaccttttgtgtatggcttctttaacttagtataatgttttcaaggttcattcatgtaatagcatattatcagtactcattccttttatggctgaatggtattccattatatggatataccacaatttgttggtgtccctttgtctcttgatggacatttgggttgtttccactctctttggctcttgtgaataatgctgctgtgaacatttatatacacggatttgtttgagtacttgttttcatttattttgggtatatagtcatgcataacgtcagggatacattctgagaaatgcaccattgtatgaacatcatagagtatgtttcacaaacgaagatggtatagcctatgacatacctaaactatatgatatagcctgtttctcctaggctacaaatctgtacagttagtatactgaatactgtatgcaattgtaacacagtggtatttgtgtatctaaacatagaaaaggtacagtaaaaatagggtattataatcatggttctattgttgctgatggaaatgtctttatatggtacgtgactgtatgtctagcagtgaagttgctgggtccactttttgatggtccttcaaatagttaaacatagaattaccgccaaacttttttccatagcagctgaaccattttatatttccacaatcaatgtacaaggattccaatttctctgcatccctgccaacacttatttcttctttaaaaaaattacagccattttaatgggattaaataatgtactttaaaaagtggcaactcttcattcattttccccaggaaataataataactgaaacctcctccttttttccaatgtttttgtgtattttcctctatcttatagtcaaaatatcttgtaataatgagatgagaatgggcaataataaattgtgtttacatctaaggcagttagatgtttgacttgtcaccttggttgtttgtgccttgctctcttaccctgaactacctgtatcacctcatctctcctacatcttagccacactaaacctctcaaaactctttgtacctttctaagagcaagtaagtgctctgctttgcatggcttgaggacagtgacagtaccttattcttttttgtgttctaccttccactttttttagataccacttttcatagatatcttattttttttaatagtgcttgtcttttgtattacttatttacttgtctgccacccaaacctaactgtgagctccttgtagtatgggaatatgactttgtaaccctaggacctaacagggtatttaaaattgttaaaattcttagattttattttttaacgtggccacggtgtcttctacttttggtatagaaatgcttggtattttcttccctcactcaaccttttccaattaattccatctcatcctcttaagattcatctgaaatgttgtctccaggaagcttccctgaccttgccttctccctttccccttaaagtcttcttttaatgttcttgtcagtagcctatgtggtatctgttttatactttccacattgtatatatatttttatgaatatggaattcataaatgcattacttgtgcaccccggccagactcgctatcccttttcctctttatttttccatagcatttatttgtatctgatattcaatattttttcatttttattatctatttcccaactagaatgtaagctccacgaaggacattatttttgtctctccactgctgcatctctgacacctggaacagtgcttgctatacagtatatgctcaatacgtattttttgaatgaattaatcagttaatgaataggcctgagaactacttaagagcagtgactgtggtgtattcatttttataacctcagcatctggaatatcaattctcaataaatatttattgaatacagcatttatttttacagcaggatcttttgctatgtgatattcctggttctcatttgttgttgtttttgtttgttcctaaataattatataaaaatagaaaatgcacataagcaaaaataattgtttcattcaaaataggagatgattcagtcatagtcttgtgtatatgggcgtaataattttatctaaagccatttcttataaaggtaaaactgttcattcaagggaagagaaatttctactgaactgtaaacatgaacacatcagttggctaagatttaagaaaacagctgaatatttttatattcatatttcaaagtaatcattgctttggagtagattaaaaataaaggttgtatagggtttcaggtgagttttgattaataagaaaagattacatacacatcaagttagattaagttcccaataagccaatgatactaagtattattgggaggcaaagtcatttcagaacaggtgtactatacttaatgtagtttcccttgccccctgcaagtaggatcatatcagatgagagaataaaaagagtaccttgcctttttacatattcaggattttggtctccgttgagaatgaatcttttttgttcttttgttggaaatgggctatttacaaatattttccagggttccagaaaactcagttctctgcaaccaactttcttactctgatttaattctattttgtcgtctgtgtgattctgatacttagtctgagacctatagtaacaaatgtatttccatgcatttagctaaagaacatggggaactgacattgcaaaagacagattttttttctttttaaagtgtcatgatttccttcagatgtagctaggtcctgaacagatgaggcaggagaattgcttgaacctgagaggtggaggttgcagtgagccaagatcttgccactgcacttcagcctgggcgacagagcaagactccatctcaaaaaaaaaaaaaaaaagaaaagaaaatgtattatctgtgttaggctgggcacggtggctcatgcctataatcccagcacttcaggaggctgaggcgggcagatcacctgaggtcgggagttcgagaccagcctgaccaacatggagaaaccccatctctactaaaaatacaaaattagccaggcgtggtggcgcatgcctgtaatcccagctactagggaggctgagacaggagaatcgcttgaacccgggaggccaaggttgcagtcagccgagatcatgccattgcactccagcctgggcaacaaaagcgaaactccatctcaaaaaaaaaagtattatctgtgttttaatttctgggctcaaaaggttgatctgttttgaaactattaatgttggccagtcatggtggctcacacctgtaatccaagcactttgggaggctgaggtgggtggatcacctaaggtcaggagttctagaccagcctggccgacatggtgaaaccccatccctactaaaaatacaaaaaattagctgggtgtggtggcacgtgcctgtaatctcagctcctcaggaagctgagacaggagaatcgcttgaaccagggagacggaagttgcagtgagctgaaactgtgccacttgcattccaacttgggcaacaagagcgaaactctgtctcaaaacaaacaaaattagctgggtatggtggcacatgcctgtaatcccaactacttgggaggctgaggcaggagaatcacttgaacctgggaggcgcagggttgcagtgagccgagatcgcgccactgcactccagcctggtcaggaagaatgaagcaccatctcaaaaaaaaaaaaaaaaaaaaaaaagaaagaaagaaaaaaaagaaaagaaactattaatgttatatcttaagtaatgattaaacgtcctaaggaaaactagattttataggagttaagattttggaaatattatttataattaggctggcccttaaagtcttcttgaaggaagtagattccaggctggatatttcataatgactaggattttcagagctagagaggagggtgaaggatatctgcattttcatcctatttgagggtttcaccttagctttctccctgactctcctctcctccctcccacctcttcttttctccttctttccctaatgtgtaatgtttcctctctcatttatacattttaaaattaatgttcataggatatagatttccattctcatttgtggaaaaatgacaacaggaataggataaaggagaggactgtcctcccaccgcaaaaatagatgcacacctgggcagaattcaaacagcagaagtgtgtctcttttaagagactggagactgattgctttggagatgacattgaaggataaattgaaaggatgcccattttaggaaaattttagcaataaaaattaaagctgttatcacaacttaatggtaatactcatcatggtagagaatttgaaaaatacagaataatgtattcactattaacattttgatgcatttcctatttgaagacgttttttgacaaagttgtcctttataaaatgtaatatttcttgtgggctataaaatttgatttgattcctttttaaaaactttattttaatgtaaaagaaatgtagttgaagtagctagctgtgagatagatagcaaaggccagaattctactactttgtcatcttatgtccccttatgagcctgatcatggcctcaattactgatttgtcacttagctaatatttgtgaatgagcattgaattggagtccttcgtcattggatggtttagtagaaagggcaattgggagagagttgaggcaggggtgctagacaaatcggtggaaggctcggaatttcagtctgagctcaattactatccagcttggttatttcagtggaagtatttctgtatattagaaaaaatttcttatttgtaaaacaaggagcttgattagttctttttaatgtccctttcagctttaccatttccaaaatatgaaataaatagaatcatgtggatgtaccctttgaatctggctgcttttacttagtatagcgggcttgagattcatattcatctgtgtcatatgtactttagctcaattttatttcttccctcactcccacaaaatgttgaggaagtaccaaatgtgttttcgtagtaagaaggtatagattattgcttttgggttagagagatgggaaacatgaaagaaaatagcatttgagctgagcgctgaaagacatttaaatgcctgaatcctgtgcaaagctgagtaatatgaactgttcatgaagggaagaaacctttgcctatttgatccttgactgctggctatgaagagaaaaacagaactttctgggagatgaggactctccagtgcttgaacttaatataaatccaactgtctctcagctgggtcttcactgtcactggtgctaaccttggattcacctctaatttattccctgtcacatttttcattgcatatttccagtcttctctatttctgttttgctctttcgttttctgaaaatatctgccttttgattactgaaaaaattgtagctgtctgatttgagcctcaccacctccctcttcaatactttacatttttctgtttttacctaccttctccttttttttttttttgcatctgacaaagaaatatctctctttacccccaccgcctccattatttgaattgtcttctcgtacccttcaggtttctgccctatctttcaaccgctattgttcttaccttttcagcatatcccttccacagactctttcagtcttttaagtttgctcaggttttatcaacctcaagtctttccttccaccctatctgcccctttgaattatcatcctcacgctgtcccgccagtacctgacttatgaaagaaacgatcatcactcaccaccttggcttcattattacctgcttttgcctttattccttgcaatctggatgtgtacccagaattttgttgcacttttttttattgttgattcttttacgattttatgcaaaagtaattgtaaaaacttgtatgtaaacatgaatgtagcgtttaagtactcatatctaccactgtggccataaagtagaatgttaccattcctcagaaggcttctgtaggcccaccctgaacatattccatttttctaccacaaaaataaccactatcccgaagttagcgttaatggtgacattgcttttcactcaaaatatttttccatctacatatttatcctcaaataacacattacttagatttgcctgtttccataatgaaattgaattatactgtaccatggatattttattactgatttcttttgctcaacattatgtgtttgagattcatccatgttagtacatatacctataattcattttcactggatataatatcccattgtatgactacattagaatgtttgtttattccattattgatggacatttgggttatttctaggcttttgctattacaaataatatggctataaatgactttgtacttatctcttgatacatattgtgaaaaagtccccagagtattttctttatttttatttatttatttattttttgacagagtctcactctgtcacccaggctggagtgcagtggcacaatctcagctcactgcaacctcggcctcccgggttcaagcaattctcctgcctcagcctccctagtggctgggattacaagcaccctccaccacgctcagctgatttttatatttttagtaaagacggggtttcaccatgttggccaggctggtctcagactcctgacctcaggtgatctgcccgtctcggcctcctgaagtgctgggattacaggtgtgagtacccagagtattttcttaatagtgttattgctgaacttgttctaatgttacttagtactgccagccagttttccagagcatttgtactggtttatactgctactaatagcaactgggattaaccgactttgcaattttagccaatttatcaggtgtaaaatggtatctcattggggttttaatttgcatttccatagtttccaagcagattgaacatcttttcctgtgtttatgggccatctgtgtttcttcctttgttaaattcctgttcatttatcttgcctattttttctgttgggttgactttttcttattgactcataggagttctttgtgtattctgaatactaatcctttgttgtttgtatggattgtaaatattttcttttttcaattcactttatgtagccctttgatgagcttttaattttaaagtagttaaatttatgtgttttcatcttttggttcttgataaagaaattcttcactttcccaaggttagaatgatattcttttatgttatcttctaagaatgttatagttttgcatttcacattttggcttttaatccttctgaaattttcatttttctttctttttttttttttagtatagtgtaatgtgtctagttttttgttttttgttttttaaatagatacccagctacccctttattaaaaactccaccctttcctcattgatctgtcatctttcatcccttcctcacctctgtcatgtttcaagtgttcataggtgtgtgtacctctgtctctagactctgcactggtatatgtgttgatccctatgctaataccacactgcctcaattattattgctctctaaatgttaatatcttgataatccacgtctccatgttttaaagaacatcttggccccatgccattctatgtaaattttagaatcaacttgttaagttctacccctctgctccaaaaaaaagacagagagaaaataatttattgagattttcatatgaatttactttgaatccataggtcagtttggggagaactgacatttttacaatattgagctggcatctgtctatacaactggcatactataataactgcacatttttaattactattttttttcactatgttgctcaagctggtgtcaaactcctggccttaagcgatcctcccacctctcaaatctctgggattataagtgcgagcctccatgcccagccatgtctttgtttttaaataaagttttataattttctgcctatggaacttgctgtattttgatagatttattttcaggactttgtatcttttaagtgtttataaataaaatctttaaaaattgttttcatttggaatatacaaagacaattttattattattattattttttgagacagggtctcactttgttgcccacactggagtgcagtggcaggatcatggctcactgcagcctcgacttccctcagatcaggtgatcctcccacctcagcctcctaagtatgttacttagtactgggactatactgttactaagtagctgggactataggcacgtcccaccacgcctagctaatttttctttttcttttttttttttttttttcttgtagaggcggggtttcaccatgttgcccaggctggtctctactcctgggctcaagggatctgcccgccctggctcacgcctgctaggattacaggcgtgagccaccctgcctggccacaaaggcagttttaaagtagattttgtgtgctgcatcctcattaaactctcttattctaataataaattattagattccttagaacattctgtacacacaaatcacctgcaaagggttttattttgttttttccaactcagatgttttcttttttgtcttgttttgctggataggccttggagtatgatagaagtagtagtagtgttaccagtggcaaatatccaagtttcacagcatcaaatgtgttaccggtagaaggtatttgagtcactggcggcaaatatatacgggtctgcagcaacttcaattcttgcctcctcagaagaaagaattcgactgaggggcataaggcagcagaagagaccaaggcaagtttcagagcatgggtggaagtttacttacaaaggctttagaacaggaaagaaaggaaagtacacttagaagagtcccaagcaggcaccgaggtcaagtgcagtgtttaaccttgatcctgggactttataggctggcccctttcccatgattcttcccttgaggtgggctgcccacatgtgtagtgccctccttacccttgggaggtgagcaggcgcagtgtgtttaggaagttgtagacatgcccatctgaggttttcttcccttttctggtggtgtgcccccagaaggtcatattccgccattttgtctcttaatgcacatgctcaagaaattacttctccctggtccctgccttcaattaacactttagcacaacaggtgtggaccattaggaaatggcctttccctgaagccggctgccaatttatcacttaggcaatatgaaaactgccagaccatcacccgacattcctagtgggcaagggaagagccctctgccctgctcatgcctgtctacctattgtaacagtaactggcccccttatcttcttcttaatcttaaaggaaatgcttttaatttttcaccataaactatgatgtttatttattttaatgcttattctttatcaagttaaagaaacttgtattcctatgccaagattgccccccctcccccacgcctccccccccaccccccccccacccccccccgcttctttgtgagacggggtctcactttgttccccaggcaggagtgtagtggtgtgacgtgggctcactgcggcctcaaccttctgggttcaagcagtccttcccctctcagcccaagttgctgggactacaggtgtgcaccatcacgcctggctgattttggtatttttggtagagatggggtttcatcatgttgcccaggctcatctcaaactccagagctcaaataatccacctgcctcagcctcccaaaatgctaggattacaggtgtgagccagcacacccagtccttatgccaagaatttttatcataagtggatattgtatttgtctaagagttttatgcatcttttgagatttctatatgattccaccccgccctttattgaacttggtgaatcttattaattgatttttttttttttttttttttgagacagagtctcactctgtcttcaggctggagtgcaatggcgctatctcggctcattgcaacctccgcttcctgggttcaagcaatccccctgcctcagcctcctgaatagctgggactacaggcgcacatcactacacccagctaatttttgtatttttagtagagatggggtttcaccgtgttggccaggatggtctcgatctcttgacctcgtgatctgcctgtctcgaccttccaaagtgctgggattacaggcatgagccaccgcatctggcctaattgatcttttttcttttctttttttttttttttttttttttgagacggtgtttcgctcttgttgcccaggcaggagtgcagtggcgcgatctcggctcactgcaacctctgcttcccaggttcaagtgattctcctgcctcagactccctagatctaccttagccataatattttatattagtagattaggtttgctattattatttagtattttttcatatatgtttatgaatgaaactggcttgtatttatatttttcacactttatcaggttatggtatcgaggttatgctggtctcataaaatgagttagaagtgtttctggttttgttgttctctggaaacgtttgtggaggattagaattatttgttccttgaatttttggaagcacttgggtaaaatcaacaaggctttttattctcttgggaagatttttacttacctactaattcagtttccttaaatgctgtgggactctatggattttctatttcttcttgagtcagtcttgataaattatattttctatagagttattcatttttaagttttaattgtattgacatgaaacgcttcacaatatattcttaatctttttattatctgcagcttttttttttttttttttttttttttttggagacaggttctgactgtgctgctcaggctggtcttgaactcctggcctcaagtaattcttctgcttcagcctgtctagagtgctgggatacaggcttgagctactgcacctgacctgcagcagtttttgataggcctttttgttacacttaaattgtttgtttgctccttctctcttattttcttgttccatcttaccagaagtttatacgttacaaagtgacaagattcttttgaaagaaccaagttggtgtttctattatgtggaagttttttttaatggtattcattattggtcttacctttattattacctttccctctattttctttggatttatttatttctcagtgctcttatccttatcttctctgtaccatttaatagtattaaaccactccatccttgtagctttctcatccctggctcctgaaacacactagactttttttaaaaaaaaaaaactatttttgttttagatgtagggggtaaacgcacaggtttgttacatgggtatatcgcctgatgctgaggtttgggattctaatgattctgtcacccaagtagcaaacctagtaccgtaggtagtttttcagcccttgccttctccttcccttcccccttttggaatccctagtttctgtttctgtctttgtgtcttatgtgtttaactcccacttaaatgtgagaatatgtggtatttggttttctgttcctgtgttaattcacttaggaaaatggcctccagctgcatccgtattactgcatggattttgttctgtttatggctgcatagtattccacggtgcatatgtaccatattttctttatctaatccactgttttgggcacttgggttgattccatgtctctgctgttgtgaatagtgctgtgataaacatgcaaatgcaggtgtcttttgggtagaacgatttatttttctttgggtatatatccagtaatgggattgctaggttgaatggtaattctgtttttagttctttgagaaattgccaaactgctttccacagggactgaactaatttgcattcctaccaacagtgtgtacgtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacgtgtctgtctttgcctgctttttaatgaagttttttttcttgttgatttaagttccttatagattttggatattagtccttttttggatgcacagtttgctaatattttctcctattctgtaggttgtttattctgttgatagtttcttttgatagttggttttggccctcagtgtacctatctcctcagtcctgtctctttagtttaattaaatccaagttgtctgtttttatttttgttgcgtttgcttttgagtacttagtcataaattctttgcttaggccaatgtttacaagagtatctcctaggttttcttctggggtttttacagtttgtggtcttacatggaagtatttaatccatcttgagttaatttttgtatatagtgagacgtagcggtccagtttcattcttctgcatatggtcagccagttttcccagcaccgttatagggtgcctgttccccattgtttatttttcttgactgtgtcaaagatcagttgggtgtaggtgtggggctttattttagaggtctctactctgttatattggtctgtgtatctatttttgtaccagtaccatgctgtttcattaagtagccttgtagtatagcttgaagtcaggtaatgtgatgcttctggctttattcttttttgtttaggattgccttggctattcaggctctttttggttctatatgaattttagaatagtttttttctaattatgtaaaaaaaatgatgttggtaatttgataagactagtgttgaatctgtagattgctttgggcagtatagacattttaaaggtattgatttttccaaccctcgctcatggaattattttctatttgtttgtgtcgtctgtgatttcttttaacagtgttttatagtactcatagatatctttcacctccttgattagatgtattcctagctgtttttattttattttattttattttttatttttttcaattttgtggctaccgtaaatgggattgtattcttgatttggttttcaacttgaacgttattcatgtataggaatgctactgatttttgtacattgatttcgtatcctgagtctgctgaagtggtttatcaggtctaggagtctttgagcagaatctttatataattttacttctgcttttcctatttagatgctgtttatttgtttctcttgcctgattgctctggcaaggactttcagtactatgttgaatagcagtggtgagagtggacatccttgccttgttcttaggggaaatgctttcaacttttgactgttccatatgatattggctatgagtttatcatagatggctcttattattttgaggtatgttccttcaatgcctagtttattaggagtttttattataaagggatgttagattttattgaatgcttttttctggttctattgtgatgatcatatggtttttgttttaattctgtttgtgtagttaatcacgtactgatttgtatatgttgaaccacccttacatcccagaaataaagcccacttgatcatggggaattgactttttgatgtgctgctggatttggattactaatattttttgaggattttcgcatctatgttcatctggatgttggcctgtagtttcctttttttgttgtatcattgccagatttaggtatcaagatgatgctgctttcatagaagaagttagggaggagttcctcctacttgatttttgggggatagtttcagtagaattggtacgagctcttccttgtacggctggtaaaatttggctgtgaatctatctggtccagggattttttggttaagtttttcattactgatttcgtttaattactcattattgatctgttcaggatttctgtaaacacactaatcttgaatggttttttttctacttttccaactgctccttctgtttctctgtgtcttcatgtctcctaatgtaggtgctcctattatgtctcctaatgtagggtgctccttttctcccaggcacacaaaaccaagtgctatttggttttggcccgcaatgtacctacctccacatttctagctcatacttaacttccagttggggtatgtgtgtgtgtatctgtttctctctcctttccttgtagtccaatttaggtctttatgttttacaagaatgatttccatgtaataactactttcttctacttctcacctcccagtggagcctcagttgccacagtaaaagaggttaacctaccttagcaccttaaattcctctatttatctgagtagttgtctaagagtattctttttaccttactacctttgaatactgttttgtattctgttatgaggtggttagtccagtgtggccacaataggtgacataagaaaagctcaggaaaacaaagtttattatactcacaggtcctagagacaggaggcacagcacaccatgcagggtcacatggggaagacaccagagtggtgaggaggcagaatataggagtgagtggaaggtttaggccactacctttgctggagtttctaaaggggaatagttaggccatcacctttttgcagtggcatgatcgtagctggttgcagcctcgagctcctaggctcaaaggatccttcctgcctcagcctctgagtagctggaattagaggggaaagctacccactggctctaggccactacttttgttggggtttctgtgggaaagtcaggacagagtaaacagtttaggattggctaatttgaataattttagagggctttgggaccacctaggggtcgtctctagttgcccagtacctggccctaggatgaaggcagaatattgcctgtagagtctgattgaggaagtatagctctagattggttagtttgtgtatcaaagacatgctcctgactgggccctttgctgtctccaagaattgactaaacctgggaggggcagtctctccccagccagaaaggtttttatgatgtcaaaatatcataatacattaaaaatgtaagaacattttacaatacagagaccatgccttcagctcctcctcccccccaaggcagaaccagggcacttaaatactattaccagtagaccattgtaccagggatactagacatcaatgtctctgttacttagtgctttgtgacttataagaagctttgatagcatttttatggcaacttgaaagtggaaccagtatatagaattttcacaaactccatgagagtggaatatttggttctggaagacctcctattagtagtgtgttaatcttttaagtgcttgtctcggtttttcaaaatctcatattcttttagtcttgttgatttatttaatatatcttgagcatgtttctctaatggtgaacagtctctttttcctccagttttattgaggtatgattgacaaaataatataatgctgtactatcttaaaatctccacaaagggactgatatcctgcatagagatagagataacaactaatgacaaaacgcatgactttaaaatagtgaaacttctacatgtggcttatggaagtgactacttacttgactagaatgtctcgttgtggaaaaaaataaaaaataaaggaggtgattctaattacattttattttcacgcaagttttcaattacttgacacaagcatgcattcttaattttactaactgtatatgtctaagtagttctgtagttttctatttgtggaagactttaggaaaaaatagaagcgattttatgatttttagaaagtgaaatattcatacatatcttttataattatctcaaggaaacaaatagggctctgcttcatgttctatacctaattattcattcttatttaagtaatacatctgccagaaattaggatgtgtatattggcagacgttagcactgtcttacaaacactgctgtaaggttctaactttgtgctcttctgactggtttgctctggatgtgtgtgcacatgtaagtgtaaggatgggaagaatgggatgtttgagtggtaggaaatggaagtgtagaaccatatccatggtctagacaattcttagagattcctgtggcctattatattttattcagtacataatgttctggctttttaaaataataactggatatagtaatttgaaaacaatgtattataatcccttagaaaatatttctgggtgttagggtggcatgtctttccataaattagccctattctaatatcagatcacagcagaagtggttaaaaagctcttgcatggctcacgcctgtaatcccagcactttgggaggccgaggcgggcggatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagctccgtctcaaaaaaaaaaaaaaaaagctcttgcataacatttttttttctttctttctttcttttttttttttttgagacaagttttagctctattacccaggctggagtgcagtggcgtgatctcggctcactgcaacctccacctcctgggctcaagccattctccctcagcctctggagtagctgggacttcaggcgcacaccaccacacacctggccgattttttatagagacagggtttcaccatgctgcccaagctgacctcgaactcatgagctcaagccatctacccaccttggcctcccaaagtgctgggtttacaggcataagccattacacccagcctcgcataacattttgaaaaatataattacagcagggcccttgctaatgagatacatgcagcaatctgttgtttaggattaaaggaattagtacagctattgttttctttatgcttatcatggagaaggttgctttttgccatcagattgctattcattaaagtgttcagagttaataataagtctttcttgctcttggcaaagtcgccagtgaatttcttctgtctaagccacatatcaagtaagctgaaaaatagaagagagcctcagggtgtctttgaactctgttcctgtgctagctgctccagttgctgcattcacatctgaattttcacataccatcttatgattgtaatttattatttatatttttgtttctgtttcttaagctttatcagtgtttgtgtacttgtcatgcagtcctgcttttagaagataaaccagtttactgtttcctttcttttgaatcccttctccttggaggtacttagaaaagtacttatgcaaaataggtgcctgatgaatgttggtaactgaaatctagtgctttatttcatttatttcttttaatagttgaaattattttgcttgctttctaggcacacaaaccaatggtctggactttcagaagcagcctgtgcctgtaggaggagcaatctcaacagcccaggcgcaggctttccttggacatctccatcaggtaggaatgttctgctcaaccatcagtgagagtgaaagatagaggcgtaaagtactggggcctgaggaagttatttcagaatgtgggaccttttaaattatttaaagcctagtgctaattgtgtaattgtgtcattctatttggttagtatgaaatcctatggtttagttgagtgtatagtcattgaccccacaggtgtgtgggaaacaaaagaattccttgttgtgaatggaatgtgtataacaactggtttattgtttttataagtgggtatctgtggtggctatctgatggtagcaaattatcaaaatcatccagaaagatgtagctaccattgcctgagacctgctgtgtaaggctctgagctccaagctcatttctgtcctctaaaacagttccagaccatgacagttgatttgggcaactactcagaggcttttgcttgactgtgacccccgcaccctagtttgaggttcaaaagactctgcctcaactttattaccctatgtcacaacatttttttccctgggtctaaaacagaccatgaattctgttcattcatgctttagctataatgtagagggaatgggaataaaaaaacaaacactggctactcaatagttttggaatatggaagctggttgaaaatggaaaacagtgaaaacagttgggagctagattatcagagtgtctcaacctcttgacttatgttcacaattatatattagaccaatattttggtggtctatatgtgttgatagtaatggtgctagtgatggtgcctaatgatggtagtggtagtgattcagtgaaaaacccatatgtacataagacaggttacatattaatatactgagttactgagcactgaatatatacatcttactaaagtcttttcatcaaaatatgtcatcagaccacctaaactataaaagaaattcttctacttgaaaacaggtaaaatcctggaagctgttctaaagcccatttatttgttcacagactcaaatggatatcatgtaggcagcagttattatctgttacagtgaggcctaatggaacacttttgctcaggcacatagcttcgtttatatctttgaaatggaaaaactttgacattaacttccagataaaatattaaaatgaattaacatctaaaatgaattttaaaatatattttaaatatatcctagaagaaaaaaatgttttcatgttgattttttttctaagaacatattcaagcctccagtaatttttctgggttcctaagaggaatagcatttttgacagaatttagtcaattatttgtcacctagtaagcatctttatctggcttaaatatgtgatggtccaaatgtattaaaaaatcactgagggtgcacagatgatgtgcagttttctctgcaggatccttctggatccaaattccaagatgattgcaactctccctgtaccagctccaagacctctagatctagccactgattaccaaaatcacagacccttcaataccacccagaccaaaggactgcaaacaaaagaattttatttgaaattgcgacaccattgaatctcccatcaagacacaagtccttgcatctgattagctacataattaacagtgtgacacttgccttctatttccaagccccttattgacagaattagcaccttgaacctttccttaccataattataatatacatacacaaaatcgatggctttaggtctgttgccccattaactataagttccatgaaaatggaaaccttttgttgtttacctgtgtcccagcatttaccaaagaaccccataatacaataggtgttcagtaattatttgttgaataaagtcatagatgactaaatggtcaagtatgagactactgaggaagaaatgattagcttaccctgtacaatctaagacatttctctcagggtgatttttgagctgagtcttgaggggtgttggaaactagctaaatggagttggtaaaggaatgctctcttctttttatttttaacttcctattttaaaaaaactttcaaatttgtaagagttacaacaatagaacagtgttcatctgaaagcccttcacctagaatcaccagttgttactattttaccatatttgctttataccatatgtgtatatgtatgtatgtacacatacaaaatacattttgcttttaccatatgtgtatatgtatgtatgtacacgtacaaattttttttttttgaaatgaggtcttattatgttgcccaggttgatctgcaactcctgagctcaagggatcttcttgccttgcatctaactgtgattataggcgtacaccatggcaccgagccaaaaaaaattgttttttgctaacccctttgaaagttgcagacattataaccatttacttctaaatacttcagcatgtttttcctaaaaacagcattctcttataaaactgcagtgcaaatttcaaattccagaaatttaacattgatacgatatcattttccaatattggcccatatttatatacttcctgcccacaatccagtccatactttgcgtttagctgtcatgtctgttaagtcttcttcaatccagaacaattcctcagcatgtctttgtctttcatgatattggcatttttgaagaatagaggccagctgtttgatagaatgcccatttaacttgaatatgattgttccctcaacggctgaacccaagttatgcatttttgaaaggaatacagcagaaatgatgctgagtccctctcggtgcattcagaagccgtatcatattgctttgtcccattattgtgatattaagtttgattattttattaaggtagtgtttattagatttgtccactgtaaatatgtctttttgcctcctggtaagtaatactctgtgaggcagtactttaaagactgtgtaaatatcccattcctcaacagacttttaccctgaaacgtaataagtaaaaatcacataaaatttttatcttcttcaaatctttgtacctgaagttctttccttgggctctttgacttcttagcctttaggccttaaacatattatctgttcagataggcctctcctgattacactgtattttaaatgtgttctacatatgtcttcagattttggttttttgtttttgtgtttgagggttctcatctactaacaggactagcagtttcaaataaaggacatagtagtcaattcattttagctcttaactcttcactgagctccataccaacatttatatttaatctcaggacatcttgatgctatctggtgtatacaaaatggaactcattatcttctctgtccctgttagtggtactaccattttccagttgcccagatttgaaccctggaataatgcatgactctctttttttaatctaaatccagtcaggatccttatgtagtgcattgcagagactttcatgtttcctactttttattcccactgccaccattctagtttagttttccatttattctagcctagtttatagtctctttctccctcctcagtctttctttgtttcaggacattgactgttttgaacagtgtacactggttattttgtagtgtttctcagtttgggtttgtctgattttcatcatgattagattcagattctacacttttgttagggatgcagcataagcaatgctgtattcctctcagtgcatcttagcagaaggcctgtgtctccttcctggtgactcttgtttgtgctcacttgattatttgtctgccaggtttctccactgaaaagatactattttaccctttgtgagtatcaagtatcattggagacatagctgagaatatgtaaatatcctgttactcctcagatttctcacccattagttatccattgatgactctgcctaaatcatagttattatcatagttgccaaatgatggtcttaattccatgtgtatccttattttcacataaccatgatttgaactttctgaatgtatgaaatgtattaaatgttttgacagacttttatgtgtggtttatagggtagattttctatttcagctaagagttttaagttatgattataaatgttttaaggacttggctgtgtgggtgtgtaaatatatttctactctggtgtatacatggaacattcaaaattaaaataagtagatggttctgattgtttctaataataaagaatgtatatagatagcttatatgttctttaacacaatgtggaaggttaattaaatttttagaatcttaagcattctgtgaatacaaacaatgttatgtaaggagcattcaatacaagtgtggcatggctgataatgttcatttagtgtgggaaaacatcttcaaaaaaagattaacagcatttttctgtgggacccgttggggtggggtagggtgggttgagaagggactgagcttgttcataaagttttaactccgtaagacaaacttctttgtcttctcagttctagctcggtgacacatagtagactttatttagtgatgacaaccccttgtgatgaatgtcaacagtattaaactagaacttcccctgattacttataggtccaactcgctggaacaagtttacaggctgctgctcagtctttaaatgtacaggtaagctgggacctgggattatgggtcaatcttttatttattttttcttatatttttctgtagtgagcatatattttataataggaaatgcttagaagtattaccttttcaaaattagtgaatctcgtgaagattcaaataatgataattattaccattaatgaaaatcagttttatattatgctactgtgcatgaaccaaaaatggacaggaaaagtctactttcaaagttgtatgtgtaagttcagtaaaaatgtttctaagttatactgctataacacatacctaaacacacagcctgaaagttctcttaaatgccagtttgtttccaaaagacttgttatttatcatttttgatgtcttagggagaccttatagggaagaggaaagaacactggactgagacacaagggtcttaggtttgcattctcattctgccactgactagctgtgtgacctttggcaagtcacataacctccttgggttcagtttttctcatctgtacttaagtggggacatttataagattgccagggttcctctccatcctaaaatgttaggcttctaataattgtaattaaacctgtttgtagatgttggtggatagacaatcaaaatcttaaaacttaaatctggccactttccttctttgaaccatatggcacaacatgcaaagttcaagtgttagacattgccctcttaatatttctatcaacctgctggttcctttcattatagtgtttaggtaactagcagtcaagagggaaagacagtattatggaagattgatttcagtgttgctaatgactaaagaccttgggttgagcatttcatgaaacccagttgaatatggacctagtaacacgtaggaacaaggagagaaaagaaaaagagataatgtgaccttactttctgagggagaggaggcggaaaattgccttggttgccatggtaaactttcatcccttagagagatgttggcaaacaggctgtatctccagtgcagaatgtttacagtcctgcactgtaattatctctcaatgactggcagaattaatcagagcatttatgttaattagccttgctgcagtccccaaaacaggtggtgagaaatatgcaaatctatgcagaattttaatgctttgcataaccagttttaattaccgtaaaattttctcttcgtgcccctctctcttgactgcagcattttctctctgagcttgtgtgttagttgatgggagttgctagatttaccgttctgtaaaatattaggtggaaagttctgtggatcaagtgatcattctctgagatggtatatggagaagtttcagactgaccaccaggtgtatgttaaaatattggtttggaaggtctaatgtagaggtgaattgaaaatatattcttccctttaccccctatttctagagttgaggaattgggggctatgaaaaaaatctataaatttgtgggggatgactttatttttaaaaattgtaatagcagctttgctggcattagaattaacaagtttaaaaacttggtatgtgaaactaggaaaatacaaataaaagaaaggaggtaaaccagaactcatgactgaataagctcatgttttaaatgattcctaaaagatggggttttaagtacatttcttttaatcaaccatttgcaatcttttatttcctacccaccccacctcagtctaaatctaatgaagaatcgggggattcgcagcagccaagccagccttcccagcagccttcagtgcaggcagccattccccagacccagcttatgctagctggaggacagataactggggtaagtgttcactgagagaattataacaaactttttctgtgtcagaactgccattggccaatagctgattagaattgttcaccatagctggtagtaacatggctatgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgcttcatcatgcaatggagtaattatcatatggttgagatcattacactgaaaatggcagttatccatttggcattaagacatcactgcagggtagaagttaaagaatggattagtacctgcaaaagaaaaacatttttctttaagttactgtgtaatgatctaaaataaagcatgtggcttcatatcctagctctgcaacttaccgtatggcctaattacttcatttccctctacctgttttccttctgttaaatggagatactaataatacctatctcacattactgttgtaaagattggagataatacatgtaaaacttatagaacggtgcttggcatgtagcattcaacaaatattgtttatttttgtacttgatcttagccaaaaggctgagacgttctgtcatttattttttatggttaataaattggcctgtttggctatattaagcttttaagttttcagctgtcttttctctaaggcaccattcaaaatatttttccaatgttgaaaatttgtgtattaaattatctttgtgggggttggtttagggcaatggtaaggaatagtttttattcaattcacatcacattaactcccaagaatttcctagggttttttgttttctttctttctttctttttttcccagttaagtgtgttttgtcagtggacaactgttttaagaactgttgcaaaattgttcacaaaatcccatgagtagagatgtatgtatatatatattatgtaaaaattaaaaatatatctatactttatatacacacatatcccttgaagggtattgagtttttgaatggtttggttttgagccttatgtttctaatgcacaaattgtgtttgattcttttagaggaggttgtggcactaagtgactgtacatatacttcagaaaattatggttccatcttgtttgatcaatcagaacttgtcaccaaaagaaaagtagaacacatttactactttaagtgtgtttgaaataagttgcattatgaaaacaactttaaatatgctctaaatacatttcctactttactatttgggtcttgtttttggtgactagtgtctacaatagtaagagggagttgggattctaggttcctttggctggagcttctgttaaacctgggcattagggttcatttgcatgtaaagagaacggctatcaccacctgtttcatagagataatgtgttggaaaggagatgtaaagttgcagagactcagtgctttcaataacagaaaagattgtgttagggaggggcctgtagggagacttggaaaagaaacaaatggagctcatattctttagtcatatctttggacttaatggaaatgatggaatatggcagggattcatgctaatgggaagcagctgggccttatcagttctttccttggttatatccagcatccttgttcctcattcatctgactaatcacttgctgtttggttgtgtgtaaatgtattttcatatcttgtcagtggtgattcttttttttttttcttgcttactagttaattacttttttgcccaaaccctagggccctggacaagcttgaatgattaagtccatagtggggaccaccattttaatttaaatgttctgctagtaatggtagtttgatcactgatgaacattttagctgtctgctaagcaagtgaagttgggtagctggggactgatatcatttgagttacctattttaaagcagttggcttgcattaggagactttctccttcaacactttcccataatgtgttctggttttgtttagcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggtgagtgaggaactccaatagctggggcagcaagtgaggaataaagtggcaggttttatttaatgttagattaactttttgattgttagtgtggggccttaactgcctgaggagctctagatcagtgaggtaagcggtacccttccttaccactgaattagaaataatgtttgtttgcttattgtagttgatattgtaaacatatagctgattatttgaataactgactttatattaagtgacaattcttgaataattagctggcatatttttgaagcaggggattactgtatttattttaattagctaattacagcagacatggattttttttcatgtgctctgcggtgaatgttgccacccatgtgtgagacagtgagtcatctctgctatggagtgattaacattattgcattagaatgttgtttggtttcaattttcacattttagggcaaagtatctagagataataaaaatttatttaagaagcgccaggcgcggtggctcacgcctgtaatcccagcactttgggaggccgaggcgggcggatcactaggtcaggagttcgagaccatactggctaacacggtgaaaccccatctctactaaaaatacaaaaaattagccaggtgtggtggcaggtgcctgtaatcccagctacgcgggaggttgaggcaggagaatagcgtgaacccaggaggtggagcttgcagtgagccgagatcgcgccactaaaaaaaaaaaaaattaagaagcatacacaatagtaccaaggaggaaaataaataaaatctttaatctcaagaagaggaaaaaggtataagtagatatatcagtaaaatatatgaagagttattatgagtctaattgttagacagctgtctttatccgtctcagaaaagactcagaaatggacttaacttgtagcaagagtttgactaaccatttaaaaagaactaattaactgtaagagtagagaataaatatcagactagtctttatacaatctttatcaagataatgttttgattttggccactttctcatcaccaaataaatgtttttagtgcctaagctgtgagaccctatattaacattagtctaaataagataacgttcatgaaaacactttgaaaattataaaacagtaggccaatgtaaggtgctattgttgttagggattaaatttttatatggatagctatttttggttttaaaaaattgaatactttagaacatgtggaaaagggcaaaaaaattgaatactgatttttcagttgagttagataagctgttgtcaaatgtcataagtcattataggccctttattgatggaaattcagacataacacgatcaatttttatttaagagaaagatcaatcaaatatttaaaaactgttttctcacttgatttttaaaacccatattggtctttacatgataaaaaacagaagtatatttgttctgagggaattttaaagaaacattgaaaattaggcttatcataacaatatatgtcagtccacaaaaatagtcagttgcagaggctccaggttgcttcacgtgctttgtcaagcacacacagagcataccctgtttggaatatgaaagcatgcgaagtatttactcttctttatttggatgtgacagaagtcatcagctggaagccttataattaagcgaacttttatttcagaatctccaatccatgttttaattccaatttttcaggatcttcaacaactgcaacagcttcaacagcagaatctcaacctgcaacagtttgtgttggtgcatccaaccaccaatttgcagccagcgcagtttatcatctcacagacgccccagggccagcagggtgagctcctccttagagcttattagtggtataccaaggctgttcgctgaatgttacacatgcatgaactactatcattttggccctgaaactattagaccaatgtttttattaaattttatttgattataaactttcgtttaaaaaaagttttgttttgttttttgtcataaataccacattattgaaggttgccctgaactgccattcatctgcttaatcactaaggaagaaccaagagtttggccaaaagtctaagtgaaattattcaacatgccaaacataaattggataagttgctgctagtgttttgattgtttttcatggaagtgtattcaaagaatatagactgagtgttgaaagtatgtgcttctaaccattgtttttttaatttaaggagggaagactgctataatagaaactacaaatttcgtgagttataaaaaacatctttgagtcatttgagtggtaaatgttatataattaatatatcaaacaaccactcgtctgtaaggtcagttaatgtaatcagggtgaagaatgtcagagtatcaaggcttcaacccaaggaacattagtgcatcactaatgattctttattatttctgagtgggtttttttgccttttttcttcttgatcattcattccaaaatcttttgtcatgaaataattattctagcatatattcaagattcagagataagtaattcagtatttacttgcagagggctcacaatttagtggcagggaaacagacctaaattatgttagatttgatatgcacacaatgctatgggaaccaagcaaagagacccctgtaactttgtgctcagataagtcttcacagtgaatttgggaaaatacattcataggcttacaaaagagagaatgtcagtcttggaaaatgaacagcatttgcaaaccttagaaacatggaagaaaaatcaataagctgtgtttgagaactataagtagtgccttacaactgcagaataagtttgcatatgcaggtaatagtgaaatttgaacccagaaagattagcagagaccagatcattaaagaaccttagattaagtttccaggagtttgaccttaaatcctatagcttagtgcttcctaagatttgatttatttaagagtcattaatggccaggcgtggtggctgacgcctgtaatcccagcactttgtgaggccgaggcaggcagatcacgaggtcaggagatcgagaccatcctagctaacacagtgaaaccccatctctactaaaaatacaaaaaaaatagccaggcgtggtggcaggcgcctgtagtcccagctactcaggaggctgaggcaggagaatggtgtgaactgggaaggcagagcttgcagtgagccaagattgaaccactgcactccagcctgggtgacagagtgagactccgtctaaaaaataaaaaaattaaaaaatcacttgaggaattagaaaagtttcctgagccctaaccccaacctcccaattactttttttcttatttttaaactattaggttcagggttacactcaggtttgttatgtagataaactacatgtcatagggatttgatgtacagataatttcatcacccaggtaataggcataatacctgataggtagttttttcgattctcatcctcctcccaccctctaccctcaagtaggccctggtggctgttgttcccttctttgtgtacatatgtactgaaagttttatggctgtatagtattccgttgtgtatatgcaccacattttttttaatccagtctagtgttgatggatatttaggttgattccatgtctttgctattgtgaatagtgctgcaattaacatacgcatgggtatgtgtctttatggcagaaaaatttatattcttttgggtatatacccaataatgggattgctgtatcaaatggcaattctaagttctttgagaaatcgccaaactgctttccgcaatggcttaactaatttacattcccaccagcagtgtataagtgttcccttttctccacaacctcgccagcatctgttattttttgagtttttttgttctttgttttttgggattttaagagatggagtttcactcttgttgcccaggctggagtgcaatggcacgatctcggcccaccgcaacctccgcctcccaggttcaagcaattctcctgcctcggcctcccaagtagctgggattacaggcatgcgccaccatgcccagctaatttttttttttttttttttttgagacatagtttcactcttgttgcccaggctggagtgcagcagcacaatttcagctcactgcaacctctacctcctgtgttcaagcgattctcctgtctcagcctcctgagtagctgggattataggcgcccgccactatgctgggctaatttttggtttttagtagagatgaggtttcactatgttggccaggctggtctcaaactcctgatctcgggtgatccgcccacctcggcctcccagagtgctgggattacaggcgttagccactgcatcaggcctttttgtttttttgtgtttttttgagatggaataaataggaaatggattcacaggctcctcgttcttgctctatttgtttgtttgtttttgagatggagttaaatggcatgatcttggctcactgcaacctctgcctcgcgagttcaagcgattatcctgactcagcctcccaaggagctgggattacaggcatgcgccaccacacccagctaattttgactttttttttttttttgagacagagtcttgctctgtcacccaggctggagtgcagtggcacaatcatggctcactgcagtcccagcctcttgggatcaagcagtcctcccaccttagccttcaaagcagctgggagtacagtgtgtactacctcacctggctaattgagaaaaaaaaaaaagttttttatagagacatgtcttgctgtggttgcgcaggctggtcttgaactcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagaggtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagattgccttcattcactttcagcaaagccaagggcgttgtctttcccttttcatatctgggacctcattttatttcaattttatttgtctcaaatcaagatagtaggaataatgaattactgttcattctgattttttggtacttgcaaaagtatgtgtatgtttttaaacactcccccaacttccagacttttataagattgggaaaatagcacagataatgtaatactgattggccttagagccagtgaccctggacaactcacctaacctttctgagtttcccatatttccctttttatcttccccttcacttacatgggtgaattacaaaaaaagttttactaccctaacatcaggaaggtcattataatgtagtagcaaagagcatagactctaaagccaaactgtctctttgtgaatcttggctctgccacttacctgtgtgtcctggggaaagttaactttatgggcccctgtttcctcaactgtgatattaggatactttcagtgttcacctctaagagttgtagggagtcaacgagtaaacacatgtaaggcaccttttagaaagctgcctcctacatagtaacctttctaaatctttgctgctgttatcattatgacattatcatgataccagtatcatcctcagtcaacaaacgatagataactcagagaatgaaaaggttgttcctttatatagtttccctagaatcaccttgtaccactgctgctgagttgcaatcattcgttagtcgtatgtgacctagattccattttctaagattattcaacaatgtagaggatcagcgtagtggaaatacgtctataaacatttctaagaattgaattcattgtaattaatagcatcagagaagctgaaaatccaaagagctaatctcttaacttcatgatggaggacaaagattttatcttttggaattttaataatgtttccagcatgagattagccttcaatattgatttctggaattctgttttcccttgtttttcattgattaacctaaaacttttgagatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaagaaatgtttttggttagaaaactgttgttcatttgagttttgtttgggttttcattgtttaggtaagggaaagtggcaagcgttttttttttgttgttgtttttgagatggagtcttgctctgtcgcccaggctggagtgcagtggtgtgatcttggctcactgcaacctccgtctcccaggttagaaggattcttctgcctcagcctcctgagtagctgggactacaggcgcatgccaccacgcctggctaatttttttgtatttttagtagagactgggtttcaccgtgttagccaggatggtctcgatttcctgacctcatgatccacatgcctcggcctcccaaagtgctgggattacaggcgtgagccatggcgcctggccaagcattggttttttaaaaagttctaaacctctatgggccctttcagccttttcagctgaccttgtttgggggtaaaacctaaggtttgaatttgtttacttatctgcttttgtctcttacagattaaactaactttcattgttaaactttaaagaaactcctatgttgaaatagcctatgtttaatggaacttcatttctgacctttgtgctctcttctctttttttttttttttttttttttttgagacagagtcttgttttttcacccaggctggagtacagtggcgcagtcttgtcttaacacaacctctgcctcctgggttcaagcaattctcttgcctcgcctcccgagtagctgggattataggtgtgtgccaccacacccggttaatttttgtatttttagtagagatggggtttcaccatgttggccaggctggtcttgaactcctgacctcaagtgatctgcctgcctcggcctcccaaagtgctgggattacacacatgagccaccgcgcctggccctctctttttttattattgtttttgaatattctttagtcttttcaaaacaattttatttaattagttttaatagttaacatagttttgttcctctagactacccttcagtatttttcaaaccagtaaagtttgatattttaattaattcactcaaaaattagttgagtgcctgctgtgtcatatagtgctctgatagttagggatgtattttgaacaagatgcaggccctgccctcattaagagacgtcaaatagtaaacatgtaaacaaatggtttagataccaataagtactagtcaggtagcggatcatagtaatctggtaatggttaacctaaagaagaatgggcccatggtctggaaaagtctctctggagaagcaatatttgaattgggaactggtgaggaaggatgagggagaggttaccacacctagaatctgaagacaagagtcttgtaggcaaaggaatgtgaaacacctgagatgggaacagcttgacctgatccaggaaaagaaaagccaaagtagctggagttcagtgagtcaaaggaagtggtagaagttgagatacgatagctagacagggccagatacctagggctgcatagattttgttctaattctaatataaggccatgacagcattttaattgggaaataataagattataaagatcaccctaactattatatggagattgaactatagggagacacttggggaaggaggatggtcatttaaacttccataaacctgccttttaagaaatgtttgtagtaatatatgctgaattttatttaatcatatttgcttcaatatatatttcacttgtcccagatcagcaaaagtcagggttctttagaaaaattcaaatctatttaatatatttatcttatttgtgacctacattatgaaataaatattagtatcttttgatagcttaaatttaggcagtgcttagttacttataaataagtgataaattctatggctaatctctggcaggcttaagtgttctggctgttgtcctacatattacaacatttaatatatccaaatttagtaacctaatgaaatcataattaggaagctattgcctcagataatcttatcacatattcaaaagaaaatggtaaaatcccttttgtttggtgtgctttgtcgaatactttctaccattgctcttatcacagcaaacataatcttgtatttagtattttagcaacagcattttatctgaaactctttacttaaactctttactctgtatttaagattaaatccttaaatacagacattctgggttggtcctgtctatcagtttctgaaaataaaaagccatgtattcaagtaattgagcatcttctacaaacaaagagtttgtatttctactttgaatgtcagtttgtcatcatgaagcattggtggcattacattatcaattatttgaaactaagacagttcagtgttcatgcagatattaatagaatattttacatttcaactttattatcaccaacaggcaaatgtttgataaagagaacttgaaaatgcttcttttcctctggtccaacatacgctggcagtttctaatggattctaggttaagaagttgagctctttttggaatttccagctgtttctatttagaatagttttttaactttcatcccattctttcctaaaataaaggattgacctatcacagagcttattcagattatgccaaagacatatcagttttaatttaatgttgtatatcttctcttccaagttgtaaaacaagattgaatgtaaggcaaataagataaataagagttttgataccagtaagactaccagagatcaactggaaattttcagctcattttctgattctttctttcttttgccatgtgttcgaagaaatctttaatgtttctggataacatgtttttcttctacaggtctcctgcaagcgcaaaatcttctaacgcaactacctcagcaaagccaagccaacctcctacagtcgcagccaagcatcaccctcacctcccaggtcagttttcttctatgggggctgctttctcttatcatattgtttggggagacttttggactttatttaatttttttttaaatctaataaaaataattcggtcttcgaaaactgaccagaaaatcaaagctaggcttatcagctcaatgctaccaaatcaatatagtctttgaaaatcttcagagttcctgtttcttatatgttcttaaagaataactgcattagcagtaaatgagtaatgagttctagctatgtgacatctcccctcaccatacttggcggtagatattaccacttaaactggaaacctagtgagcctcagttaaaaatccattgttaccctttaccctttctcagaaactgctaagagattttgatctctatattttcttttttctcaatgcttttatggtgctttagctcatttctactagaccatataaacactataattatattaaaaaaatttagacatataaaggtttaaattatagacctgattccacttcttatctagctgttgctttgaacatgtcattttatctctctggacctcagtcttctcatctataaattaggtgactgaactggctgatcctgaatctccttccagctctgactttctttgtctgcagtatggaagttatcacttaatactaacacattaccagatttgacagaattcagcatccatttatgataagaactcttgcaaactagatatagaaggtaactttcttaacctggtaaagagcatgtattaagaaaaaaaaaagaaaagaaaaaaaccaacatcatacttcacgaaaaactgaatactttccccctaagatcagaaacaaggcaaagtgaccagttgccacttttattccacattatactcaaggtgccagtaatgcaataagacaataaaataaaatattaataaatgacatacagattagaaaggaagaagtaaaactatcttagttgctagatgacatgattgtctatgtagaaaatcttaaggaatctaccaaaaaaagctactggaataagtgagcttagcaagtatgatacaaactcaatatataaaaatcatttacatttctatacactagcagtgagcatttggaaattgaaattaagaaaaagaaatttacagtacttaggggtaaacaacaaaatatttgtaaggcctatacaaatagttctatagttgaaaactatagaacattgctgcataaaattaaagacctataaaatagaaagaagtaatatgttcatgaatcagaagacttaagttaaatgttaaaatgtcagtttttcccaaattgacctctagattcaacagtctcaaccaatacctagcaggcttttttgtagaaatttgcatactgtttctaacatttatatagaactgtagaaaacacagaataaccaaacgattttgagaagaaaattgaaggactactgatgtcaagaataattataaaactcaagtaatgaagacagtgtaatactggcatatggatagaaatagagatcagtggaacagaatagaaggtccagtagatccacatgtatatggccaactgatttgccaaaggtgccaaaggatttcaatgggaaaaaaaaagtcattcaaaaaatgcagctgaaacaatagggaaaaaaaataaaaaaccttgactattatttcacaccatgtacaaagatttgtttgatgggtcatagacctaaacttagagaaaaaagcttggaaaaaaatctttgtgtccttgggttaggcaaggatttcttaaataggacacaaaaagcaccataaaataatggataaatttaatttcataaaaatcaaaagcttctctcaagtgaatgaaaagaaaaccacagatggggagaaaatatttatgaaacatatctgataaaacatttgtgttcagaatgtctaaagaactcattcaagttaataataagacaatctgatttaaaggaatgggcagcaaaaaaattggagatatgtcaccaaagatgatatgtaaatgtccagcaggcatatgaaaagatgctcaaaaaccgttagtgatcaggaaaatttaaatgaaatatcactacacagtcactagaataagcaaaatttaaaaggctatgacaaaaccaagtgttggcaagaaggtaaagcgactagagttctcatacattgcttagtggtgttgcaaaatggtatacacactttggaaattattttggcagtttctttttgggggggtgagggggaggcaaggtcttgctctgtcacccaggctggagtgcagtggcacaatcacagcccactctagcagcctgacctcccaagctcaagcaatcctcccgcatcagcctcctgagtagctgggactacaggcgtgcatcaccatgcccagctattttttgtagagatggggtttcgccatgttgcctaggctggtcttgaacccctgggctcaagcaatctgcgtgtcttggcctcccaaagtgttgagatgacaggcgtgagccaccgcaccaggctggcagtttcttataaaattaaatgtgcatgtaccttgtgacccagcagttctgtccctagaaatgaaagcatacgtccacacaaagacttgtatgtgaatgtttctagcagctttattcacctcaaactggaaacaacctaaatatacatcagctggtgactaggtaacataagctttagcatatccatatgatggaatgctactttgcagtaaaaagaaacgtgcttctgatacatgcatctcctgtgaatctcaaaagcattatactacatgaaagaagacataaaagactgcatacagtatgattcaatgcacatggcattttagaaaagacaaaactaaggtacataaaacatattagtggttgccagggacggggggctaatggtggggattaactgcaaagggaacaagggaacttttgggagtgatgagaatgttctgtatctactactatctgtagtaactgctactgcaattagtagcagttgtatgactgtagttgctgaaacatatactttgcccttttaaatggtgaatttgtgaatatgctgaatgcaagagtgaggttgggattttgaaaaaagcctataccagagacttcttcctggcctccgttctctgcatatggtggcagggccgttgtggcttcatcctgactcctgctcactgaattctactctgccatttctagatctggcccagtccagcctgaggtttctggagctggggtaacttatctgtaaccaccccatctaaaggtacccaagcgatttttagtcctttattatttgagaatggggctacttcaggcccggagatgaagtaacaatgtgatagttaagactcacctgtaactgtcaaccagtttcgctgtgagaaatgtacagctacataggggtctgctatggttggtgctcgttttggctcctccaaaatggtcaggttgaaaattacgcagtgtcagcatgacatagaaatgaactttgttattgtcattgaaacaggataagagaggaacttaactccagttgtcgcctgtgtaatgcttattctgtagttttctgggacagttagttcctttggaggaagccttgactcataaggtaaaggtcaggcttatataactcatctaaatttgaagaagaaaaattcacagccacagactttatctgtaattctggtttataatcgctcacctgggctactcttcacaggaggagtcaactgagcaactaagatgcagtcaggcagtgcctcccactagtgaggtgtgttccactcagggcttgtgaatagaacagaataaccttaagtttgtgtgataagaaagttgagtattttatttttaaaaagagactataccctcatgtcccaaaataaactatacatggatttaaataatcaaatattcaacaaagaagaagctagcagattaaaaggaattttatcaatgttagaaataagtgaagctttctcagatttgaagtaacaggatatattagaaaggaaaattaaaagctcacccaaatgacaatttaaaggtttatgtaccctgaaaaataaaaggaagaaagcaaattggaaaagcatttgcattaatatgacaaagcttcctttataaaatttgaggatctctctaaggataaggatgagaataaatatcattaatatataaattggttaaggacgtaaatccaattcacattcaaagaaatacagataataattgacacatgggaaaattttgacattgagtagtaagagaaatacaaattaaagcagcagggaactaccatttacttcttgaattagcaaaacattttttaaaactgctaacgtaagtcatgtggaagagtgttgcatagtgggaaccaacgttatgatatgtatcaaaaaccatgaaattgtttatctagttaccagaaaagcccttgagaatttatctcaaaagaactaattacacacataggtggaaaaaataactaatatgcataaagtttttcattgtgttatctatgttagtgaaaacataaaaactgtctagcaattaagaactggttaagtaaattatgagaatattgccttagtttttaaaaaggataactatgaaaactgaaatactcctgatttcagtagtccaagctatcaaagagtaagtcagtggtagtgcttaaaacaaataaaaatgctatatatccagacaactatttaaaccattaaatatattcactcttctttaaaagtcctcggttagctgacaaattccagaaaattaatttggattttggttaatttggggttttcatcttctatagattcttgctcgattaactggtgttagcataggcttagagagtatgtgtgcctgtgcttgcatgcctgtctccatcaccctctctcttccaaaaagttatttttatttttaatttttattaatttttattttttagagacagtgtcttgctctgttaaaacaacgttaaataagaaaagcagagagtaaaattttgtataccataattacagtgaaggtttaaagatataggtccttggggaaaaaactggaacagatatacaaaagcgaaacctgttataagctatttaaactgcaggtggtttacttttcccccttaatgattttgaattatgatcttgaatactatttttataatactgtgtcacaggttggagatgtaatagtggtaaacaagacagatatgctgtctactgttttgacagttgaagtgctagacttatgaaatagattttttgaaataaagagtaatttattaaaagacataagatatatgtattcagaccatttgaaaacccagttataataggtttcatttttgtgtattcatttcatttttgtgtattcatgttttttctatagaattacataattacttgtaattacagtatacataatttcactgtctgctttgctcactgaacattatgttgtacattctgtagtgttacatggtcttcatcgttatccataaatgtggctctttccttcagttgtttacttggagtaaacctaaatatctcttcacgtgtttttcctcattgttttattctttctccaacagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcaggtagggtgaattggccttacattgattcccctccttggctgggtccaaatacagttggctctctgtattcatggattccacatctgtggattcaactagtccaaaatatttgggacgggggacgaaaaaggatggtcatgtctgtactgaacatgtatagacttttttcttgccattatttcctaaacaatacaacaatttacatagcatttacattatattaagtattataagtaacgtagagatgatttagagtatatgggaggatacacgtatgttatatacaaatatacattttataatttggaggacttgagcatcagtggattttggtatccaagggaggtcccgaaaccaatcccctgtgcatactgagggacaactgtatttgctttacatgtccaaagaggcttctaagatacaatatgttcctcagccatgttgttttttggttttaaactgcacctttttgttagccttttcctgcatttttaatgtatggtttaatgttagtctagaagctttatgatttctttcagaacacaggcctctgaaatcataattatatcactaaattgtgaagactttaaaagattgtatggaggattttgttatttgaagaatatctggtggtagacctcagtacttcatatgtaagattgagagagtaaagattacggggtgtattatattagctaaaaggggaaaagtttagaaggcttatttaaaaacagttttttgtagtgggggcagtagctctaatctgtaatcccagcactttgggagactgaggtgggaggattgcttgagcccaggagatggagaccagcctgatctctggtgggaccctgtctctccaaaaagtaaataaataaaaaatttaactgggtgtggtgacgcatgcctgtagtccaagctatcaggaggctgaggtgggaggattgcttgagcccgggaggtcgaggctgcagtgagccatgattgctccattgcactccagcctgggtgacagagcaagacactgtctctaaaaagtaaaaattaataaaaattaaaaataaaaataactttttggaagagagagggtgatggagacaggcatgcaagcacaggcacgcatactctctaagcctatgctaaaaccagttaatcgagcaagaatctatagaagatgaaaaccccaaattaaccaaaatccaaattaatttcctggaatttgtcagctaaccgaggacttttaaagaagggtgaatatatttaatggtttaaacagttgtctggatatgtagcatttttgtttgttttaagcactaccactgacttactctttgattaacctgtcataaataatatatttttttagagacagggtctcgctatgttggccaggttggtcttgaactcttggcctcaatcaaccctcccgccttggcctcccaaagtgctaggattacaggtgtgagccactgcgcccagcctgcaaataatacttttaaagcaggcaaggaattaaactgaatgaaatttatgtaaaatggtataagatcattaggtaaaaaaaaactgaagtatggattagactgggtgcctttatggaatcaggagaaatctgttattttctttccagggaatataatttaaagtttttaagccactagttaaatattactcaaattattttgtgttgaaagtacggtaatgctccacctggcctggtaggtcaaaatccaagggtagcatccccaaatgtactatgggtgtttttaagaacacatttatatatatctttatatatatcttttttttttttttttttttttttttttgagacagggccttggtctgtcacccaggctggagtacagtggcatgatcacggctcactgcagccttgacctccaggggtcaagggattctcccacttccgtctcctgagtagctgggactcaggcacaccaccacacccggctaatttttgtagagacgaggtcttgtcatgttgcccaagctggtctcgaactcctgggctcaaccaaatccacccacgtcagcttcccaaagtgctaagattacaggtgtgagccaccaggcccagcccaggcttatatttctttgggaattcatttttgctcaaagaaatcaattgtgttggggaatatgtaatgattttttaaataggcatgattttagaggaaatacagttacatttgtgaggagtttgacttgtgaagaagcaaattatccagaaacattttaatactttcaaagcatcttaaatgatctgacctgttttaaaaagaaagctaggccgggcacagtggctcacacctgtaatcccagcactttgggaggccgaggcaggtggatcacctgaggtcaggagttcaagaccagcctggccaacatggcgaaaccccgtctctactaaaaaatacaaaaattagccgggcgtgctggcgggcgcctgtaatcccagctaatcaggaggctgaggcagggacagtggcttcaacctgggaggtggaggttgcagtgagccaagatcacgccactgcacaccagctttgggggtgacagagccagactctgtctcaaaaaaaaaaaaaaagaaagaaagaaagctaaacatagaactagattgatatgagtaagttacaaagctgaaataagtataaggttagcatatttagcagtgcctcaagttttaaactattagcacagcatactctggggttccctgagagattgttgcgtaagtgatatgccaaagatgttaaggcttttaaaaatccttatcttttactcaaatagtggtttgcctttctgcatttgacccaacatattgccagtgttatgtttttctctccctccgcacatctctccaggtaaaggagcttccctatggtctggtgttttgttttgtggttttatcctattttttggcatgaccattccttatttttcgaaatgactttgagacagcagtggcaatggttcacaaacttggactatgtgggttaaagtacatactactgctgcagaatggaaaatcagtctatcaacctctgtttttaagtcagatacttcaattttagttattcaaaggttgctctgtgtccaatttatttatatacacacacaaagttttagccattaaagttatttgctgaaacaaaaaaagctctattctctgtgtaaatatacacattattagatgttttaaagttattttctaatttcataattgcttattaaaggattaccatggctgtctttgcataattagaaaacatgtcatagcataatacatttatcacatgtggtacattcattatttcccagtctcagtttttgttccttttttgttatgttctttttaaaaatatcaaagggatataatatagttaagattatatatgaatcgactacttaaaacatttacttttgtgagtgataacccaagatggttgtgagttggattatcacgaaagagcattaaaccaagcctgtaccgaattaatgaaaattagtatgttaactgaggagtctgttgctttttattcaattaagcaatttaaatgtgaaataaaacatattaataaatgataaagtgagtttattatttattatcatggttctagttagtgaatggcatagctttatttccagccaccaccttaaagtatcatttcttataattactgtcatgattttttaatatatattttatttacttatttatttattttttttagagagagggtctcactctcttggctctggctggagtgcagtggcacaattatagctcactgcagcctcaaacttctggggtcaagtgatcctcccacctcagccttccaagtatctgggactacaggcacatgcaccacacacagctaatttttttgtgtttggtagagatggggccttctgtttccaaggctgttgacttattttttgcttgttaaattgttacttttataataagacagaagtttgtgaaaatttgtagcttattgtgcagttactatgccagaaaacacttattgccatctaactgctacataagtttatatactcaaagaattgcaaggtttagttggcaccagctgtaatctaaacaagctgaccatgacatgaatatatgtgatacacaatgcataagttcaatgcttgacatatagtaggcacttagtgaatatttgattgaatgaagtaacattttattttattttattttattttattttattttattttatttatttttttgagacagagtctcactttgtcacccaggctggagtgcagtggcatgatctcggctcactgcaacctctgcctcccaggtttcaagcagttctcgtgcctcagccttctgagtagctgggattacaggggtgtgccaccacacccaactaatttttgtatttttaacagagacgggggttttgccatgttggccaggctggtctcgaactcctgacctcaaataatccacccgcctgggcctcttaaagtgctgggattacagttgtgagccaccgtgccctgcctgaatgaagtaacattttaataaatatatagagatacaggtatagataaacataatcatctgtgtctttagacatatttgtatacagtataatggatagcatttatgccctgctcaccactgattctgattcttgcagttttatggtaattggaatgaaatcaataaacagtctacttcagtatattcagaactgtcattaaaactttctgtgatgatggggtgttctgtacattggacatgggatgtccaatacaatagccactgtctacttatggctattgagcacttggaagggctagtgatgctgaagaactgaatttttaatttattgggttttaattaatttaaatagccacttgtggctggtggctatatgggaaggcagaggatatcaatcacttgaagttcaggtattctgggtgcctcattttgtcttacatttcaatatttctcatctgttaaactttttatcagaagttgctcaccaaaaagaaaatggggttttaaaaatatgttacttttttaacccaactaccacctaataaaaaatgtagtattcaatgtgctaataaaaaatgtagtgttcaaaagatggatttaggggtaggggggaatcaaaagactgggataatcccagttcaaacaagtgttgccaggatagttgagagttggctgtctcatagtaggattagttgtatagtactttggaccagaaatgatgttgcctttctgccctgtcactaaactaattgaaatgaatgggtgaatcatttaaactccgtgagcctctgtttcctgtatataaagcaactatcttacgcttttttcccagtttgatcaagagagattcagcaagaagaaaagctctgtatacatttcaaaggttataggcttatagagaaagacatcttttgtaatatattcagggcatcattgttctattgctataaggttactaagtttccattgcccatgaaggtttgactaaatgggtcaaacctctctactgtgaatttctatttctatgatggttacaaaagtagtcttttagaatacctgttttttgtaactaactttgaaatccaaactaggagtgaaaatagatttttttttcactgcgtccagaaatacttgatagggaaaagaagaaaagagatgatttctaatttttaaagtgatttttgggaagtttgattagttcgtaaatatcttgggttatctagagagttatacataatatctgtaggtgatacagataaatttatttttatttttcttttttaaatttttttctttttttgagacaggatctcgctctgtcacccagactggagtgcggtgccatgatcacggcttgctaccgccttgacctcctgggctcaagcgatccttccacctcagcctcccaaatggctaggactacaggcacacgccaccatacctgcctaatatttgtattttttgtagatgttttgccatgttctccaggctggtctggaaatcctgggctcaagcattccacccatgtaggcctaggcttcccaaaatgctgggattaaaggtgtgagccactgtgcccagaccagataaatacatttttaaaaattacttaaatcactttggttgtatcaattaaggggcttgttagaatattagcactatttttgatacctagttgaaattttggtatctccatgattacataaggtggcaagaagagattcaaaatgggaaagtatgtgggacagtattgaacattgtaacgatcaggcctaaaagagtcctcacagtaacactgtgactggcttagggatggagtttatgtgggaccccgtaagtggaataattactgactccttgtctaaagcagttattggagcaacaccccagagtgaaggctttaagcactggtgagataactctgtctttcctctcctcttctcctgctctgtattgtgtgtagggtgatgttgggctcgctatggggaaactatatggaaatgacttcagccaaactaccatctctcgatttgaagccttgaacctcagctttaagaacatgtgcaagttgaagccacttttagagaagtggctaaatgatgcaggtaagtgactgtataagacatttctttgtcattcattggaattttacatggggattgttatataaattggggtttatatttcttactctatttttgttgttacagaaccttgaagcttactaatcctgggaggatcattataaattatggtgatataaatcagaaagctgattcatttaaatattctagtaattacagtataaataattagccgtaatttttagcctgaaatactcttgtatttgagccaggattaggaacacacacacacacacacacacagttgaaggaataggataagtaaggcttttgtatttagataagcttgaagtagaagcttattgtttcttccttgatgaattatcatagaacttgttcttgcaatagttctgcttttgttatttcaaatgaccacacatttcattcagaaaagttggactactagctttgtcttacgtttttttgtgctgagagttccttttggaagattggaattttgagtcacaggatcatagactatgaaagctgtaggagtcatgtagatcccttaaactatggttcttattgtagatatgaacaaaaattaggcctttggaaaagacaaacctgaaacacgcatccttggacagttttattcagtagctatgggtgaggcctaggcatctgtttcccaagtccacagataagaaccactggtttactgtttccatcttattttacgtgtagcagaaacaaactcagatgtgtatgacatgcccaaggttattaaactgtgaaattatagaaccctgtgatttaacttcagagaatttataaatatttcatttgtttcttttctttttaccctagattataccaataaaatgagaggccatttacaagataaatattaaacgttcagtaatttctaagaaactttcttccttttatccccagaacttataaacaaacagaactggagacatagagctgagtttaaggataggaatagtaaacctcttctgtctcagaaacagaaatccaaacatagtggtaatattgtcaaccatcctagcagaaagaatgccaataagggcagcagaaatatccatggtagtaaatatatatatattggggggatgggtggtgggtagggggagacatggtctcactctgttgtccaggctggagtgcagtggcaccatctcaggtcactgcagcctccacctcccaggttcaagtgattctcctgcctcagcctcccaagtaactgggaccacaggcgcacgccactgtgcccagctaatttttgtatttttggtagagatggggtttcaccatttagccaggctggtcttgaactcctgacctcaagtgatcctcccgcctcagcctcccaaagtgctgggattacaggtgtgaaccaccatgcccggccaataagcaatattgtaatgtaggttatgtgaaaaccttttcatacttggatgtagcttattttgtcagttttgttgttaatatgcatattatgcacatgaatcactgtgctcagctaattttatttctgtattttcttcattcttacagagaacctctcatctgattcgtccctctccagcccaagtgccctgaattctccaggaattgagggcttgagccgtaggaggaagaaacgcaccagcatagagaccaacatccgtgtggccttagagaagagtttcttggaggtcagtgaggattttacttttctgtacatgggattgtctgtgtagtacttaacattagtacttagtagaaactgtaggtggtaaaagatgacatgtcagcctctgctcttatggatgattataaataggtgaagtaagtaagttactaacataggagacagaaccagagttctgcagggttcaggagagactagaatcacatccatgcaagcactcagtatgagagaggtggcagcttaccataggatacataggaattaattccacagactagaaaaggtggggggaaagtactttaagcagaggaaatgcatgagcgtttccccctcagagtgggggagaaacactggagtgagggaaaccatagggtgtatgaggagacactctagtagattagttggttaaattgtagtgtctgtatgcctggaatagtagtttgggactggaacactagagaccttgagtgttaggctatggagcttaagttaatgcaagagatatttggcaattatttttttgtaccaggtaatatcataacaaagcttttaagaaaattttgacttctctaattcagaaaagacttgagcacattgggaggactctgaattaggagtttttgtcagctctgccacttaaactgtgtgattgggcaaatcatgtgatttctttaagctaaaggtccttcatctgtgaaatacctgcctttcttactgtgagatccaaattagatagcatgaagcatggagaaaggttaaattcctactaatacatgtggttgtactggtattttgttaatttcattcacaattaatagatcttaaaaatgaaaaactatagatatttaaggataacttatcctaagttaatatgaataagtttaataggtgtatgttcattagaacttctatctacacaatctctttgttgaaagtggcctaatgtggatggtcatatgtatcccagcttcattttctaacctgacgtgattatgccagtagttcaaaaagttattgcaaaggatagcttttggaattacatcttttcaccctgcagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtaagaataaaaaatagggagtgcaagctcaagggctaatttttgcaattttacaaatgacctgttaaatcagtttatttcataatagtaatttaatgaataaatacatcaaataaatgcatgtaaatttgtattttagacattaccaaggtaatgaaattctcattctctctttccttgtctctcgtgctctctctctctctctgctgaggtcactggtcttgaggtgcccctgcatggagggtgaaatctcgtgttgttattaacccaagaacttattggtcttgcttattttttatttatttttctatttattttatttttttgagacagagtctcattccatcacccaggctggagtgcattggtgcgatcttggctcactgcaacctccgcctcctgggttcaagcgattcttgtgccttggcctcccgagtagctgggattatagacgtgtaccaccattcccggctaattttttgtactcttagcagaagcagggtttcaccatgttggccaggctggtcttgaactcctgacctcaagtgatcccttggcctcccaaagtgctgggattacgggtgtgagccaccattcccagtctttttttttttttttttttttttttttttgttgagacagagtttcactcttgttgcccaggctggagtgcaatggtacgatttcagctcactgcaacctccgcctcctgggttcaagcgattctcctgcctcagcctcccaaagtagctgggattacaggcgcccgccaccagacccagctaatttttttgtatttttagttgagaccagggtttcatcatgttctccaggctggtcttgaactcctgacctcaggtgatccacctgcctcagcctcccaaagtcccaacgtgctgggattacaggtgtgagccactgcgcccagcccacctatcttattttttaaagtgaacaattttaattctttcatcacatttccatcatactcttctctggtatagttcattagattactctgtaaccatgggagtaaatttgctgctgatcccagttatctcagaaaatcttgttactttttattcatgttgagtcctaaagcccagtttattaaacttacactcacgtgattaagtgacaataagttaccagataaccttcagttctgaacttgtattaaaacaatcatctcaggtcttttactttgaaacaacatatgatcctttcctgtgaagcctcattgagtaacttctgctgtttgcattattcctagactgaagagacatacagtggtcgtatgactcccttggtttttaggatgattatgaatttgacttctacattgtcaggattcaaaagatgggaatattgttgagtttgcatttctgttctttttaaatttggttttattttatttgaatgtcattccatactggcaggctttttaaactaaggtcagcattaaaagcacatgttagtttatgtgaaggttgtagttgttaaatggtgggcctgtagtcataaagttatgagatagttatgaaaaagataattattaatcaacaattttgttttgtaaaggtgatgtttgtgttttagatttgtactaaaagaaagacagtatttcttgcaaaactagaattttttgttatttcaaaactaatccgttttttttaaaagtttgcttcacattattttcataattttattttattaaaaccaaacctaaggcaatactgcccccctacagagtcaaaagtaaaagtaatacatgtaccccagattccctgatcctgtcaaatagttttcttatttaggtaaagttgataattagtataatgtttcttaccgacttagagtatatctgtctcaacgctattgaaatttacgaactttttattatttatttttaaaacccaggcaaagctatctgtgatatcagtgaacaaccatcttcgaatagcagctttccaacataggatgtcaggtgtctcaattccaagatcaaagaaagactgtaaaatcatttcctctttaagttttgattttaagtgctttgtccatgttttcatttctgacctcaaggtggcgaccacaccaagccttgtgactagcagtgcagcaactaccctcacagtcagccctgtcctccctctgaccagtgctgctgtgacgaatctttcagttacaggtaagcagctgccaggccatgcacctgctgagcacatgggaggcccgttttgggttattataagagtctaccattaaattgtgaattaaggccctaactaaagataggtgttgctcataaatatcaattttctttaaagtaactcctttccttaaaagccttcaatagccgtggctttttgcattcagaaaaacatccaagtttgtcaattcgtgaaggttatttccggtctgaacctgatctcccactagtcttttgcctacgcaccctcaacacacaggaggcctccatccatacctttgtaaacatccctacaatggaaatgtccatcttagcctgcagttcttgatctgttactgataaaactataccagcttgtatgtcaattttcttggaaatattctttagctttcccaggaaactattcatttccatgtacctgtattataaatgattttatttttacacacctgtctttcccaatagactgcacttctcaaaagatttgattattctttttgaactcttgatgcctagctcagtgcatgacatactcactataaaatgaatgtttttttttcctttggcctcttttaaatagcaaattttccagataaatttaaaatcacttagcattgtcatcagatgttttttagtgatacatagtgcataagacatgctgtaattattcaccaggttggttatttgctagtacatcattgggtagattaatgatatttcataatgaagcttgatttaacctagaggtagggacttttatttttctcacccatgttttaagtttacaatgcctccttggctctatgacctacccatgatgtaaaaattgaataaatggctttatattatattaaatttctacattattagaacattttgtttattgttttctgcatccaatcatccattaatttttgcttatgttaaacagtacttcttgacctcttctggatgttggacctttttaagaatttgaaagctacagacttttcctcacacaaaatagacatatacacaatttttagtaaaatttaaggagatttataaatgacagctcccatcaacctcccactccaaggctatttgtggatacctacaggttccagttttaataaccttggttcaagaatatacttaagaaccttggttaagaatatatataatattgagcacttccacttaataagcaaactgttagtgattgattggcattgtgttgggcaccaagaatgtgaagaaccatctctgaggaccttgttgtccaaattgactgccagtcacctggtaaattatgaactgaatcctaccttcccaacaaattatattgctttaggtctaaaaatacctgtctcttacagaaattttgttaatagtttacacattaagaacaaatagctttgcagttttcttaaaatatggggaaaatcaaagtaattttagagagattttaatactcaaaactagctaaaaatttgcatcagtttttgatacttcttaccactcacattttcttgaactcttactcagcctatttatgtggatctatttgtgatttttttctgacacgttgataatttttcctggagtgaattttttttaattattaaaaacattattaggaaattcaaacaggaaaaacaatcacaagtaccatttttattttctctttaaatcctttttatatgtacatgtatgtacagtttcagtagtatttgtgcagtacagtatttgattgcagccttgtgatactctaagcagaggactcaggctctgcctggacacctgacccacaaaaactatgagataataaattgtgatgatttaagctgccgaatttgtgtcattgctccttgaaagagaagaagagtcagtgtcaagtgggttttcttttcttactcttttatcagccgttgctcaaaaccatgcccctttttaatttgtttttcctctttggactgtaactttcttgtacagcctcttttcctctgatatttttatactgccttctttttttctctgttgagaaaagtagcatgtttctttatcatgttatttattaaagacggccattgtcttaatcatacaacttatgtaatgcaatctgctttcttcctgaagactttcttcttgggatttctatgattgcttattttaaattgttttccttgttttcctgagttagatccaatgtttctcagatgccctgtcatcctctttgattcctttttgtctggagcacgttctcaagtaattttatttagaaaggttacatgggaggtaaaacttctaaatacatgtataactgagaagtatttattttgccttcacagttttttttggagtttgtccagttacaaaagtatttttcctttgaattttgttgtgttttagcatctagtgttgctagtgaaaagtctgatttcaatctctttttccttgttttttctctctgtaaaccttaagggttttttaaaatcttatactgttctaaaatttcactacaaggtttcaaagaaggggccttttaaaacttgccctcattggccttcagcaagcattttcaatgtgaattaatgtatttcttgcactctggtaatttatctttttttttttttaagttaggattttttggcattcactctgtttattcattttgtgtcatttgtaatgtgctgttggcttttttcattgtctggtgatttttgtagtgatgaatgcaagattacattacttattatcagtagcctgtaagggtttttcctgacattgtgtagcttctgttactcaagagtcccctcccctgaatggaagggctcgcggtgagctgtgaatgtgaataaagaactgccaaactttatttcagcctatgaacaggaagcaggcaggcaagcgaggctttctgtcatacttttccaaaatgaggggtatctttcctcatgcatgcaagtacctacactagaatccttagcgttccatagtcagattttattttctttcaagagtaggtgactttggttctgttcatttgagaggtctggtagaaggagggaaaggcccactgtgagagctattatgtgaatagcccttgaatcaccctgttctctgaccctatttccatctacctcagtatctgacaaataactctgagctgggactctctgtgaggctccatcagagtgaataatttcctcctctatcatagtcttctcctgtgcccttctggattatggttgatttctccaccatccagttttatcctttttctcatttctgcaaatctgtctaaatctcaaaacctctgatacctgtcaccagagctctttttcccttttgtatctctttactattatttggaataggattttagaaatgaagggaaaaaccatatccttagcactatcttctaagaaaaatcatgtttgattgatgtggtcatcttattttcccataggtacgtttgacacataataggtccttggtaaacattctaaaatagatgcaagtgagcattgccatactcctccagaaagacgagtgttccattgtgtctcaaaaacttgtaaaaattccacagcccttaataatctcaaccaaacatgccccgcccccaattcattttccaaaatatttttcatagtgacaaaattgttgattcctcaggaagatatagcaactataattatatagccaccttaacaacaaaggcccaagatacaggaaacaaaaaggaataaaattcaaagaagaaatagacaattcaacaataacagttgcagacatagtatttatttgagccacgttaaaaaaaaaaaaattcaggccatgtgcagtggcttatgcctataatcccagcactttggtaggccaaggtgaaaggatcgcttgggtccaggagttcaaaacctgcctgggcaacatagtaagaccttgtctctacaaaaaaaaaaaaaaatgagcaaaattagccaggcgtggtggcacgtgcctatagtcctagctgctcgggaggctgaggtgggagggtcacttgagcctggaaagttgaggctgcaataagctgagattgtaccactgaactccagcttgagaacagagcgagaccctgtttgggggaaaataaaaaaaagccgtgaaggatatacaacatttgagcactatcaaccaacttgttctaactgccatctgcagaacacttggtccagcaacagcagaaaacacatcctttttatgtacacatggaacatccatctcccaggatacttttagccataaaacaagtttcagtaaattaaaaaggattaaaatcatacaaagtgtgttgtctgatgacaactgagataaactagaaattaacaatagaaagaaatttgggaagtccccatgtatttgaaaattaaaacatgcatcaaagaagaaataacatttctcctctattttcctatcaggccggtattacccagatacctaagcttagataaatagcacaagaaaaaaaaattacaaactcatattcctcgagaaaatataaaccaaaactctcaaaagaatcttagcaagtcaaatccagcaacatactgaaaaaatcgaacgattatatacatcatggccaaggaggatttatctcccaggaatgtatggttagtacaataactgaacatcaattaatgtaacacattataatagtagaagaaaggacaaaaaccacataatcatctcagtggatacagaaaagatatttgtaaaaatccaaaacccattcatgatgaaagctgaaatacaaaggaactgcctcacctgataaagagcacttactaaaactctccagcaaatagaatacttaatggcaaaagactgaatactttccccactaagattgagaattaggtaagagtgtttgtttgctcttgtggacttctgattaacatcgtcctggaggttatagcctccagtaagggggagaaaaaaaacggaagacaatttggaaaggaagaagttaaactgcttgtatttgcattattctatatgtataaaaatactaaggaattcaccaaaaaaaggtatctaggactaatcaataaattcagtattgttgcagaatacaagattgatatataaaaaataaattacatttgtatgtactatcaatggacagttcaaaaatgaaatttaggaaataacttgtatgtaacagtatcaaaagaataaaatacttaggaataaacttaaaagaagtgtaagacttgaacaatgaaaactacaatttgctgaaagaagttaaaagaagtctaaataaagagacatttcatattccatgttcatgttttggaagactaagcattcttaagatgacagtttttctccagcttgagatatatgtgcatctctctttctctctgatttcaaggtttatccacattatagcataaatatatatttttttattttatttattttatatattttattattattattatttgttttcgagacagggtattgccctatcacagtggcgcaatcacatttcactgcagcctcaacttcccaggctcaagcagtcctcccacttcagcctccccggtagctgggactatagccacatgccacccgcccagctaatatttgtattttttgtagagacgaggttttgccatattgcccaggctggtctcgaactcctgggctcaagcaattcacccaccttggcctcccaaagtgctgggattacaggcatgagccaccatgctcagtcttccagcttgatttatagattcaacaaaatcatagtaaaaattccaacaggttttttctttgttttgttttaaagaaatcgataaactcttggaagggaccaagaatagccaaaacaattttgagaaagagtgaaatcagaggattttcatgtcctgctttcaaagtttactgtaaagcaacaataatcaaagcagtgtattactggtatacatatagatatatagattaaatggaacaaaattaagagtccagaagcaaaactttaaatttatgctttattgatttttgacagaggtgccaaggcaattcaatagggaaaggacagtcttcaacaaatggttctaggacaactggatatccatatgcagaaagaggaatagaggaatttagatccttaccttacaccgtgcataaaaattaactgaaatggatcaaaggcctaaatataagagctgaaactataaagttgctagtaaataaagtaggacaaaatctttgtgaccttgggttaagcacagagttcatatacacagcaccaagagaacgatccataaaagaaaaaaaaattagtaaattcagcttcatcaaaagtaaaatcttttgtgcttcaaaagccacagactgagagaaaacatttgcagatcacatatccaataaagaaattgtgtctagaatgtataaacaactcttacaactcaatagtaagaatataaacaactcagatttttaaatggacaaatgttagtagacattttaccaaggaagatataggagtgactagtaagcacatggagagatatgtgacattagcattactcattagggaagtgcagattaaaactgtaatgagatactactttgtactcactagaatggctataatcaaaaagacccaagatgataaatgttgggaaggatgtggagaaactggaactttcatgcattgcttgtaggaatgtagaatgatacagcttcggaaaacatcttggcagttcttttaaacataaatttaccgtcctacccagcaatttccccaagagaaatgaagacatttctacacaaaaacttcaatgtgaatgtttatatagcagccttatttataatatccaagaactggaaacaaaccagtgctcatcaactggtgaatgaataaacaaaatgtgttatatctacacagtggaatattattcagccataaaaattaatgaggtgttgattcgtgctacaatgtggatgaaccttgaaaacagaatgttaagtaaaagaagccagatgcaagagactacatattgtatgattccatttgtgtgaaatgtccacaaaaatctagagacaaaaagcagataactaggtaggagtgtgacatgattacaaacaggcacaagggatcttttttgggagtggaaatgtcataatctggattgtgatgatggttgtataactgtaagttgattaaaagtcatcaaattttaaagctggatgaattttcatgtgcttactagtcactcctatatcttccttgttaaaatgtctactaacatttgtccatttaaaaatctaagttgtttatattcttactattgagttgtaagaattgtttatacattctgacacaattccagttcctttattggatatgtgatctgcaaatgttttctctcagtctgtggcttttgaagcgcaaaagattttacttttgatgaagttgagttcactgatttttcttttcttttatggatcattctcttggtgctgtgtctgtgaactctttgcttaacccagggtcacaaagattttgtcctactttatttactagaagctttatagtttcagctcttatatttaggcctttgatctgttttagttaatttttatgcacagtgtaaggtaaagatctaaattcctctttctgcatatggatatccagtttataagttgtatctcaataaaagctgtttgagaaaagacaagacagggcgggaagcacagggaagtgccaggtactatatacacaccttgactatagcttcctactgcccctgtgaggtggttggtggtatcttattttgctgttgaggacattgaggctcagcaacaataagttcactagtcaaagttacccaagtaattaaattgccaagttgccaagaatttacagtcatgaaatacatatattgatgaaaacatgactcactgactgggataattaatttgaagataattttaagttgttataccataatgcttatttatataacatttatattggagacgcctagaacaattttgaatgcttctggagtcatcatcttctggcctaggttaaattcactgataaaatttgactgggattttctttgtaaacttaagggatttaagaaaacagttggtgaatgatttgaaggtggctggagagtaaagaaataactattttaagccttttgagctcaagatattaggacttataaaaataggcaattcaatttcagaactttgaaagggaagtagtacccataggtaaaatcaggttagataaggtgagaaattggtcaaaaaaagattgaaagtacattgaaattgcttagcatggaagagaaataaaagatgttcaccttactatgtgacagggggcatgtcttaagagaagattaaagcgaaaaagggtatatgaatctgcctaacacaggaccctacacagcatccagtgttcagtggttgattgttctgagagatttagaaccaaagaagtaatgaacgaaaataggattcatagtatctacaaagatgtaatgatatttaggggcagtggcaataaaaataaatcacttatatttttcagaagggtagacagaggaagaaagccttcctttttatttaacaataagaacattatgtttacctcattcatttggcagccacttttgcacagctttataggaggtgaagaaagtagtcagtgctgaaataaatgatgtctgagtctctcccaaccctgtgacatgtgataaaaactgaagagtggaagtgagagttcaattctagatgttcttagtacagaccagaagaaggttttaaaacagatttttggaaggacaaaattgcctgaatttgtaacaagattgttatgaaagaagagcatgttctgaagcttggtaaaagatttcatcaccaaaaaatgttattattattattattattttttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggggtttcaccacattggccaggctggtttcgagctcctgacctcaaatgatccactcacctcagcctcccaaagtgctgggatcacaagcgtgagccaccacacctggccttgtcttaccattttcagtggggctactagaaatttttaaattacatatgtcttgtatttctgttagacaacactgatctcaaacattaaataatcccagcaaatgtgttttagtgtttagtaatgatatatttaatgtcagttagtcatttatatccaaatgttcattctccttaaaccaaaagcatattcaggcacttttttctaagacctcacaaataatttcttttttttttttttcttgagatggagtcttgctctgtcgccaggctggagtgcagtggcgcaatcttggctcactgcaacctccgcctcccaggttcaagcgattctcctgccttagcctcccgagtagctggaactacaggcgcgtgccaccacgcccagctaatttttgtatttttattagaggcagggtttcaccatgttggccaggatggtctcaatctcttgacctcttgatctgcccacctcagcctcccaaagtgctgagattacaggtgtgagccaccatacccggcctacaaataataatttcttagatcttaatttttatgcttttatgagattcatagtatcattgtatgttgttttttttttttaccacaatggactttttgagagctaatttttattacagaatagttgtttgaatgtagagaaggcatgtagtcatttttatactatgttgttgttgatactgaattcttagaaaagcatataactttctgtttttcttctccttgttttgatttttctgaggagacccctaaggagatttctgaatgaaaagagctttacagaagtttttcttcttttgctttctttttcttccccagagcagttgtattccataattagagcttctatgattcttttgtttcttgaataggaaacaggcaatggaaaacttctctgtttctttcattgctcatatctcttaaagtagggttcctagctgtgatcctaaaatgtttggttttgtagttaatttccataaaagcactaaactaggttattaaaggacagctttactaggtggtaggttaattattccattgattatagagtttggctgagtaaagccaccattcttccaaaaccatttacaaaaggtcatcttctaatctgtttgtcttttcaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctgggtaaggcgctttctcatctcattcacgtctgaggtggaggtcatccctggaattactcacaggggagactttacatcactgacttagatggggaaaaaaatgtctttaaagcagtaatctctttgaagtgggctgttttgtgatcatacaaggactttgattatagttgagtttatgtttcttaacaccctgggaagggcagtagtcatacctttgtttccagatgaagacccaaaataccaggtcactaattaccttagtgacggggccaggaagaaagcctagaattcttgactcttattttccccattaaactctctcaactgcctacttcctaattctcaagcatagataagagatgtaataggagtctcaattttatactgttattgtcacacattataagaattatcttgtaaatatatctttttctctagaatgtttctttcattttggaaagaaagagaaataagtctttcaaagaagggtcaaaatgactataaaagttttacattttgtgctgatcataacctcgtttgtatgagtaagcatccaggaaagcagtaactgagaagcacaaaccatagaagagtaaagaaaaataaatatttccacctatttccccagctggattttcgttttgtaagttccttttggtgtgttgtcaaaatgagacctgcgtctgcatggtaataaagtgactcctcttttggacttgcagaggtgccttactcagtctgaatccagggaccctgagcggtgctctcagcccagctctaatgagcaacagtacactggcaactattcaaggtcagtagaagcctttttcttactttggtggcatgcacgtgtgtgtgagtgtgtgtgtgtgtgtgtgtgtgcttgagacagagatagaggaagtctgctttgctagaggtaaaagtgatgggaaagagtcaaatgctgactaacttgttcttgagaactaagaaaatgtcctcgtaaaaaagctttgtaagaaaagtataggtgttagtatgtgagtaaaagcaggaaatatacttagtttggtatatggtaaaaaaccagaactttcatgctaatattgatcttatgtgagtagacttgaagccagatttttttcccctgataagtttatcccaagtattaatctaaaacccgtctctaggcaaacttgaccaagtaagactctccagttcccagctgcactcctgagaaagctgtgcatgggaaagtcctgtaatgaacaaacattggaacacatcaggtggacctcaggagtgcttttaattctcattaagttctgctctttttatatcgccgttagtgtagaacatatattctcttggattataatgtctcttttccaagctcagctgggttccttttgccttttagcatgttacccagggcaatattcattccatatactgaagggttccacttgtttagtacctaagctttctgtctaaaaatgtttactgttatgtgattcagggagacaatttgagagacatcactaattaattagaatttttttcttaaaatagttttgctaagaggctgaggcaggaggatcacttgaggccatgagttcaagactgcagtgtgctatgatcatgcctgtgaataaccattgcaccccagcgtgggtaacacagtaagaccctgtttctaaaaaaaaaaaaaaaaaattaaagtgttttgtgcataaatgagaattctcagggccaaaaataactattagccaacctaaattaagattaatatttcacaggtaatatctctaacagtgtactagagaatgttaattacagacaaaaccaaaccatggcctagattaccttacattatattgactttctgattgactaaatcatacctgaattggttagctctaaagcttttgttatataataatttttttttgcaatagaatttgtgataaatcactttttcttctgctttattgaatgtttctgtgctgtgttgatactacaaaggcaaaatgtcttccctagggcatgattgacactctgaaaagatactaagtttggaatctcagaaaaacttcaagctgcactgtctcactgttctgtactatttgtatgagcaaggccaaagtcagaggcattcccttcagctatattttatgtaagaaatcaaatgtgtaatgccgttagaaaatccctcaaatctacatgtaggagtgaggttatatggctagagagatttaggaatgttgccagacaacaggttgagatactaaatgagagtctcgattattttaaataaaatgttgatgatgccttctttggggaagcaacagcatcatagaaaatttctcacccattaaagcacatcctagacttagatcacccacctacatcattatgtctaatttcctgctacaatagattcatcattctcctttgcacaagtcatagaaatcaagtatttagcctcaggaagtgagaaattaattataccttttaactttatttggtgatacataatttattttagaactaaagcctttttgcaagatgattttcatcttgtatatcataatataaagcagtggtccccaacctttttggcaccagggactggttttctggaagacagtttttccatagccacattgtggtggcgtggtttctggatgacactgtttccacctcagatcgtgctctatgagaatctaatgccgccactgatctaacaggaggcaggcctcaggctgtaatgcccaccactcacctcctgttgttaatgctttaatcacttcagctagtttgtcctttgaacagaggtagtttaaaatcagcagtcttcattaaagacaaaattattggatttatcaaatatgtctaggtaaatgaaataaactggtgatttcaagacacgaacatgactctaattcattagacagttattagctgtcttctacccctgcttgtgcccattaaattagacatttcagtcttttaggctcttcaaaattaaaaataaactacaattggtatcaatatagcactgtgtttgaggaaaaaaattcagtgaagggctatactttttcctggtgggttgtaggaaaatgatagacttttgatgtgttatttggcttctccaggatgatgttaatgttttcattcctgcctgttttggggggtttttgtctgtagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaattttta

SEQ ID NO: 16140 - DNA, 10029 bp, Human; identical to SEQ ID NO: 11846
  misc_feature (1)...(10029): n = A,T,C or G

SEQ ID NO: 16141 - DNA, 10095 bp, Human
accatgttgcccaggctggtttcaaattcctggcctcaagtgttccacccacctcggcctcccaaagtgctgagattacaggcatgagccaccgcacccagctgaattggtcatttttatacctaatttttcccaagggtttattgagtactttcaaggcattatgctacatgcccagaaactattgctgccttcaaggaacatccctctatctagtagagggagattgtatgcatgaacatatataaaaatgaaagtgtaagtgtatgtagaactatatatggagtggttggaagtacaaaagagggagtgtttttttcttcttatggggtaggggggtaatatcagaaatattcatagagggggtgactcttgaaggatcagttttctctggaaggttatggcctttgaaataaaaattattccagatagagcaccaggagtgaaggccttgagatgtaagatagcctaggcatgttggggcccatagtactgctggagtattgtttgtgattgagatcataatgaaagataagattggagtattaagcagagaccaaattataaattttaagtgccatacaaaagagctttgattttatcttttagacatttgagagccattaaaagactttgggctggggagtaatgcctagtgttccattactggaatactaagcttgtgggagttatttatatcctcctgctcaaggtcattgccaaggtctgatctttcacaaaaacaatttgcaacctcccacgtaaatgggttaaatttgtgaagaagtcactggcagccacatgataatgatttgaagggggagtggtgcaaggcattctaaggattctaaggagaattctaaggactataaggagaatctaaactgaggatgacatgtgagagtctaaactcggtcaacagcattagtggcaatggataggaaggggtgagtataaaaaaatgtaaacaatagtcactaactatgagtgaaaagaagattcagagcaagtttgagtttatttttttatttttttcagacagagtctcgcccttgttgcccaggctggagtgcagtggtgcgatctcggctcactacaacctccgcctcctgggttcaagtgattctcctgcctcagcctcctgagtagctaggattacaggtgtgcaccaccacacctgggtagtttatgtgtttttagtagagacagggtttcatcatattagccagtctggtctcaaactcctgacctgaggtgatctgtctgcctcgggctcccaaagtgttgggattacaggtgtgagccaccacacccagcccgctattgtttctaaaggtttgaaaatctactctaacccccttttgagataatgaaaaagctgaagcccagaaggattaaattgagacctggtccaacgtgtttggaattagttggggaactatgattagaaccacgttctcttaattttctaacccaaaatttagtaaaccctatacccaattattgcacttaagattaaggtggttagcatcttagtgttaatgagaaggtcttgttgctgaatctgtggtactagaaaagagtccttatgtgcttagatgttgctagttaaaagtggcagcaaaagtacatagtctgagctttacatgaaacatgggagctccaccagtaatcccagcatttttggaggctgagatgggaggatcgcttgagcctgggagttcaagaccacccttggtaacatgatgagacccccatctctacaaaaatttaaaaaataaattagttgtgcatggtggtgcacacctgtgttctcagctatttgggcagctaaggtaggaggatcacttgagcctaggagttcaaggctacagtgagctataatcacaccattgcactccagcctgagcaacagagcgaaaccctatctcaaaaaaaaaaagatgggagacagttcttctgctatctgcctactgagacttttcttttttttttttaaggggtatcatcttatttcgtccttcacatctcactaacaagtttgaggacaagactgtggcatatacagagcaaaaaatgaccagtggcaaaattaaaaagtttatccaggaaaacatgtgagtacttctttgtatcttgtctgggatttatttgcttgattttagtttgtttacctcagttattaagccgagctatattttggcgtaaacagtctatttggggggattgtaatagtaatagtttgagtttatattaaagcagtaatgtgtgggtgttagaactcctgttgtcatcctgtaaggtatatattgctcagtacttgttctaaatgtttaaaatctctttccttcataaatgctatcaattattttgtggcaactttatgatatagctaaaaacttggcaagccagttgataatggattatttcatttcagttttggtatctgccctcacatgacagaagacaataaagatttgatacagggcaaggacttacttattgcttactatgatgtggactatgaaaagaacgctaaaggttccaactactggagaaacaggtaataagaattatgtttttccctcatgaacaagtttacccaatgtatagacagtcccttctaactatcttgttggttccttaagaatctgtaaaacaataaatggttccttaagaagaggtaaaaaaaaaaaaaaaaaaattaaagtaactatcctgttaccatgtgtggtataaaagcaggaaagaatgggaacatttggcttccaaattgtctacaattgacttcaaatggctacatttgaagccataaggacaaataaactgttttcacaatctgttgggcatgtatttcgtaggtgtttctttgctttgtgacacagtgactccaagtagaaggtggaaatttgatataaaatgcacttaaaacattgtgcttacttgcacattgagcctctcagtgcattttacccttacaaattttcttttcagatcagttattatgcctataatagatttcagttatatattacagcaagatttagcaggaatgcaccagttgattgggtatcaccaatttgccagtgaagttcagtaaggcattgaagtatatcataaccctgtgtcagtgcccaagagctcagactgttcagactgattccagaaggctagaactatagaacttagtctttgctttccaatcacttgcttcttagtttcaaaagtgcttgaccaccctgtatagtcttggcacaaatgtctcttgtttcccacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgtgagttgctagttgggctttgattctccaaggcaattattaaagccttttatactacaaaggatttctaaagaacaataaccctggaatgtgaagataggtcttttaatcaagacctatgactgtcatttttctcaatttaaatataggtactttagaccaggcgtggtggctcacgcctgtaatcccagcactttgggaggccaaggcaggtggatcgcctaaggtcgggagttcgagaccagcctgaccaacatagagaaaccccgtctctactaaaaatgcaaaaaaattagccaggcacggtggtgcatgcctgcaatcccagctactcaggaggctgaggcaggagaatcgcttgaacctgggaggcggaggttgcggtgaaccaggatcgtgccattgcactctggcctgggcaacaagagcgaaactctgtctcaaaaaaagaaataaataaagaaaaataaatacatataggtactttaaggattatgatccttaatgaattctgaaaactaatgaaaggatggcaggttggaattcttacatgattccacttggtcattagaaatagcagataaagggtgagcacagtggctcacacctgtaatcccagcactttgggaggccgaggcatgtggatcacaggagttaaagaccagcctggcccacatagtgaaaccccgtctctactaaaaatacaaaaattagccgggtgtgacggtgcgcacctgtaattccagctactggggaggctgaggcaccagaatcacttgaacccgggaggaagaggttgcagtgagctgagatcatgccactgttctccagcctgggtgacagagcaagactctgtctcaaaaaaaaaaaaaaaaaaaaagaaagaaatagataagattggacagcctcctttgggccagatgtggtggctcacacctataatcccagcactttgggaggctgaggcaggaagatcacttgatcacttgagcccatgagtttgaggccagcctgggcaacatagcaagaccccgtctccaaaaaatttaaaaatctaaaaaaagattgaacagtctccttgatactgacgtaatttcaaaccaaaccattcccccccctcatccctacagaatgtattttctttttgaaatagcacatgggtctaaagtgaactcagaatcgggaagatctgaagaccccggaaacaatttttaccctcactttctgagattttgggagattgagacaagagaaaatcttccttgtgagccagtcaataaaacaaaatactgtaaatagtgtgctccagagcaataagaccttgttttcttacaaagatgaatctccagaagaccaatgattctcctttctctgaactttgtaatccacaaagaacacactagaaataaaaggaacggtttgtttcttcagtcggtagttctgcatattgagagatgagagtcccccttttttagccttgaaaagctaaaatacatagtaactattcaaagaaattgctgtaattttctcagcggtgggaatagattaacaagccttacccttgttttccaattgtaggcgtgatgggaaggctctggagaggttcctgcaggattactttgatggcaatctgaagagatacctgaagtctgaacctatcccagagagcaatgatgggcctgtgaaggtgaggtgctcacagcctcatcaagctatgagcaattgcctgtcctcatttctttgttccaaaactgtggggtctaaatgaagacttcgttggccatctctttttttttttgtccttactcccgagtcataaaataagcattggcaggccaagcggtggctcatgcctgtaatcccagcactttgggaggcaaaggcgggcacatcacaaggtcaagagtttgagaccagcctgcccaacatggtgaaaccccgtatctactaaaaacacaaaaaaatcagccgggcatggtggcgggcgcctgtaagcccagctactcgggaggctgaggcaggagaatcgcctgaacccaggaagcagaggttgcagtgagtcaagattatgccactgcactccagcctgggcgacaagagcgaaactccatctcaaaaaaaaaaaaagcattggcagggctcataatgcttggtaggggcaagcgtgtaaagcctgcgtagaattttctgatgaaatttatattgggctaagttactcttgaggatagagcaacccctaagaacagtgtgttgctttgaattttttatagggatgtggtcttactctgttgcctcagccttctgagtagcttggactgcaggcatgtgccaccaagcttggcttgaaattattttaaggaatggttgggtagcacttctatgtcctgtaacttcctgaacatagtttgacaggtgacagacataggaacgagttggtatctagtgaatgacaacatctttaatacaatctgtaaatgtgatttgggtttccatgacttattttctgtggtaacacatcaaattagagagggattgggtctaggaacaaatacagttgtgaatttatttttttatgttaccaactagagattcttctgtgttttccaggtagtggtagcagagaattttgatgaaatagtgaataatgaaaataaagatgtgctgattgaattttatgccccttggtgtggtcactgtaagaacctggagcccaagtataaagaacttggcgagaaggtaagtgtgaaccctattctgaggataacatttgagcgggagcagtaagtttatgtatgtattcagcattggctaatttggttggttcctaagtactgatagatttttttcccaattacttgctgtttactcactttctcgtgactgccccctagtgctccagcctgtgcagtgcctgagatacccacttttaacattccattcctcaggctcaatctagataatggttaaaaatatctaaggacttctgaattttggtaatggcttacatgaatccatatggtccttcatcttaaaacatttggcttagcccctgtaatgtcttattcagaccaggtaaatttgaaggtggcaatatgtagagtcttaatacaagagaaaaaagggaagcttgtggaaagtgaggtactaccatctgcaaaccactcttcccacatgaacagcagtttatctgctggaattacaggtgcgcaccaccacacccggctaatttttgtatttttagtgtttgaagaatgagattgttttaagtcttcaattgactaagtgtccctctgtcactgaaaacttgaaatgtaaacatttaacctgttttattaacagctcagcaaagacccaaatatcgtcatagccaagatggatgccacagccaatgatgtgccttctccatatgaagtcagagggtaagtggcttaaaacttaacaaaagtgtctaggcaatagataggaataaagcttgtaaccaccaggaaatcattactagacatagttttcatattcagttgaaggcagaaccactgattccttcttggcttaagagttctgcagtatgggcccacataactgcttgaaattaataaatgtttctttccccagttttcctaccatatacttctctccagccaacaagaagctaaatccaaagaaatatgaagtaagtgaattgtcccatatccccacaaatatatacacagacgtaaacacacaaccttaaacatagttctttaattgggtttatttatttatttaattattttttgagacggagtttcgctcttgttgcctgggctggagtgcaatggcgtgatctcggctcaccgttcaagcgattctcctgcctcagcctcccgagtagctgggattacaggcatgcgccaccaccccggctaattttgtatttttagtagagatggggtttctccatgttggttgggctggtcttgaactcctaacctcaggtgatcagcctgccttggcctcccaaagtgctgggattacaggcgtgagccaccgtgctaggctaattgggtttatttaactaaaatctctttaaactctcatgggcagtatatgtggctgctaatatgcttttacaaactcagaagtcttcctgtttgggtggggcagatcagggttctttaaaaagttacacttttaagctgatctttctgttttcagggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagttttaattttttagccatgttggtaaaagttcattttcagtacatgggtaacacccaggccctttcccattatatccaggtatgctacaagttcttttaactcttatcagaagttattattactgtttccttagagaggctaccaggctaaaattcacttagtttggtttgtctaatgtcctcattattttatcctgaagatgatgtcatttctcaggacttgaaaatgacttggctgaactaaaggtaaaaaagccaagcctctgtcacttttcctagactcctaggcacagctatggagtctttgcacagtgcccataccctaaaaattaataatgaaaaccaaacctcaagaacctagagcagctctctacttgccaccatggactccagtggtcagcataagaaaagcagatagttgcattctatttagtttatagctgctttgttcctttgtgtttcactaagcagaggctcaaaaattcccttgataacttcagctgcccctgttcttttcctcaaactccaggatgagacctttaatgtgggacaatttctggtgaaggtactcacagcgacgcttttcttctctgtaacttgggtactgctgcagagaaaaagcatccatgtcaaaaagtaaaaattctcattctaccttgcttccgttcccagaccttgtcttaccttcctgaactttttatattcctggattatcttgtcttccaggacctgaaacagaaattactagcactgagttcaacattaagaaatgagagaggggcggccaggcatggtggctcacgcctgtaatcccagcactttgggcggctgaggcaggcagataacgaggtcaggagatcttgaccatcctggctaacacagtgaaacccgtctctactaaaaaaatacaaaaaaattagctggg

SEQ ID NO: 16142 - DNA, 45323 bp, Human
ccagcctgggccgcagagtgagaccctgtctcaaaaaaagaacctactagtctacataccacacttcctcatccccatctgagactatatatattttttctaacatgaggcaatgccaaaaagaggggctggtgagtgaaagtaagaacagaaagacatggaggcaagtcttatagaataatagccaacacttaaacttacacttaacagcgtgataggtattgttccaaacacattaaattcatttaatggtccttacatgtctatgtatttggtgattattatccttattattcacattgctgagtgtattattctgttctcatgatgctgatagagacatacccgagactggataacttattaaaaaaaaaaaggtttaatggactcacagttccacgtggatggggagtcctcacaatcatggtagaaagcaaaagacacgtcttacatggcagcagggaagagagagaaatgagaaccaaacaaaaggggtttccccttataaaaccatcagctctcatgcgacttattcactaccatgagaacagtatgggggaaaccacccccatgattcaatgatctaccaggtgcctcccacaacctgtgggaattatgggagctacaattccagatgagatttgggtggggacacagccaaaccacatcactgaggaaactgagttatagggagattagtaacgcccaacacagctggtaggtggtggagccaggcagtctgactctagggtctggactctgaactgcatcatgctgccaagaagttcctcattttttcctctctctaagtttcccttattcccctacagtcattccttcaacagcatttccttcaccatcttttctacttctactatataattaattttttcttcttggtcccaaattccaacgtgcaaatgcagccttatataccctaattcatctttacctttagactttcttccaatgtttctacttcattccattttaaatttatccatgagatgcctatttacaagctgtaaccatcatgaagtgaatgaagaataatacctactactgtacaatagaattccaagagtataaataggagttatggctttctgacttgaaactaaatacttgatacttgattttgctgtctgagatcaatctgaaaagtaataataatcactaacatttgttgagcatcaattgtgggccaagtgtcatttcaatcactctgtacatattaactcatttcatcctacaacaacccggtgaggcaagttctgttattctgttttacagttgaggaaacagaggcatagagagcttaagtagtttgcccagtagatagccagaagaggagccaggatgggtctcgggcagtttaacagcacagctgaagtcttaaccactatgccaacagctttttggtcctacacatcccatgggaagaggaaaataaaaaggtatctatttgtatacctttttatttctgatataagaagcagaattcctttcacatgacctatgtctatttaatacgtcattttgaaacttaccaataaaatttcccaagcgccagaaaactgttagtggctttttccatttctctctatttttttttgtgctactaattttgcttctttccctcagaaggctgccggaatagtaaacattcactgacatgtcataattactggaaaatgggcactggaaaatcacattgtaattaattcaaagcatgttttccaaatgtactactttaaattggagcttatatcataatccaaggaaacctttgtgtgtgtactgttcccacattgctcagcctgggatatccaggagtaattcaccttgcgcctgcctccagaccatcttccatggaagggggtgaccccttgcctcttggcaaccactatttctaagctgccaacattactcttgcattatcaacattctaacttcatgggaagggctgtggtgagtttctggaatgtgaataggaagttgtttttctaaacagcctgacactgaggggaggcagtgagactgtaagcagtctgggttgggcagaaggcagaaaaccagcagagtcacagaggagatggtgagtttatttttttctgcatgggaagtggttgaagtgagttggagtggtatggagtaaagtcaggcaggtaaaggttcagaaagtgaggaacagcgatagccatggagttttatgttgaattgcctattagattttgtgagtacttttaaacttgctgtccactttgaccctcccaacacccttgtgagttgaggttgctatttctattttacaaataaagccatcgtggtttacagaggctgtgttttatctaagcttcactgttaggctacatgatgttgggatctggggcctgtcctctggctccgcagctgctgttcctcctactagaatttataggggctctctgagaatagatcatggtaaacctgtcaccccattttccaagactgtacttctctctgggataaatgatggaataaatggaagactgggtaggtgccctgggacaagcttacaattgaatagtttctcatccccatccctcccatttctttctgtgagcctatgaatcttctgggactgatctggaatatccacatagtttccttttctgccctaagactcaatcttgttaatgactcagtttcttcttctataaaatggatatagtaataatactctatagtttcatcatgaggattaaataagattttgctgaaaagcatccagatctgagcctgacacatagtaagtgattagtaaatgttagccattattgttacaataaaaagaaaattcttaggaatagtggggtttaggattcagggaagatccaaggatagctaggcattttgaactcagcaatgttatatgctcatggataagatgcacgtggttaggctacttctaattcagggaagatccaaggatagctaggcattttgaactcagcaatgttatatgcacctagataaaatgcacatggttaagctacttccaattttcctcagactttccaagagtatcccacatagtcccagggtccgaaatcctgcagtctgtggctatggaggaaccaggcaggtctctgtttttgagcacctttctgtgggactccagaaaaaagtaccgcatacacctgattcatcctactgctttgctttactatagcacacttttcaagtacttataatgtgggtttctgtgttggggaaaacaggaataagagtatgataaagagaagaggaaggagtttgagcctgtcttaagtttgaaccacaatgacctaaggatatgaattacttttgtcctgtctttttgcatgtcatacttctgaattggttaacttaaatgagcagttattcctctcttccttctactctccttggcatcctcctctatttcaaaggtatgaacttattggatcagagagttctttgagattttgatgaaagttacaacttgtctttcccagatgaaagcaaaaacatcgacataaacaccaacctttagagacaaccacaggaggttcccagacctccatgtggatcccagggtaagaacccttctcgattgcctcctgggctttatgttcagaagcccctctcttggtaccctgaaattaggcttgagctctacagcgaagtgctaaggccccagccctggaatggtttttaatatttcaaagacaagacctcttccttttcctctgagcacatttggccccaaagattcagaaacctcaaactgcctgtgtaaattttgcttcaagttcagagagtggctttaattaacttttaggacctgagaaaatgaggataaggtttttctggtggggtattttcaatcagatagatctcagaggagtagctcttgattgggaacttatagttaaattgcactgatgtttgtcaaagttttagcgggctatggccgggctcagtggctcatgcctgtaatcccagcactttgggaggccgaggcgcatagatcacttgaagtcgagagttcaagagcagcctggccaacatggtgaaacaccatatttactaaacttacaaaaactggctgggcatgttggcatgtgcctgtaatcccagctactcaggaggctgaggcaggacaatctcttgaacccaggaggtggaggtggcagtgagttgagatcacaccactgaactccagcctgggtgacagagcaagacttgtctcaaaaacaaaacaaaaaaaaagttttagtgggctaaggagcaggtctggattttcgtccatttataccttttaaccaccttatgtggcttccagtccttactcttcttttcattacctgtttttcaaaatgcaactaaaatagttcagactctcctgggctagccaccagctcttagaatgtgcatcttcagagatctttaagtagaagcttattgatcaaatcctcaaaaatcaaaatgacttactacataaaaaactgtgtttagaaaaaaccctggacctaaacctagagagtaggcacacagtggttttataaatgacattcattatattgtcttcaaggtgtctaatctttttgattaaaaagtaaatcagaaacttcatgaagtcaaatacagagcaaatcctcactatttgtagagatataactcatctctgatccaatagactttttaaaaaattttaagtgtcgtactttatttttaatgctaatattttactcaaaataatggcaattggtagtctaaattaaatatatgcttggattctaagtgttgatgtcctgggtcccttcttgtctatattcataatttgctctttggcttagagacaacctcttttctcactgtatttctttttccacccctaagctgggctaccaatatctgtgccacaccactaacaccaccaccgtccagaaacataagggaactaatgtattagctgtaatagcttgtaacatctgggctttgctaccaacaagttgtatagttctgcatcctcaacaactctcatattcacctcccctatttgcattcccactgatgccagaccaaacctgtccctctttaactctcactgggaccattgcaatagcctcttcttttgcagtgcaatctccctgattgtaactcatttaaaaaaaaaaaagtatcgcactactctcacccctataatatcagcatttttggaggccaaagaaaaagtattgcttgagcccaggggctccaggccagcctgggcaatatagtgagaacttatctctacaaaaaattagccgggtgtggtgatgcatgcctgtagtcccagttactcaggaggctgagatgggaagatcacttgaggccaggaggtggaggtttcagtgaacccagatcatgccactgcacttcagcctgggcaacagagcaagaccctgtcccccagccccacaaaaaaaatcataccaccattaagtgcatgtgttcatgatacttctctgttcagaagtatcccttctgccaactggtatttgtgacccacaagatatggtctcaaactaccttttcagttaacctctaggatctcccaatcttcagcaggctggagtgcagtagtgccatctcagctcactgcaacctctgtctcctgggttcaagcgattctcctgtctcagccttctgagtagctgggattacaggcatgcgccaccatgcccagctaatttttgtattttttagtggagttggtttcgccatgttggcaaggctggtcttgaacttctgacctcaagggatctgcctgccttggcctcataaagtgttgggattacagatgtgagccaccgtgcccagcttccgttggcttatcattgcacttagaataaaatctcatccccttgttttggatcccaaagcccgatgtgatctgtcactacccccggctcgtatttttctctccattgctcattccattctggccacactaatgtcttcatgttctttgaacacactgcagtttgcttccaccttaaggcctttgaaatagctttttcttcttcctttaatgctcttcttcctgcttctcactggctggtttcttgcagtcattcttctctccacttaaacattatctcattaaagaggtcttccctgacgttcctgaccaacatagtgacacagtcattctatcacataagtttcatttcctacctagcacttatggctatattctgttaatatttttcatgtttacttgtttagtactgttgtgtagttattagtatttgtttcattgtcttctctaccaatagaatgtgcattctatgaggactggaattatgtctgttttcaccattttatttgttcacttagctattatcactactgtaaaagtaatgcattcagttataattattatgtatttttccaacattttcttatttagcatatttttgtcttactttcagttattcctctgccattattcattcatatatttatccataaaatgtttattgagtattgagtatgtgccctaccatggctggggattcagacctgagtaagtaatagtccttgcccttgagaagcctctgtcagtagcttcctcagctgtatgctcacatgtttgttgcgcatttaaattgtggacctcctgctcaagagaatattcagaaacggagatgctgattagaggacattggaaacagatgaccataaggaggtcatctttacttcccaggaaagcagaagaatgagaagagaatagggccatggaggtgggaacctagagaaacacttacctctgcaagggaaggcagaggattgaggtagattcagaagaagactcagaaaagtttctcaaacattagagcagaagaacaacagaagagctaagggaagcattttaggcaaaaggaagtagtggtatttactgctacagaaaggtcaaggaagataagggtggaaagtcttcatttggtttggtaatgaggatgtcagcaatgaagtttgcagggacactttgataggatggtcgggcagtgggctggagagtaagggggaggcaaggaagttaagaaagtttagctataagaggaaggagagaaacaggcagatgtgggcaggaggacaaagggtcaagggagggacattgtttgattccgcctttctaaaagcacaaagctgtggtctacaatgtagacaaaaagaacaagatctcctttctgtggcactattcttgccaactttgtaagccacctggaacgtggcaagccatgggacacctactagcctctggtacctccttgtgtgaaaagttaggtcaaggcatttgcttcttccactttctctctgcttttctcttcaccctgcaatcattattagtttttttgcttgtttgtttgttttgttttttgagaaagagtctcactctgttgccaaggctggagtgtctcggctcactgccacctctgccttctgggttcaagcgattctcctgcctcagcctcccaagtagctgggactacagacatgtgccactatgcctggctaatttttgcatttttagtagagacgaggttttaccatgttgccaggctgttctcgaactcctgacctcaagtgatctgcccaccttggcctcccaaagtgctgggattagaggcatgagccactgcaccagcccagttctttattaaagtaaaattaaagataatcatggtacttaatgaaggcttacacaggcacaggatgttattctaatgacccagtctctgactcctttccagcaacttccagttgaaccagccttccagagaacattaaagactagcagagcatgtggatgcttctagagaggaatttcctcttgttttagtatttaacttgcttagtaacacaggacagagcagcatcctgcagactataatgcagagtaggagcaggtatgagaaggcctgcccaccccaagcaggtttcagaggaaaactgttactcaaagaagatttttaaacatcatccattctccatacctccacacaaaatccctatcagttgccttacagttaacacagaatcttgaacttgggccacattaaacatggacagacttagtaggtcatgaaccatctgagattctctaaactactgcaagcatgcatttgttttgaagaaatctgaccacggcttttatcagattttcaaaattcataagccctggaagaataagaataactgtgttaaccctatgcacattcatgtgagcaagcttgggcaaatcatttacgctcactgagtctcagtggtggggagtggtggctgccccatcttaggcattcgaagtctgaaagacttcctgcagaacagcagataaatgctaagttggcttggaagtgacctttatgttctcctatagctctgaaataacctgtaagaggtgaatcttggtatttggtgatgcatagaaacagaaaagtatgtcagattaaagcaggggatgcacactgacttgcattttcctttcttagatgttgtgccttcatcaaaagcactgtaccagtcctctaaaaccttcaaatgtttaaaacaagttgtctcgctctctctcactttgttttatcttgtgtggtagagaatttgctgatgaaattttgcttaaaaaaagttcaaacaaacaaacaaacaggttaaaatgggaaacatctctttttggaaattttgtttaaaccaaatcttatttaaaagtttaaacaaacaagtcaaagcaggaaacagtgggtagggttggccactgtgatgggagactgggagcctcaccgactccttcgccctacacactcttgtgagctggccccaaagccagggaaatccctagaaatactctgttcagggagaaaaccacttccacaggaagagtaccactaaatttaaaatcgttgcactccttctgcaatctgtctgaatagaggcaaagcccaggttcaaaggcaagcactcaggtccccttcatgaaggctgcagagttgtgctcttcagcagcaatatttttgctcctatacctccaaaaatatcctggaacactatgttacctcttacacctttctaagtggaaagctacaattttttatcccaaattttaaaagcaaaagaagattggattttccagtgtattacaaaaattagactgtaaaaataaaattgttacataatttcttaaagtttatccaatggaataaagtactagcatgatctgcaatcctcatcacttaaaagaccacaagcaggctcttaagaaattttatattattcatttttctctccttgaatagttatttctatcccacttctacagtatttagcctaagattacacattttaagcttaaagtattttcttgattattatacttctttgcaaaataaaaatataaaatttcaattttctacaactgtaagtctctatgtgttaaaatgtttttcttttctattgagttagcatgacaactactttcagtacacaattaaataaagtaaatatactgcaagttttgacaagtaacttaaacctttatatttaaattgctattaaagattcatctctaagacaggaggagctttccctcatttgttcatatatccatgaatgaatattacttatcaacaaaattagacaagtttggcatcaatattattcccatatttcattttcaaggatttaaacattgagaaacttcattcatatgaataagtaaatggaattagaagttttattatagcaatgtctcaattccttgaagtccttccaagttatatgccccaaattatatagtgatttactatcaaaatttagtcagacttgacaacttaatcgggtgctccctcaaagctgatgaaaggaaataaatggaaatcactagacttgaaaacggatttgctgcaatatcatttacaatattcaaattcttaatacctataccaatatttcgaatcatctctggcatacgaatgtatttatatccaaaggcaaagctctggaataaataagaaattagtaaaaggtataatttttctcttataaagtgggagaaaggtgtattttaggcagattgtttttaagaaagtatatatgtgaaagttgagaatctgaatacagatttaattaacactctctttgcttgtgaaccccttgggaagtcagccttatcctggtttgaagaattccacttcagcatttggaatggtgcattttgaaatgtgataggaagaacagcttgtgacacaacacaattcagagaaagcagtggggttaggttcgcaccaaagggttatcgatcactctgcattttgtgcaaataaacagctgtaaatcataacgttatgatactctcagtgtttaatcataggtcctgcagagatcagcagcttataagaacacaaaatatgcctacttaccaaagtcaagattcagaagctcccagatgaaaagttctaggcttatgagataactctactctctgggacacattaactggtttgagttgagttctccctggtatctggtcaggctgtagtcaaaagtgcatgaacacatgcacacacacgaccccacactgtcccatgcaccctactgggcgtgacacatacacaaccccacactgtcccatgcaccctacataatccatcactgggcgtgacacacacacacacacacacacacacacacacacaacctcacactgtcccatgcaccctacatcatccatcactgggtgtgacacacacatacacacaatcccacactgtcccatgcaccctacatcatccatcaccaggacatgatacatgaacacacacacaacaccacacagtcccatgcaccctacatcatccatcactggggtgtgacacaaacacacacacacacaactccacaccatcccatgcaccctacatcatccatcactggggcatgacacacgaacacacacacaaccccacacagtcccatgcaccctacatctcatcactggggtgtgacacacacacacacacacacacacacaactccacaccatcccatgcaccctacatcatccatcactgtggcatgacacacacatacacacagaaccccacactgtcccatccaccctacattatccatcactgtggcatgacacacacacacacacacacacacacacacagaaccccacactgtcccatgcaccctacatcatccatcactggggcatgacacacgcatacatacacaactccacacagtcccatgcagcctacatcatccatcactgtggcatgacacatacacacacacacacacacacacacacacacacacacaaccccacaccgtcccatgcaccctacatcatccatcactggggcatgacacacgaacatacacacaaccgcacaccgtcccatgcacgctacatcatccatcactggggcatgacacacgaacacacacataacctcgcagcaaattgtcacagaccaaattgtggtctgaggcaatttgagatttctttacaggaaaggttttaggtagcagtctggctgggatagtgacaaaactgcaaatgcatagcaaatgcactgtttttatgttgatagtaatgttgagtggctttagaggggaactgatgtagcagctaggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgcaacatgaggaagtcggacaagatgagcatcactagaacttagatgcccaaaaacattttttgttgtttttttgagacggagtcttgcactgtcgccccggatagagtgcagtggtgtgatctccgctcactgcaacctccgcctcccgggttcaagcgattctcctgcctcgacctcccaaggagctgggattacaagcacccgccaccacacctgtctaatttttttttaatgtacttttagtagagacagggtttcactatgttggccaggctggtcttgaattcctgacctcatgatccgcccacctcagcctcccaaagtgctgggattacaggcatgagccactgtgcctggccccaaaaacattttaaaaatattcatagatttgatgaaatcccaacagaagagagttcatgagaaataatagttgctatagatccaaggggaacaagtttactgcatatattaagaaatattaaatatatacatacatatgtatattaaacattgaatagtattgtagatgtgtacagaaatgaaaaagcaagaagataaaacaaagatccatagtacaaaatagatggcatagcataacacaatttgttgatgctctgcacctcaaagtataggttagacattatttgtgtgggtcaggaagttctcatgtgactttctgttattcttgggtatgacataccacttcttaaaaagattgttttataataataatgacagccatattaatgtgtttagctttcttccatacacattaaaaatgtatcttaaaataaaaacattggtggcacaaactactcaataaacatttgttgaatgaatgaagaaatgaactctgtccccagccttgctacagtgtccatccagggtagaacttagaagcagggcaatgagaagcaagaaggaagcagagggcttgaaccactcttccagtggaaattggcacaattatacttcaacataatgattgttaactagaattatttttggccatgttggtggtgtatggatactaaaagaaagttttctcttcttgtttcaggccaactgccaaatagccatcttgtaccagagattccagagagtggtctttggaatttcccaactcctttgcttcagtgccctgatctctggtaaactttatgctaacttttcacttaggcctaagtaattagggtagagcccagatctatgtgtgagaaatttaaggattgtagccagttggtttgaggcatgggaaaactgtccaagtccagattgctggaagacaaatgtacccaacgccatcatattggtagaaagggcataggaaagaacttaaaatgatatatccaggacgaatgtatccattaggcacagtagacacagacgcacaaaattttcaaagacccacacacgtctgaatttcttttataattattttctttgaagtcaaagaaaatgttttaatatatagtgatatattcatctttgtaccagtgcagttgcaaaatagaatttttaatatgttagcatggaggaagaagcctacataggcaaagttgcctgaagtctatgaaagtcataatgcagccctggctatatcagaatgaagtctttaaggcaaaacaatgccctggaaatgtcagcaagggaggtacaagcatgactaaccctcatgcaggcagcagaggagagggttggatagaaacaagcctttaaataaacaggaaagaaacccatttccaggcctgattgcttgctttgtacacctcttcatgtgggaaatggcctctcctgccccgggtggactcccacagactatgataagagtgctgtagtacctttatacttttgaaacgcacattctttagttcatttggtatcaaaaacacttgtgaaaaagggctgttctgagccctatcttaataagggagtattcagacatggaagaagtagagtagttaatgaaagacaaacagccaagaagaatggaaagactataagattgcagatcaggatatctgatttcccacccgggttctgccacaaacctactgtgtttcactcattcaacaagtatttattgaaggcctattaagtgctaaactctaggctcagtgctaaggatccaaagctaaaaagaaaacaccgtcggagatttacaacctggcagatgtagactgtatcatagaaacagacattaccgtacatggcaatgagcacaatggaggcagggatgaggtgctgtgggagcctggaggaaggaacacagagtccacctgggaaagccatggagaataggtggagtaaagtttatcagacataagaagagaggacagccaggattgtggggagagcatgtgcaaattcaaggaagtaggaattctgttttgctgagaaagtacatacagtgggcaatgaggctggaccaactggtaggctccaggtcataaagcatgttattttccatgtgaagaggtagagcttgcccttaagacattttatatgtcatttaatctgagcttgggcaaattacttatgtctccttcttttataaaaggacaggagtaaattagatgacttccagggtccctcctaactttgatatcttatgattccaaacctttaacatcaaggatcctcagaagatgacattttcctattctgacatcattcacacttttaagtgaaaggtggaaaccactctttttccttcaaacaactacattagacataaactagtcgttgttttgtgtattaatgttctggtcggaaattcatctgagtatgcagaagcatacttgggatcacggcctcttttttggtgaggggtactaacctggcactcactctcctttactctagaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacaggtagggccttctctactttgaaactttcctgttaaaaaaaaaaaaccctgccttctctggttggccaacataaccaccgagtcaacacaaagatacaaaggcaggacatgaaatcaaggggtaaattgttagtcaatcagtattattgagcaccttgaagaatataagatcagaattagagaaaactagctgcttaaaactagagggaaattttaatatcatccagctcacctgtctcatcttataactgatgaaaaggacactcacgaggttttagtttctcaaggccgtggagcaggacagaagcaaagtgaggaccagaaaccagtctcccaaattttaggtgtagagcttttttttcacccctgtgtcttgtataacagagagtgtaaattggaaggaaatttagccctgcccctaggtgacacagctgtaactaatagctactgaatgtcagtatgctctaggcattgtgttattagtttatttagttcatgtgtcatttgctcatttaatattagtcaaatttagtcctcatgacaactccatcagtcaggtttttctattactcttactttgctgatgagggaaaggctcagagctattaagtaatctgcccagggttctaagctagttgatggtggagccagtttcacactcatgttgattccaaagttggtgttttttagccatgtaaactaccacattctttgctctacatttttatgagacaatttgagaatataaccaaggattgtaaatgctttatagtttctcttcaacaacaacatatctttagatccattgaactttggtgggagggtagtggtggggagtgggcaggaaaggaaagaagtaattgaaggtgaaatacttcgagtgtattttaattctcaactttaccagtgccagagtaagcagacattcctgaaagcttggtcttcctctagtcacgagcctagtgtcagagctgattccttctttctgatgttgcttccctgtccagaggggccggttctgtcctttgtagcacacgaacactgtgcctaaggatggtatggactgccccgagcaggaagtttctaagtactctgaagcttctttgataaatcatctgccatacatattctgaattctttagattttaaacacctctccctcagaagccctcaacagtacaggtatggaacagaatacacagaataaagcaagccttctacattgtccctcttctccccaagcctcctagctgaggcaaaacatatccatgaatgcattatcatataatcagatctactttataaataatgcatttatatataaataaattgattaattgagcatatattcatggatcaggatggacattaccaggatattagctcatcctactgctctcccagtcagctctctacccctttctgggctatgcctccctagaattatctcttatcagataaccttgactgccactagctgtttcaatatgccactacttccccttcacacccaaccttcaaaatccatttctgcaagacagtcttcctcaataaagcttgccaaaaaaattgcaagatagaaaaaagataaaaaattactggcataaatgatgacactcctctaacccacaacagtggtagagacatcactaattaatacaactttacctgaacacagatgggttttatctccaccaacacagtactctaagcagccactaccattgattgtcgttttgccatctaagatgtaaaggatgtagagaagcatcaattatccatgggagatgagaaatagatatatttactgtaatatgaaattaagtttgattgttggaataattctccacatgtcaggaattattagacctcagagcaggctatcgaaaaaagatttattcattgaatcatcatgaataaatcatcttctccctggagatccaaaggaatagacaaattgctaacctatctattcaggaaaccctgaaatgggatagaatacagaacattgtctctttttttcccctagagttctgagatcccaaggaagctataattggggaaacatttgtatgctccaagaacatagggcaggcaggggttgctactgtaaggtattaagacattggtggggttaaggtcagggagcgaagtgaataggatgtggaccaaacctgtatccatttagctgctattgcctcctacatcttctctttatttgaacccttcccagtgtctcagtgcagcttcaccaaattcactggctgccacaggaacttcttcctatagaaccttgcatggtttatagaattttagtatctcagaattgagaggaaacatagagatcatgtagcacagcatatccacatatgacatatggatattcttttgtaatatacttccaagtgaaccagcatgtggacagggcttaagacagaggaagtaaccaccagaaaacagttcagccatagaacttacccccaactatgacctcattaataaaaacatctcagtgctttgaaagtatcaattctaatactaattctcatcaagtgcatataccctaaaatactttcttgcaggaaagaaaccatggcccttctctattctgtcacctgagtggcactatcttggtgaagaggacatggcagttcagccatagtcagtactctcttcgcctgctgtattcagactcatgaaacatcacctcataagattgtttgtcctttaccatgagtacgtcttaaacatctcatttggctcctctgtttctccactgtaggattctggacatagatttgaagcaaatgaaaggtgaaagggtttgggctctaacactgtgcaagctgagctcagagaagtaacttgcctaaggtcacatagcaagtaggcagcagagccaggattcatatcacacctgtgtgaccccacgccccacatctggtgcctaacctcaatgcagtaatacgtgacattgggcttccataataaaacaatgcttggtttgaaaaccacagcccattttgtaccacatagggtttctctgtccacacatctgtcattggctccatttgtccctctgtgtccacacacaacaataccctccttaggaaatactaaatgcagtatgaaatgggagccacgcaatactccagcaggcccctacaatgcttttcacaagggacaggttggctctctagaagatactgtgcttccctcttgtctggctagctcagtcctatctgagaggggatgagtctgtggtcaaaacgagaattcagcctttcctcacatctgtgaatgtccatgactctgacctttccatatctatgcagcctcctgccaggacatgtcctgcagcaaacaaggagagtgcctcgagaccatcgggaactacacctgctcctgttaccctggattctatgggccagaatgtgaatacggtgaggcttcctttttgttgatattattttggttttatgctagagatgatgccaagaagtaaataaatcatgttgaagtctctccagtgagaataggatggtaccagcccccctctatcatctgtctcctccactcagtgtccctagacacacactctaggtaaaaacattttattcttgggagaaaacattgactcataaatttcaaaaaagaaaagggaaagggaaaggaagcaaaaccaacagaactttcaggctaattttacttgtttgaagtaaaaacttgtgaaagaatgactatttcccaagatgcagccaatacaaagagaccaagtagagatggatagcttgggttaaaagtttagaaaattagagttaagagggttacacaaatagttacagctttcagcaaacatgacattgctgttaattctacatggaaaataaaaatcactattttgtctcctgcagtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttaggtatgtagaccttattcttttcatcctcactgacatagaattttgggggagaagaggacacaatgagctttctccattaaaaaatgtgagaaataatgaccatctaggttagatggaaaactctggttatcactgttaactgtcaaccagagtaacattaatttcaattttcatggtatttttttatgggtagagtgacttagtcagtttaattgttgattcgcaggcaaaaacattacaaagggacccctctttccctttgttaattgtaaagtaaacagagtacaatgatgaggacttaggggttaagaattattaatttgataattttacctaacttctctacatgaaaaacaagggtgtttgatctttccaagcagctattgaaaacaccatttaaccattctagtgcatcaacctgcctgccactttgggaaggtgtgactgctgcagaatttgaaggcttccaaggtgatggacaaaatttgtccaaggactcacactattattctgtggttggttttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaaggtgagtttcaggtagttgggatgtataatgtccattgcacccagtccttacttagtgcatagatgaaattgaccagcttatggagaagctggcctgaattgccaaaatttaattctcttcctacctgccattcagctagattgggttcatctgagatgagaaaggaaaaaaattcctttctttccccaaacacaaatgcaggcagtttcagaatggcctcattcataatttccccataagattagaaagggtggcctctacatctataagtggacactagaagacctactgagacaggtttatagaagtatagggaatagaggacattaagaatacagcttggaggaatctttgtttttaacagactcagatcaccctgggaactggtaatccaagtctggacaaacatcattagggtctcttgacctttacatcttgctagctccacctgcatttcagaggtggttccaccattgctctctgtgtggcttttctcctttctcagtatctttctctttatccttggttattctctccagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgagggtaggatttttcattagcaacctccattctgtccaagaaggaatcatggcatggtagagaggccaagggctctcagtgtcggggtgatctcttctaagttcttgcactagagcaagctcttcaacctccaggaaccatggttttctcatctgtgaaatggagctaagaattgcaaggtgcttgtgaggattaagtacataaaaagtatacaattaaatagcatgtataaagtacctagcatagagcttctgctctactgacatatccgaggtataggaccatgtcctatacttgagagggagttgggagcagcggctaaggtggctaaagagagtggttcaccatgtagtctttgagggtagcctttgacaaagaagcaaaggaaggaacactgcatcgaaaaagtgtgtgatgcaatcccaggcaattacataattccgccaaaatgaattctctgcaattgcctcacaccctcagtttataaggcggacagtggtaatgggagaataggaaatttacgatagattagtgaattcccagacctggatgacaagcccaaccctgctactatctagctatgagactttagagaagtcacttaacacttctgaacctcacttttcttgcctaaaacataagagagaagagagaaacactagaggattttggtgtttttgtttgtttgtttgtttgtttgtttgtttgtttgttttgagacagagtctcactctgtcgcccaggctgaagtgcagtggcacgatctcagctcactgcaacctctgcctcccaggttcaaacgattctcctgcctcagcctcccgaatagctaggattacaggcaactttttgtatttttaatagagactagggtttcaccactttggccaggctggtctcaaactcccgacctcaagtgattcactcacatcagcctctcaaagtgctgggattataggtgtgagccattgtgctcagccggatttttggttcttaaatgctctgagtctgtaaaaaccagaggtcaaagcccagagcaaagaggtagtctttacactttgaaaagtttcagaaatagcctggaaatgaaatgctttatcaaggaagagcatgaggaaaccaatctttatcagaactgaggtcactcagggcttaattgtgctcaggaattcactttggctgcactcacttggcaactgaagtctgattaggatgacatcctgtgttctagagacaaagcccggtcaggatcattttacaggactaggtaacagtgtcaacaataagctatgctagtccagcttttttttttttccctataagtccagcattttcctgtatatactcttttcagattcaatttcacagataatgtcaatatttaatgagcactttcaatgtacaaaacactctgctcagctccagaataaaactatgaatgactgagcccaacttcgaggagaccacggtataatggggaagaatgacaatcatgtatgaacagcgcaagaacagaggctgtgggagcacattgcaggggcttctacccttagttaaggtgggaagggagggcttcctaaggaaagggaagtctaagctgagacctgaagggcaggtgagagtgagtcaggccaagaggggcatgggaaggtgttccaggcagtctctcttttggaaaatggaggttttagggttctgaacacactgaaaatgtggacaggaaagatatagcatctaggaattttttctgaggaagaacccggcccttccattacctggctttagaagataccttttccacttagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaaggtactgtaacagtggtaatgtttttctgtgtgtctcagctcgttagaggcatcagcatctgcactgagcattggcatgcctttctttatcagatattcactgagaacctactatgggccatgtcctttgtgcttgggaccagggatgagatgaaacggtgcgtgaagccagtcttaggcacatgtccactatagtatagtcaaggtgaggtttgcactgattgacacatatagggtgcattggaatgaagaagatggggcttgggggaataaatcatgcatgaggaatagcatgggatggggaagggtaatggacaaggtgtttagctcagtcctgtcacttcctgtccttaagctagtggtttagactctctgaggctcagtatcttctgtaaaatggggctactattatcagccttacctacctgcctcactagtagttgtgaattaatgtgtgtaaacgcaactttaaaactcttataggatttatagggaaaatgatgatgatgacatgttaccttataaatcacatgtctgtggtctgatttgacaaaatgatcctctttcaatatgttaggtttctaatcttttgctcttatactaaggcactcatggggggcgggtgtggtggttcacaaggattattattttttttacgaggagtacctcacactaaagtcatgttccagaagtgtaatattgacattttgtgttttcatttacggagacctctgagcaatctatgtgactcccctgggttcctaagtataccttgattttaaaatgaggcagtggtttgaaagcaggtcttgaagagatatttgtgcacccatgttcatagcactattaatcacaacagttaaaatgtggaagcaacccaaacacccatcaatggatgaaaggataagtaaaaagtattccacatacttacagtggaatattattcaaccttaaagaggaagtaaattctgacctctgctacaaacatgaatgaaccttgaagacattatgctaagtgaaataagccactatgaaaggacaaatactgtatgattccactcatatgaggaacttagagtagtcaaagtcatagagacagaaagtagaacggaggttgccaagggctcggcggaagagggaaatagggagttatggtttaatggatacggagtttcagtttgagatgatgaaaagagttttggagatgaataatggtgatggtggcacaataatatgaatgtgcttaataccactgaactgtacacttgatattggtgacatggtaaatggtaaattaaatttcatgctacgtatatctcactataataaaaaattgaacagcaaaaaaaaaaaaaaagaaaaaacaagaaggcaatagaatagatggctatacaccatgatgctgacacttagtctgagttatggaatgtattgtatatgttatctgggagaaaaagacacaatgagctctttgacacacttaaaacggatcataagggattattcaagccattgttgtctccaggaaggtaaatgtctaatcaagaaaagatagttggatattctcttaagtatccagagatgtggtctcactaacccccttcataggccttctgaatgtttcccactcctgaactcagtgtctgcatgtgacgcaaagccttaatgatattattactatctattactaccactgctactaatatagcagctaatgttcattgagcactttctatgatctcagtctaactctatgaggtagttacaattattactaccattttaaagatgagaagagacaacacatggaatatgtgtgctctcttcgtatatggttatttattttacatctttgagatcatggtgtatattataatttttactctgattttttatttaacatcatacattgagacctctctcctatctttacaagttaaaatatattatttttagtgacctttaacattcttttcatggatccaccatcattaatttccaccctcaattaatggcatttgtgtttgttttcaatattccgctcttacaaataatgtcttcacaaaaatctctaaatagattttttggtatgcatcttgattacatacttagcataaattcttgggtccaaaagcatgataacttaaaaattattgacacatgttgccaagatgctcaacaaaggtttagcatttcctaataaaatccttcatgtgccgttataattaaatgacactttttcttatcttctatgttaaacaagcccaattcaggaatccctgttcttgacactagaaagagttaatggtcaaaaatcaatgagtacatgtgtattactgtttctttattccttacttcctcatcccttagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaaggtaagagtgtattctttctaacatcatggaaataaattgtaggcagtatttttaaaggctggattttagaggtgacaactatgtaagatccaccttgaaatggactggaaaattcataaatactctcactcatcctcttgtcctataacccaaggatcccaaatgcaaatgcctccgggggataggcagattacacaagtgtcaggatgtctggccatagacagtagggcatggcccttgctaactccttatcagggtctttacccagacctgaaggctcctgccacaaaccaggtaaactcttctcacctggccaaacatggcatctggaaagaagaccaggtgggaaaaaaattgcttcagagtggttgtcccaaggctggtctggcacttctaggaaccacagggtataatggtaaaatgggaggggcagaatttacaagtacccagttgcaaacactccaagatctgtataaaattggagaaatagacttagaataaggtgaagagtgatagaaaaaagagaaaaactaatctgtatactggaggttacgggattctcagaagaaagaaatgtgtggattcagtataaacattctatctgcattgtacttgatatacatacattttttgagacggagtctcactctgtcgcccaggctggagtgtaatggcacaatctcggcccactgcaacctccgcctcccgggttcaagcaattctcctgtctcagcttcccgagtagctgggactacaggtgcccaccactgcacccagctaatttttgtatttttggtagagatgaggtttcaccatcttagctaggctggtctcaaactcctgacctcaggtgatctgcctgactcggcctcccacagtgctggtattacaggtgtgagccactgctcccggccttgtacttgatatttaacaagccagtgtgctctgtcagtattgcaacatcttgtatgaacttgaacgggttctagtcatccatgtttgtgaattgaaggatagacgtatattttttatattccccaagctttttccccctcaatgtatccaattccttagttaacttttatagacaatgctgctttttaaacgcaagattttcatttataaaaatctgcagaaatataataaagaaatgaagaaatatcctcttaaatactcctatcctaaaatagacactgttaggcttctggtatgaattcttccaatattttctccgcttttcctcctatgcaattaatatttttatgatgtatatacaattttaacaataaagttgaatgggtaaaagactagacagttctacattatttgccatacctttcactttgtatagactttcaacatttgagtgaaagtgggcagatacatattttttactaaaaggaaaccactcactattcaggtcacacaaaagcataatcacatacacacacacacacaccccccacacacaccccattgttaagctaggtcaacagtaaatgaatgaatgaatgaatgaatgaatgaacaaatggacaagcaaacagcagaattgaatgtccttcatcgccaggcaccagagaggatggcaagcccctggacttagggttgggtgcaccttcagagctgggtctggagagaacagggcggggctgtgaccttgccccttaagtgctcatcctggctacgttgaagtctggacatatcacaaagtccacacaactttggggaagttgtgggaagaactgggaatccctgaggacagtgatcacagtgattgaaactcttacaggcaagcctgggtggtgcagggcacagattacagttcattgctccatactgtcctgcctctgggtgtttcacagcaaggaggttgccactcaccacggcttcctgtgaccttccagttcccttctgcttttagttctttatttactctgaactttctcctcttgttgctgggtgcacatcaagtgaaatacccaaatgtgggctgggcaggaaggtaccatgcagtgtgcaatccactcgctgttgtaatacttctgagagagtgttatcagacaatttccctttttaatgtcctcccacccctccacatctacccctgctgtcagaaggcaaagccacagaagagctggaaatgggttctgtggtaccaacatcctcacccacaccctttcccccataagtccttgcagtttataggcttcttgagttgtgtcctctccagccccacatacacacttactacagaaatacttttcaactagaagaaaagaaccagatctttggacaagttgatcagattgaaaggaatgtagctagagaggggaaggaatgaagggaagagaaaggcgtagaaagtgttcttgaaacctcatgctgtttaagtcagtggctgaaaaatgaccctaggagcaaggacttcatgtctaaaacaccaaaagcaatggcaataaaagccaaaattgacaaatgggatctaattaaactaaagagcttctgcacagcaaaagaaactaccatcagagtgaacaggcaacctacagaatgggagaacatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccatggtggaagtcagtgtggcaattcctcagggatctggaactagaaatgccatttgacctagccatcccatgactgggtatatacccaaaggattataaatcatgttgctaccaagacacatgcacaggtatgtttattgcggcactattcaaaatagcaaagacttggaaccaacccaaatgtccaacaatgatggactggattaagaaaatgtggcacatatgcaaggattttcctttttcccatttcgaagataaagcaactgaggctcagaaaggttattgtctagtgatagattgctagcaagtaacagagccaaaatttgggcgcagattccaccacttggttgggaaagggggaagaaagtattttcctccatttctgtgtttccaatcatttgtcattgttttctggtaaggtcattggggtgtttctgaagaaggtatcaagggagaaaccagttccacccctgtctagaagcaacaaaaatgagttgcaccactatcctcccaaacagagcaccagcttcctttaaaaatcacctctaaagctgtttgtgattgagcacttcaggatgtcaatcaactgtaagctgctgctattttacacctctacaatctctaactggtgatgaagcatcatgaaattcaaacaatcacttttagccaaataccatcgttgtatattaatcacacacacacacacacacacacacacacacacacacacacacacagagagagagagggagaaagagagagagagttacagagttcaggttgctgaattataaaatgatctcttcttttctcctctgccatgcccatgatagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaaggtaggctgtgggtctgtcctttcttatggctttaaagatgacatcagagaatggagaatcatcagggatttatataaaagtgttcttgagctgaagcaaacaacactctccacaacaatggtaatctagataaaaaagttctccctctctttaaataatattttaatagctttagttaaatattccacagtttcaagaacatcctggccaacatggtgaaaccccgtttctactaaaaatacaaaaaatagctgggcatggtggtgcatgcctgtagtcccagctactcgggaggctgaggcaggagaatcgcttgaacccaggaggtggaggttgcagtgagctgagattgtgccattgcactccagcctggtgacagagtgagactctgtctcaaaaaaaaattgcacagtttcaggaagtgctttcatgtcattatagcattcctgtttaccacaattctaaaataataaggaaaggcagtatcatctcattttatagataaggaagagacacaagcttaaagaggttaaataactcgtccagggtcacactgttagtaagtgaaaaggctcagctctatgtcactgaaagttttacttccttacagagtcttcttcagctacattcttcatttcttcattcctacattcaccttcaactgagcattactaaatcccagccacagaccttatttagggatgggtgagatttaaccctagcataactatgtgtgcacttccctcctctctccacttctatattgaatataagcttcttgaaggcaggagctgtgccttcttcatctttataccccctgcagcagctagacagaataaaaatgggtgtgtgtgacaaatatctgttgaattgaaggtgatcatttaccagtaaaatttactcaaacacaagctttggtaatttagtggaattctcaaaggcaggggccagatcttatctgtctttaattcccctgagacatctggctggcaaagtatctagtatattttatgttctaaaatagaagtgcactgaattaattaattcatagctcctgtttagttgcaaaaggtgctattgttctaatgtattgttcagtgtagagttagtaataatgagaccagtgataatggtaataattattgcttaatgtaggactacctatttcataagcatcatcacattcaatccacacaaatgacccttaagttggttattactatgcccattttaaaggtgaagaaactgaggctttgagaggttaagtagctagcaaagttcatatagcttgaagtatggagacaggatgcaaacccaggcctagtctgattatagggctagtgttttgaccactgaactacactatcacccagtggcagagcttctgaatctcaggtaagtcacttgtgaatttactcttttccactccacagattgcagctataactgctaaatgaactttagaaatggcagtgcctggtgatcagatgagagaatatgttggtagaaatctattcgtgttacacaaaaacagctaaaatattatttattccttcctgtggaatgagcactagattaatatccaaagacttgtattgctctctctccaagtcatgtgccattaggaaagtcttgtcacacccttaggctcccgttttctcaattccaaaaggagaagagtggaccagaccatctttgaggtcgcttccctggtcaagaattctgtagggtgaaagacataaaatgctaccatctgctgtcaaaaagatatactacaagttccctgagaattctagaacatgtatggaggaaagcatttgggcttgtggtttttcactcattcatttattcctcactctcttattcatttattccattgacatttctcataagttctattttcccacattttaaggctaaagaatatttaaaaaaacctttaaaaatctcattcacattttaaatcatgtaggcaaccaacatggctgctaaatctgtaatctctaaagcccttgcttcccttcactactttccagcccccctttctctgcaggaggaggcatttgcctcccactttgcaggccccatccccactcactgtcaagacccaaccctgaccatgaacagcagctttaacccactatggcccttggaattatcaaccttgactgatcctgatcttgagccctggtttttgcatttgtgtttcttcttcgttctccaaatttatgctctaaatttaggcaaatggttcctcttattttcccatatgcctgaacccattaatttttaaccctcagcactgccccctagaaccccaattttcacatggtgttttgcagagttctaggatacatcagatggactcaggggcctccaagtaagcagaggcagtgtggcaggtggagttctcaagctgtctcttcagagtgcaatgtgagatttcattttgggggatggctctaccgatagttccactttagttagaatgccggttccctgggccctctgggatgtggcctctgcctagttgttcctcagtatctgcagggggaattggttccaggactccctgcagataccagaatccccagatgcccaagtcacttatataaaatggcataatatttgcatataacctacatacattctcctttagacttttaaaccgtctttagattacgtataatacctaatgcaaagcctacacatcacttcatctgcatggattcaacatactcagcacatggcaaattcaagttttgctttttggaactttatataatttattttttttctgaatgtttttgatccacaacgagttgaatccgtagatgcagaacccttggatacagagagtcggttatttttcagccttgtctctgcctttgcccttcaggacctgaagtccttttcatgagcctaagcagtgcttgaggttcttgtgccaactttgatgatgccacctgcatgatggagtgcttgtacacagtttccgtatccctcctgtccctgcctgttggaccactttcatgatacagactgctgaattcctaatcccttaacactgtctgtcattgatcctctggtgaccatgtttggctgctgaacccaactcctaatgtctattttcactgcgtggggaggggtcctggttccaagtcccaacctcaactctgctcttctgccatgtgcctgcttactcacgtcctaaaatatggtgaactggtgccccctaaaactctggcccagctgacatctccatttttttcttcattcccccaacatttctctgaatctgtggggcttcctagttttattcctaaagtttgagtttacaatattcaactcagatacatttattattcatactatatcttctttccagaaaattattgagaaaactctatcaaactcaagtaaaatgatataatgaaaggaaacagataatttactaaatctatttgaaataatataaatcaatatgtttaagaattcagatgcaatcatgtatactttcttgatggactatagaagaacaccaatgaatacccatatgtgatagaactgccttggtagtcagtgaaaatagaacactaagcgtgcaataaatgcaaaccttatctgttttctatttttgtaattattcaggagtttttttttttttgccaaagttttagagtaggctcaagaatatgaccacttctcaaagttatgcacaaaagtcattcctgggtataactcttttcctgcatctgcactaatctccattccagcagcatccttgataactccacaaatgtcattcatcccatgtttgctgagtgcccaccatatgccggatctgggttaggcttccatgtaactcatctaggctgcccctcaaacaggtaaacccacttctttacatgatccagagccaaattcttagtatgtaagggtcaaggttaatttttacctgagagagttcagagacttttataaatatgaaagtctggatatgtaaccttggctgagcatgactgataagactgaaaccaaagcactatcccccaaatgaatttaatgctgtagtagttctcattttatactagggcccccttcggttaatttttaaaaacagtaattcctcttgtttcttttcaaaccaggtaggcataccttttagaatgcatttaaattaaattgtattcattactgtattcattcaattcataagtatttgtagaacccctcctatgtgtcaggccctgttctctgggatacagtgttcaaagaactgacaaggtccctgctttcctgcagctgacattatacatattcttcagtttaaagttgtaattctgggagattatgaaaaagttatttttgtgaaaatgttcacagatgacttcatgtctaggagttacaccagtagacatgtttcaaaaaggtttagtaaattgatttgatgtgtcagatatgaagttgttaattactcaacaatttgagagtactgaactgaaattcactgtgttattttggctatttgaatggattcatgcaataagaatccataatccttcaatgaatagcttgttactgaaaaatacatgggccagtatgtaaaagccaaatactgtacattggttttccatgagggagcatataggtcttgaagaggtttgtaaaaatcaaactatctaagtaaatgagacttatctgaccaaggtattgttgtcagaatagccttagatttaaagaaagaatagtcacttcatttgtctataacccaacatttattgataaataatagtcttatattagagaattaatggggagaaaagaataatgctaagaaaatatgtaactgcaataatttgtaaaaatacttttggggggaaattgtgaattaaaatttaaattcatttattcattcacttggcaagtggttactgagcactgcctcttgagatcctgggatgggagttatggaagactcaaggatgaatcattcttgggttttagacactttcccatccagtagaagagtgagggtatgacatgggacatgacagcacatcagttcagacaaaaagttgaagaattcagaggagaagagttcaggctgtggtgatcagcagagtcttcagagactttacgagttaaatcctggaggattagtgggattttacgccataaaagtggaaaaattctcaggggaatgtgagccaagaaccagaagcaataacacacaaagtcacttcagggaattccaagaaactaatctatcttgaccaggaggttttgagttttcctgtgttatctggatgggtggtattaaaatacaacagcaaaataaacaaaacaattagtgaggagattcaaatggaagaaatagtttgaggcagaaagcaatcattgcagttttaggtgtgttgaatttgagaagatggcatgatatatgggagcaagtagtctcaggcaagaggaagggcggaaatgaaatcctggattgcacccattcaagtaagatagagggagctgcggcaggctacgaggtctctgaagcagagggtgtagagaaaatagggtgacattgtaagttcttgagtatggctgcctaaatctttgacttctttgtcttcgtgacttgtacctatactcttctctgtaagcttaccatcctcccactgccctttgcagcaaatgacctacatgatatgttgtggaatgctgctgcctagcaaaatacctggaatataggtgcttaataaatattttttgaatatataagtgaatgaactttgtgtaacacagaacttctgaataaacttggagattgtgacactcttaatttgatactctagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggtaataatatgtacttgctaagacagttctacttttggaaatttattctacaacaacaaacaattatctagttcttatatgtgaactagataattgtatatattaccattatttgggtttagcaaacagctgaaggattttaaaatgtctaaggagtgacaggatatttttatgtttgtgaataaaaggtatattgattcttaagcaggaattttgtttcatggcttctttttttgaaagagctttgttgagtgaacggaatggtctccattaatttattgctgagagaaacagacaatactggggtagagtcactggtccagtttttcaaatctaggaattgaggtgcagagaggtcaatcatcatcttcctgccacatggcaagttaatgacaaagctggtgggatcattcaaatggaagaaatagtttgagacagaaagcaatcattgcagtaaatttcaactttcacattgacctttagtcagagaacagtaccatttcccaataaggcagggttgggcaggcagttggcccatgtatatttggctttctgctgaatttcttatatttctgtaccatttcttgcttctttttaaaatagcaacaacaatgactcctctgatttcttctcttggccaggagaatcatctcctcaaggatgatttttaataattttcctcatctggttttctatctctgacactgatagtttttcttaacttccttaaatagctcttgcaggagcctcccttgttatgaagggagtgaaaagcagttattccagattagccttaactctgttaacgcttcttttaattgggaggtctctgaatggaaacattttctcacaacaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagaggtaaggtgaaaaggagcaggcagttctgaacctgccttcctgcaagtactcaagctagccattgtgcctgtatgttgaagtctcacccaaccacaaccactactccaagtgtcatctcccttatgaaatccacaccaatcccattagaagtaatgtgtcacaggcatttcacttctgtccttcctcatgtcacaagctaaagctaatacacaagtactcagagacttaaaggaagaaacatttgcagatgtccaagatgtgttagaaaaatagacatattaaatgtaaaacctgctatagaaattggtaaactagaagttgcatattatgtgacagtataaacattccatattttcataataatttgaacctaaataaaaagttaagccatacatgatatttcctgaagagctatcgccctacacataaagcattgagacctatgtttctttcatttttgtatcccccacaaaacatagcacagtgctttgcaaatgtcactactgataaataacatttatttgaattaaatctaatttcttgacctttaatttcctatccataaattagaaagaataaccctgaagttccctgaaaatgtagtttaaggaggatgacagtctacttctttcaaacttccagtgtccagatatgctgaacacttattaagtatttcaataaacacatactgacatgccagttgatcacaaatgtagtaataacatttagactaacagtattttaagaaccaaaattttgtaaatagtatatttggaggcaagatttatcaatgcattagcaggtatttgtcggatgctactatgtgtccatctttgcatcttggttctttggatatcacccttcgagagaatattttcatatatgtgctgttagaagagctactgtgaatattggaagtggctcatatcctttctgaccttttacattctgcctcatttattggcaatgttaggttacaaaagaaactataatctctttcacctccaatccacatgttgtttctcttgcattatttcttttctgcagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaaggtacaattttcatgtgggttaagaagtcactttgatgtggaaaataacaaaatcagtgtttcttccctgtgtctttctcatagtggtcttgctttccatccccgggtttccccctgcttaataagtgtttcacaatgaatcaggcagaatctccttgccttataaagtagtggaaattaaacccagtgactgtgtaggtaatcacccctcctcttcagtgttcagtttgtgaaatgaaaccttttgcttcgttataatctctgtttaacagaccttgaagtttcaaaatgttttaaactgggagttatttcatgcagatttctaatttattatctcagaagacctttgcttaccacctaactctaaaaacctcctagcagatcttccttaattaaattccatctgtttgcaaggtatatttcagccccctattttttcccctcatagcttgtcctgactgccttttgttacataactgaatctttgccaaaaaattatgcacagtttattttatttgcctaaacttacatgtataggcttcttatgtctacaatttaatttcttttattgggaccttaccctaattcttttggaaattacagtttatatttaagtcttaggaataaattaaggccccacttttattttatttgcccatacttacatgtataggcttcttgtgtctacaatttaatttcttttattgggtcctcaccctgattcctttggaaattacagtctatatttaagccttaggaataaaataaggccccacttcccattctgttgcagtggatttatgaattccagatcttctttcatgttagcttgtcagcattcccaggacctttggtgatcctacttgatcgcacatcttagagttcttgaaaactttctgggagagaaagactagtcttttgcataatacacttcttatgtcttgcatgtgtgtgtgtttgttttgtagcaggaccattgactatccaggaagccctgacttactttggtggagcggtggcttctacgataggtctgataatgggtgggacgctcctggctttgctaagaaagcgtttcagacaaaaaggtaaataggaaagagtcttctctttgcatcttggttacataaatcaaaagaaattgatttatgtaatttagggtggggaggcaaaaaccacaacttcagtagttcatgttggaaaacatttgcattaaaagaaaataaagccaagataagtgatcttgagaactgattgtccattagaatcacctagggaacttcctaaaaatatagatccttctatggggagacttggtagtgggtgtggaaatctgaatttttcaaaagctctctcccaaaattcaaatgaggctactttgcagttttgcatttggggcctctggtctaagtaccctaggctatcactaaagctaattagaaaggtgttatgcttcctgacttcactcatttcttcatgtagcagtcatttattcatcaactctgttagagtgtgagactcataatgatggtttctgatattaaggaaggaaaaatccagtaggggagacaggtgaaatcagtgccggtagtgaagtgtagtaagtgtgttaggacacaaatacaacctaggtattattagaacatagactagggatgcctaaaccagactggcaggtcagaaagcctttttcaagcttagctttgaagaatgagaggcatttagccaaggggaaaatggaaatagagttccatcagagaaaatggcatgtagaaagacatgaaagtgtaaaatcaatgagaagatggtatgtttcgcagttcagtgcatctgaatcaaaaggggattatggaggaggcaggagatgaagttaggggcagaagaagctgcccctgtattggtgacctggtgtgataagctaagagatttgctttttctcctgaaaatttgtaaagttgatgcaggatttaaacagagaagaccaaatagatgaaaactctctgtaagggaaactgtgttcatcagactgttcatcagaaaaagaactttagtctaggaattaaagatgggaacatcccatctcttaaggtttaaaacatcctttctcaatcttctccagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagaggaccctctaacagtggagaaggacaaatggccactcatgccccaatatttttaataataaatacattcatttgttggggatgggagcttttttcctcagcttctcccaatttgattttaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaccttaactttataattcactgtaatatgtcagaatgattacatgcaatgcctgcctcctttttacaatgtcttttgcaatgtcttcttttctactctgaagtaaaatacacagataacaaatattctaattaaaatataaagtaggaataaaatgaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatggtgaacaactccggtaaagagtctgaaaacctgtgataattgtcctttgattcatatggcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctatttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggtcatattgcaccctttgaaaactatcgttagattatcaagtgttaatgccaagaattttgtaactacctcttgtcacctagaagaggttgcagcaacttagagggtataacaggtattcagtacataaagcatgaacaataacttagtgtgggtgcaaaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagactataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggagtcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagcaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgtaattaaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactg

SEQ ID NO: 16143 - DNA, 15413 bp, Human
gggttgaattaaattcgttaattaagttatttttttctaatcagttgtcttttttggaatttttcttctcttttcttgttttttttttgggtcttgacatctttatgaacacagaaagaccagtgctaacaagtaaagagaaaaacgaggcttttaccactactcgttcaggtctgctgacagtacatttttagatagacctcctattttgaaaggctgtagatatagaatattagcttgacttgagctctgaaaacctacagaatatggaaattaaaatgatccccatttactgttaccatcatttagatagggtaagatgcagagatggggaatgtatacaatcacccagaagaaatgtcaaaatgaagagcaggaatataggataccacatacatctccttctgttgcatttggaaacaaatttcttttcttttctttttctttttttctttttttttgagatggagtcttgctctgtcgcccaggctggagtgcaatggtgtgatttcagctcactgcaacctctgcctcctgggttcaagcgattctcttgcatcaggctccccagtagctgggattacaggcatgcgccactacaccccggctaatttttgtatttttagtagagacagggtttcaccatattggccacgctggtctggaactcctgacctcaggtgatccacccacctcagcctcccaaagtgctgggattacaggcatgagccatcatgcctggcctagagacaagtttctttaaactgtattcttgttactataaaggtgaaaaaaagggaaattgaaaaaaactttaaaatcctgaaaataataatgaaggatataaaaattatcccaaatcctgccatccagagttagtcactgttaacattgtggaagaatttttattctttgcacattaacatttcaaaaattttaaacaaaattttgaccaattaaatatatatatatagttttccgttttattttttttcttttcttttctttttttttttttttttttaagacagagtttcactcgtttcccaggctggagtgcactggcgtgatcttggctcactgcaacctccacttcccgggttcaagcgattctcctgcctcagcctcccgagtagctgggattacaggcatgcgccaccatgcccagctaattttgtatttttagtagagatggcgtttctccatgttggtcaggctggtcttgaactcccggcctcaggtgatccgcctgcctcggcctcccaaagtggtgggattacaggcgtgagccactgtgcctggcctcctttttatttttttcactgaacaaaccatgaaactttcccagatgtaaatatctatttcccatttttctttttttaaaataaggcattattttaaccatttgagtgttagatattatttttagataatattttaatttaggcataactgccgtgcaaaatctgaagattaatatctaccttgtgagtcattcctctgtgagacagtgcatgttaaatatgttgaattggcaggtgaaaaaggaagaaaaaatgagtagtgattggttatccacagctatgaatgagaaattgaaggtagtagactatggatgacaaacctattcttggtttccttctgtttctgaaattctaattactaccacaactacatgagagacactactaacaagcaaagttttacaactttttaaagacatagactttatgttattataattaaaaatcatgcatttttgtcatattaataaaattgcatatacgatataaaggcatggacaaaggtgaagtagcttcaagagacagagtttctgacatcattgtaattttaagcatcgtggatattcccgggaaagtttttggatgccattggggatttcctctttactggatgtggacaatatcctcctattattcacaggaagcaatccctcctataaaagggcctcagccgaagtagtgttcagctgttcttggctgacttcacatcaaaactcctatactgacctgagacagaggcagcagtgatacccacctgagagatcctgtgtttgaacaactgcttcccaaaacggtaagtgcagaacgctttataagggcagcctcgggccatgaaacacagatatgcaaaaggccttctaataaaaaccacatctgtacaagctcttattgtattgtagctaaaacctgtcttttctctttgacctaaataatgaaagtcttaaaatttgtttatttatttgattaaactctgaaataaagattattgcactagtgtcctttgcccaaaatcttaggatgctgccttaaacatcatggtagaataatgtaactagctacccacgatttccttctttaattcattttgtgttttatctccccaggaaagtatttcaagcctaaacctttgggtgaaaagaactcttgaagtcatgattgcttcacagtttctctcagctctcactttgggtaagtcagtgccattagaccaagatttctcattctcgcactatagatatttcagactgaaatatccttgcttgtctggggctgtcctgcacaggatatctggcagcatccttgacctctacctgcaatgtgttcttccctgggcttggggtcatttactttacctcttggtgtctccctttccttaagtgtaaagtgtggatcataatgacctatttcccagatgcattgtgaggattcaatagcatggttcatggaaagtacctcatacagtgcttcttggtgcatactaagtgctcaataaagcttagttattctgattattattctactacaaaatgggtatactataatgttgtgagtgagtgtggataaggtacctagtgggtggcagtcacaaaagagataaacaataagtcgctgtttcttcatacgtacttcttacttttgaaaagatgagaaaagtctgggccatgtcacaaacattgccaaaaataagacaataaaaagcacagttgtcagagttaaaccacaacagtaccaaactctaccatttcttttctttttctcccactagtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacaggtagggagtttgcggcagcagtgggaggtagtttcagtgtgtgggcatcttggcaaatttacagcatgcaaaaactgctctctattgtggtcattttatgttccaaaagattctgtttaactgctaaagtttctctcttttgctgttttgtgtgaatgtgggcaagaatatgtggatatgtatatatatacacacacacacatatatacacacacacatatatgtgtgtgtgtatatatatatagcctacagcatttatatacattttatatatatacatacacacatatacacacatatatgtgtgtatgtatatatataaaatatatataaatactgtaggcaaatatgtagttctttacatataaaaatgcacacacacaatacatattttaattacttgtttatttgtggtaggggaactgtcttcagagtttgtgaagaagtaaattttctacggtaggtgccagccacagctatacattagcatcaaggtttaggataggtgggcctgaaactcagatttggaactttgtaaaacacttcagttaaagtctatggcactctgtaggactgctgatgtctctgttgcacactgttgattctaaaatcaaaggcactcagtataagcacagtaatagtcctcctcatcatgctttgtattttccgtagctgcctgtaccaatacatcctgcagtggccacggtgaatgtgtagagaccatcaataattacacttgcaagtgtgaccctggcttcagtggactcaagtgtgagcaaagtaagtctggttcttgcctctttcttcacttgagatggtagcaccatctcacgtcctagctggcattagagtcaggtctgcatgccttcccttccctggtgcagatggtgtcatatggtgatcgtgagctgagactatgaagtcagaccctgctgggtttgagtcctagattcaccagttatttattttggcaccttgacaagatagtttaactctctatgtcagttttctcattgtaaaatgaggataataatagtgtgaacttcataggctcatggttacatggtgcctggcacacaggacacattcaataaactgtaattctgtgtccctgcgaggaacatgtactcacctcatctaggtggtaacaagacgttgcagtagaaatgagtgagttacagagtccagggtatcttggttcatgctctggcctctggctctgtaatgactagccgtgtagcatggagcaagtcgcttgaatgaaatgaggtctcagttcctaaatttgtacattaagagagttagatgagcttctctccaagattccttagcacagcgttgtgcagtagagcttttgtgataatggaaatgttccatagctgtgttttccagtgtgtacctatgagccacatgtggttattgagtacttgaaatgtggctggtgacactgaggaactgaattttaaatgttatttgatttcaacgaattcaagtagccacagatagtggctactatagtagacagtgcagcattagggttttaaaatttgtaatgtattctagtacttaaatttgaaatatagctttgtgaatggttctcatcctggttggaagcttactgtagtatttttagcagttgtgagaaaagtaacaagaaatttgttgtggtacctaagtttgctgtgtttgttcatataatttgaacagttttgaggtaaacacaattacactactctccccatatcactcaatatttcttttttatggttgtcatcactgcttttttgttgttgttgttatggatcagcattttcttgaataaaagaaaaggggtagaattacagtcaattttacaaattccattagaaattttataaatttttaaactaaaaaaaaaaaaaaccaaactgtagttctagttttcagtgttcttatctgttaaaggtgagagatgagcagaactgatttgggtttctttttcagttgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatggtaaatccctctgagaatgcacagaacgttctgtaactcatccctcattgcttctgttttttgattcaacttacattttcaaaacttcagggaaagttttttttttgtttttgtttttaatacaatttgttctctcagccaatgtatattgccaacccagtacctgcttgggttgagagaggtttttttattctatgcttgaaatgggtgtttctgaggctctggtgatttgtaagggagaccataaaacaataaagctctagaaatctcaatggatttctcatcttgtttccctgtttaacttttccaagccatgggactaacttaagaccatgatagtcaagcagtcttagtatctctttttctctcttaattttatctttctgaaccagaggccaaaaaaagaaaaatcagttcttcaggctctgatgggctaaaataaatgaatagcctacgtatgtcagtactagtcataactcctaatctggaatctattttttttaaatttttacctcacgtaaatgataacatagattagagaccactcagcataggcaaagtggaaatcagaaaagatagaatatccatgaaaaagaataaaagcttttattctggctgtgcatgtccctaagaattgacataggactttggaatctaccctttgaaggcagcttcctcactctgttaggcacccagctcaataggaagtgaaaagatcattcttctgtaaaattcatggtgctctttcaaatcctcagtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaaggtagagttgttccacatggagacttactgtgaacattctttctctcaacccatactggaaatgggcaagctaattctaggccgtgctaatatcaatgcgtatatttgttacagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaaggtaagcttgagatccttcgatttatactttcttaaagaacaaccatcttcaaacttggacagtgaaaaaaaaaaccaatacccactttaactatagaaatcagatttgatgagcaaccctcgtatctttgagattcatttaaaagaactaatgtttggccagggaaaggatcatatgtgttaagaatgaattctttgctgtttttttttaactgtgatgtgctgataaaactttgtagacattagcatggaatagacagaattcttaatctaaaggaatcatattagaaaattcggaaagcagaataatgagaacatgatttgaatgtaaaactctcatcacacctgtcttctgaaatggctcataattagcagtgatgagactgtttcaagcatggtgtcagctacagagatagtattgatgcatatataagcagtaaattttaattcactttaaagtgagagcaaggatattgaaaacaagcagtttttactatcaggcactggccttgtcctagccaaagccagcacagaatgatttccagtagcaaaacataacacaaaaaccaaactgcaaaacagacaaattttataggggtgctttcttttctttctttttggcaccatctataaacatccatgacccatatgttgtcctcagactgcgtgaaatctttccttggaccataatttattttgtgtgttagaagaacagtgctcaggaactaatgttctgattaattagtcttttaattagtgccatgatcagtgagggggctgaaattcaaagaaaacacagccatcttcccatttgtccagggaattataaagaatcttcagttctccaagtgttgcttgaatgaactgggttcactcaacaaacgccaagtactctctagttccactgcaatattttctgaccatcattttgatgtctcagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaaggtacagtctttgtttttattttattttaagataaaaagaactattgaagagcttgggaacttggttaccttgggaaacgtattgctggagatgcaaacaaacttctaaagtgctctctcgtgtgttccagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaaggtagaattgagtgcagacttttttagggtacaggtcaaatacttcataaagtttctgaacctagattgccccaaaggggtttggtcctaatttcctacatgctgaaaactaagtagcgcttacactttacattcattgttgacttttaagcaagttttggaagttttccagtagatttttctgaaactctgcctgtgtacctaacatttgcagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaaggtgatgcattgattgatggtggttgtctggtgattaaaaagaaaaagggggagctatcttgttacagtaatcaactattcattatatccaaaccagaaagttcgcccaggttgacaagttgtgaatattaagttgtatggggatagagaaaaaacagaagttgcatgttgatggaaagggtagaattctgacaactggaaaaaggagacagagagaggagaggagaaaggggaaatggaaaacaagagggagtgagagcaagagagcaagcaagtgcagtgtttattaaccaaggtgtggtgtggtattgtgaacgagcttggcaagttagagttctgcctgccaatggtggaaatagcttcaaaggtggcttggagcagatctcaaaggcctgtaatgccacatctctgcttcttgtattaaactagatagctcttctgctcctagtaatgaatgtacagaaaaaaggccaaagggacaggacggagagactttaacatcaattcttcctcatgacctttcttcgtctcttacttccttagctcccactgagtccaacattcccttggtagctggactttctgctgctggactctccctcctgacattagcaccatttctcctctggcttcggaaatgcttacggaaaggtgaggaagtttatgaatgtacttcaaaaatgtttttgaaaatacatttctttctcattgataagtcatggtcttgcttactgatttaaacaataattagaatctggataaaatgcagtataattaagcagaagtattaagaaaagagttagtagtacaactcagtgtgggaagtgtttcaggaaataaaaatgttagtcgtgcctaatattgtacaactccagggggtgctattcatgttgaattatatgatgcctcccggaattgtgcaatggaactgccatgatgagcactctaaggaaaatggataaaattcttcctaaggagatttatttggagtacaggcttaaatttgagagtctctcataaggaatatggaagcacatctgactacactcatggtttgtttggcttacatgtttaagagtacttaaaacatttttgagttaagttctgacgtttacaaaataggaaatctcacatttaaattaagactttggacttctcatgaaaaattgggagctgaattgggcaagatgaccccgtagctatttgctggcattaggaagctgctatgccctttggatggctgtgcactttgcattttaccctagatgccacagagccatgcttgtgctctgattattacagaggccctgaagcatcgagtttgcaacacttgatgaattaagtcatattgtatctggatttaatatatccttaaaagtcatttagtctgaattaatggttgtttgtcttttcttttgcagcaaagaaatttgttcctgccaggtaagttgcattcttatacaaagcatgccattgaacattccacatatttttctctcttcatgttggaagacagtgctttacctagtgttctcatgtattccacagcagctgccaaagccttgaatcagatggaagctaccaaaagccttcttacatcctttaagttcaaaagaatcaggtaagacttgtaaatcacaaatggttatgagagaggtatcttctctacatgctctgtttctccttgaaccctccaaacttgccaatatcttagggagggagcaggggagaaatcatcacctgggtattgttctggaaagttgctttattttttgtagaaggagaggaaagaaacggatctagctttattgtgtaatttcatttatgatagataataataatgaagatagctgacccttacattgcacttattatattctgggaatttttctaagctaggaactctgagataggggctggtactatatttcttatcttttctttttactttttttttttttaattttgagatggagtctcattctgttgcctagactggagtgcagtggcatgatcttggctcactgcaacctccacctcctgcgttcaagcaattctcctgcctcagcctcctgagtagctgggattacaggtgcctgccaccacacccagctaatttttgtatttttagtagagattttgtattttttcgtcatgttggccaggctgatcttgaactcctgatccacccgccttggcctctcaaagtgctgggattacaggcgtgagccactgggcctggcctgttactttatttcttatcacacagatgaagaaaatgagacagagaagttaagtaaattgtctgaaatctcaaagctagtaagtggtgtagccaggattcaaactctggcagtctggttctaaaatttgtgttcttaactactccgacctgctttgagagaatttggaaaggtcaagtccctctgaatactttttaaaaaattaaaataactttttttgtgtgtgcggttttaagtttacagaaaaattgagcagaaagcacaaagagttccaacatatctccccaccaccccttcaattccccctgttattaacatcttatattagtgttacaactgatgggccaatattgatacattattattcattaatgtccacaggctacattagaattcactctgtgctgtgttgtatattctgtaggttttgacagaggtataatatgtagacatcatcactgtcctaactgaatagaattcgatgttcctacatggtctatcctagtgagagtgtctgtgttagaaggtacattttgttgtcatgatcagtatgcagaatattaagtgttctgatgacatgcatgtttatatttacagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgtttatctctgtgttaagtctctttcttagaaattttatttagataaaactcactttccataaaacgcaccctttaaaaatgtatgtgattgtacagctatcaccattgtttaactccagaagatttctatcaccctgataaaacattatttctcagtgtgtctgtgagagtatttccaaagagattagtatttaattggtagactaagaggattgccttcaccaatgtgggtggccatgatccaacccattgaggccctatgtagagcaaaaagagtgaattcactgtctttttaagctgggacacccatcttctcctgccttccaacactggcactcttggttctagggcctttggactttgaagtattccactggctttcctggttctcagctcgtagacagcaggccatgggacttctcagcttccataattgtgtgagacaatttctataaaaaataccacacccccacaccccaacacacacacgcacacacgcacacacacacacacacaccattggttctgtttctctggagaactccaactaatacatgtcccttcacgagaactggctacttacactaggtctcctctttaatgccctcataatccatatgtctcttccttcctttaattgtaataaataattatagattattacttgcacaattgtttgtttaatgtctgtcttccccactaaactctaagttccttaggggtagggaaaaattaccttgttcattgctgtattcccagaacctagcacattcctgatacagagtggacatccaacaaatatttattgaatgaataaatcaatgcatgggtgaatgaatgcatattttggctcataataagaagtagaatcacttttcacaaatggaatgagtggtctcagaaggctagactttaaaacctagttatgtatcaactgcccccactactgccagtttgcaatttaatatatctatctctcaaaagtccagcaattatttcaatccccatttacagaaatggggcttgtaggaatcattgtgagggctaaaggtcaatagaaataaaagggaaaaaattttttaaaaaaggaggtgtaaaaatagcacaagaggaagtaataagagagaaaaaggaaagatactaaaagaaaaaatattgagatgcatagagtaaacagtacagatgctacagaagggaaagatctagttttgtattcactcacctgggagcttaaaacatccacacaagtgctgggcatggtgactcacgcctgtaatcccagcactttgggaggtggaggcgggtggatcacgaggtcaagagatcaagaccatcctggccaacatggcgaaaccccaactctactaaaaatacaaaaattagctgggcatagtggtgcgtgcctatagtcccagctactcaagaggctgaggcagaagaatcgcttgagcctgggaggcggagtttgcagtgagcagagatcacgccactgcactccagcctggcgacagagcgagactctgtctcagaaaaaaaaaaaaaaaaaaaaaaaatccacacaagcgtacatgctaatgtgcacacacatacacagagagatatattcctaaaccctaacccacaggtaatttgccctgaagataatgaaaattaagcttcagggcccattacttagataaacctttaaattacaagggcctgggtcctaggaatgtgtttacatggtaatacatctttgtaagatctataaaagcaagacgcttttacgttccttttctcaaagagagacctcaaattatataaaccttggaccctgaaaaactcctgaatgttcctgaaccaacccaaaatattctgattcagtaggattgggagcgaatgttgcgtgtatatttttttgtttttttaatgttaccaagtgatttggatgcacaaccaggtttggaaattactgaaaaaggactataggctgattagtttaaagtgtccctgatgtctatgtg

SEQ ID NO: 16144 - DNA, 191433 bp, Human
cgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaaagcacgcggtggctcggctcggctgaatgctcatcccaaccttgacggcctccgtccccaccccggggcgggcagcaaaaatgtcttgaccagccgtcctgtgaatcctttctgcgtgagcttggtggctcctgaactgatagagctccttctgggggtggaggcaagcaagcagtgttcgaagagtgagggagagaccttgctgttccttgctctcagtgcattcactgcaatattggtcgctgtaagacagacacggggagggtcctgggcctgcgcggtctttctaacactcctttaagcgaggtttggagtctaggagccctcttattgatcccgaacaggctctgggagaggcctttgtttcccagccctgtcttcccttcgtactggttgtaactcacaccacaggtgctggtgccaatatcacttccagcgcctctgagccatgtccagcatcccttgctgcccctggtcacaggacttgcagactccttggagcctgtgggacacacgtggagttcacacacccagcccagcatgagcactcctggctgtaggggaccatatttaactatggtctctctccataccttaatgacccatccttcttcgttttttagatcctcctgtccaccgggcagttgtgggcaggagggtaggtacgacaccttacgtaagtgtgtgtgtgtaaacacacacacactttttttttttttttctgagacggagttttgctcctgttgcccaggctggagtgcagtggcgcaatctcggctcacggcaacctccgcctcccggtttcaagtgattctcctgcctcagcctcccgagtagctgggattacaggcgggtgccaccgcgcctggctaattttgtattttttgtagagacggggcttctccatgttggtcaggctggtctcgaactcccgacctcaggtgatccgcctgcctgggcctcccaaagtgctgggattagaggcgtgagccaccgcgccctgccccacacactctttctgtctgtctctggctggtgtacatacacacagttcagattttatattatacatacaataactttgaggcttccgtgggtagaaatgacccaagttagtgtgtgggttgtgtgtgttcctgttagtacctagggatggggacaggccttgggtctgccagtgctttgcagccctgagaacagtagaaggccagaggccaaggctgatggtgagaggatagcctttgcggaggagagcccagtgtccatagatttctgtggccatggctacaggctcctggcctccaatgagtttgactctgcttctggggctcctgtagtgaggcagagtttggaaaaactgtttaaagataaggcttgacatccagggggctggcgtgaagctgacaaggaaggggctaaagtcttgctaattttaagtaagtgcacttcatcataatgaatgttggccttgcctagggagcccctactctcagacacagagaaagctgaggacttataggacttcactacaattttcatttcacttcatctaacagatgtcatagagtagtgaattaggcatctgctgtggcagaaccttctttttactctcagcatccctggcttgaaaggcagatttgtagatttctaggaagctacttcaattaaaatctctaagatcctcttgctaagggcttggcaacagggaggagggggcatgttgtagtggttgaattcttacttttagggacactgatgaatttgtcttttgttctctcatctcttttgcttcttcccctcttctttctcctagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggtaggccccgctccagccccgcacctgatgtaggacttgaggccctcacacccctccttcacaccctggctgctcccaagttaggggcctggctcccctgtcttggcaatttgtgaaaaaaccagaacacttcttctaaagttctggcggggaggggagcaggttttttaaagtgtagtgagggggcctaggatctttccaaaaagcaccaggggacactcatgggcgcagcttcttaataggcccttccctttgttttttgcttttgggcccctgtttgttttttctgctgtttggtctgttctcctttgcttggagtgactgataaaatggagagaaggagaaaaggagtgggatgagggtctcttgggccctgcatctgaccatgttactaggtttcaggtcctcgggttcccatgcagtggtccctgtgaagacagcctgtccctttctgcagcttgggagaatgggagggtctgggggctgcttaagccacaagagcagctgcaggttctgaaccttattcctggtgaaagttaatctccttgctctgtctcccttctcattctctgatcctgcacatgcatttagggggaattgatttaaatgcaaggggaaaggatgggtataagagtcttggtcttgcagcctgtgaagtctcattcttatcccatctctgctcacactgaactaaatgccgcttcaggctagcattggcttccctccggcttccgtttccttctctatgaaataaccattcattgagctcttatgacatgtttggttcagtactaagcactttccatgagttgcattttcattacaacagccctttgagataggtaatgtccttcttttttttttggatgtgaagtttcgctctccttgcccaggctggagtgcaatggtgtgatctctgctcaccgcaacctctgcatcccgggttaaggtgattctcctgcctcagcctcccgagtagctcggattacaggcacgcaccaccatacctggctaattttgaatttttagtagagacgggctttcaccgtgttggtcaggatggtctcgaactcccgacctcaggtgatcggcctgcttcggcctcccaaagtgctggattacaggtatgagccaccgtgtccagctggtaatgtccttcttttacatggaacaatactaaggctcagatgtcaagtctcttttctagggtcacatagatagtaagaggcagagctggattcaaatttaggtccttaccccctggtactttgctgcctcttggagtcacttagacttgaagaggatcatgtctatggaacagagcgttttgaagattgcttataggaagtggagtaaataacaggggggataagtagcgagtttgttttttttttccttgcttctgtcataaaccacgtgcccatcattttatcctctagtttctgggtcagatgaatggagtcaagaaatccagctttctgttgtcattgacgacagcatttggctgcataccctgtggtctgctgttttgctgatcttgggtggattctccacttcctcccccttcacccccattcccctgttgctcgttcaggtacgggggatgtgagtgagaggggttggggtggggatatctggaagttgatctcatcacccctagccggaatctgctctgaccctgcctcctcgacagctcagaggcttaacttgtggaaagtgtggcagagctaaacgtagccgactttttccagtgggtgcgaaaaataaccgccactaaggtgtgtcttcttgatgcttgtaccgctcagaaatagactgaggttgtgtttgtttttgctcaaactttcctaaagaggaaacccgctccccaaagttgaccagatagatgtatcatctttccggatgtgaattatttcggctgtgtgctatgagaactgggtatggtgggaagtaattgtttttctggctctcatcaggtcctggttcctggttgcttttctttacccgagagggccacaaaagataccactctcctgagacttccaagttccccttcagcaagaccctcattcctctggggagagagggagagttggccatgttatattcgaaagagcctgggtattggaattggccatatttagtggtgagagcctgtgatacttatttaacctttctgggccttgtttcactcactacatttttttttttttttttttttgagacggagtctcgctctgtcaccgggctggagtgcaatggcgtgatctcagctcactgcagtctccacctcccgggttcaagcgattctcctgcctcagcctcctgagtagctgggactacaggcacctgtcaccccgcccagctaattttttgtatttttagtagagacagggtttcaccatgttggccagaatggtctcgatctcttgaccttgcgatccatccacctcggcctcccaaagtgctgggattacagctgtgagccaccccgcccggccttcactcacttcttaaaatggagacggtcaacagggttggtgctgaattaatgaagtaagatccagaaatcactagagctgtgatgggcacatagtcaccgcagcggtggagaactgaccatctgtcccttgtgttgtttaggcctcatctctgcatggtcctcattggctctgagttctagtgtgtagtgtccacagtgccaccctccatgagggttgtgttgactgtgaggtggtgcagagaatgtccctgtccttgtgagcatatgacagcaagacactggccctggaatcctccgtgtcacatgtgggctgctgacaggaagaatgtgcttttgttgttgttgttgttgttgaggcagagtcttactctgtcgcccaggctgcagtgcagtggcatgatcttggctcactgcaacctctacttcccgggttcaagtgattctcctgcctcagcctcctgagcagctgggactacagatgtgtaccaccatgcccgactaatttttgtatttttagtagagatggggtttcaccatgttggtcaggctggcctggaactcctggccttaagtgatccacctgtctcggcctcccatagtgctgggattataggtgtgtgccaccctgctgggccgagaatgtgcttttgactgagggtggaaagtcagcagctgcagcccaagaagttagagccaggggcagtgcctttgatgggaagcttgggggtctaaagaaatcagaaaggggagaaaataatcctgcgtgtgctcagccctcactcagatcaacagcccctcgggtcccagctagatgtactttgtagaaggctttttttctccccctcaccctcaaaactccaggattaatgtgctattcccttttttctactgttctctgtctccccccaacccatcagcagtctgagaaatgctatggtggaaaaaaaaaaacaacagccctataaccagtacaaacaaaaagccaagacaaaaaaaaaaaaaaaaatcagaaggggagattttgaggccaggaagccatggcattcactggaaatatatcagtgataaaataacaggctacagggtttattttattttatttttaagtcaataggcctgagtgttggtaaagactagatacccagcaatccttcttgcatttcttcttggggtcggggggcagaagggaatggagaggaaatgaaggcggattgctggtaagtgaggcaggaaggcagggagtttattatggaatgtcatcggtaagtttccccatgatttgatcccaagctggtgtggagtgaagggtaagctgttggctcaacagatagtgagaatcaaacttagtggagttgtagatcctgtttcctgcagcggacagcaagatgtacaagccgtccactgcaggaatgacgtgctgtaaaagggatgcagtgtcaagtgtagtcatggatgggtgggaagaccagacaaaggcatccaatgggactgacttacctaaacaaaccagaaggaagtcagaacagtgggaagatctgatagataagcagtattctgcaggcagatgaaggagcaagctttgggcccccaaatcttcaccagtgcatccacattacagaggataatgcctgagggaggggaagatcatctcaggattctggaacactgggccctccctttcttattccaaaaggctggagcagttctgcatgtaggcttctctggaaatggtctaggaaccagctcatccaggccaggagcacctgatcattctcagagttacgtacatatgcgataagattgcagggaacagtatagttctatagacttaagtgtgaacatagtcctcatttatagtccctagtctcccatggctcacgcagcttggtctttatgtgtttctgaatttagtgctgcagaggcacaatggggtctggtttctggatcttatacagacaagcacttaggtcagctgcagtggatgtcctgcacagacaccgtcgcaactcttgcctggttcctttttgtttttggagatggagtctcgctctgtctcccaggctggagtgcagtggcgcgatctcagctcactgcaagctctgcctcccaggttcacgctattctcctgcctcagcctcccaagtagttgggactacaggcacccgccaccacgcccggctaattttttgtatttttagtagagacagggtttcaccgtgttagccagtatggtctcgatctcctgaactcgtgatccacctgcctcggcctcccaaagtgctgggattacaggtgtgagccaccacgcccggcctattgcctggttcttgaagggattctcaggaaccacaggggaatgtctgagccagctttctggatccgtgtgtacagcccttcccagaggctttgtggagccagctgtacggtgcatgagctttgtggctaagatatcagagttctgcctggcccttggccttggtctctctcagatggtcagctgctctgtttttagtggttgatcatgtagaaggccaacaggtgttgaccttggtttaggctacttttgggatttttgaggtttcctgagactcttggttttctttcatcatcccgtccagaacctctgatgtcaaactaaattctgtttggaaaagggtatgctgtagaataatgatagccacagcaatgatattaataataccttttatcggttgcagcattttcttctttgcaaagcacctctaatgactttatctctcttgccctcacagccttccttgagtgggtacaggtccataatcccatatctgtgataatgaagtctgaaaagctctgaaaactaaaaagtttgcagtaaactcatttagtggcaaaacctgatctgaactgatgtgaggctatatttatcctgcttagtttgaatattcatatgttttgctgcaaaaatattaatgtgtttgattacagagtgctgccctagactctgctggggctgttaaacacgataggtgtcagagtacctttctttttttttttttttttttttttgagacggagtctcgctctgtcgcccaggtcggactgcggactgcagtggcgcaatctcggctcactgcaagctccgcttcccgggttcatgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccagagtacctttctaaagtctgaacagttttggtcgttgaagcacctgaaggttttggataagggattatgaacgattatcattctctattgacaaatgaggaaaatgagatttggagcaagtaagtgacttcccatggtcacacagctataaatgggtagaaccaggcactcagcttgccttctaattcacagtcctgggcgctctgcaccaggccatataagaacatgagcattgctcttctgggtcaaatccatctgacctagtctttggttgccatcaccatgcctaagataccaccattggaggctacaaccatcttccttgacgtcaatcctaaaggtcaggtgtagcttctcttagtagctatttatggctgccttgtcattcacagatttgccaaaatcctttttgaatccatttccatttccaggaagtatcctttttaggggtgatgaatgacaagtttataatctcctgggctcctggaaatctggtcttttggagagaggttgttggttgtgaagataggaagatggcagaaggctttgtagtggtgaggccaggtctagacctagctctgcgtttttcagctctgtcaccattgacatcgtttttttcatcgtgagccttaacttcttcatttttaaaactaggcacttcagtgagctctttctggattgttgcgctctttaaaaaattcttttattctttgtgtacccacttatatcttcatgaagtccttttggttaattgaattttgctgttttggaatctggattggcagttcagccagttaagtagggggtcagtttgatttgattctgtgtgttctgactttttttttttttttaaatactttaacctgcttagggttactgagccatctgggatctagactgaactcttggaacttttgaagatgatttcctttattttattttcaatggaggaaagttgcccactctttcatctcagtgagaagtcccattttaatttgccatcactattggatggagccgctaattgctgggagggagaaagctatagtttagcaacacgttttcctcctgctcgttctaggaaaactattatgaatctttaaaatagtgattatcctaaactgttaaaatcaaattctattcacagctctttgatttcttgctaattcaggagagaaacttttccaatcactttaattttttttattaatttaaagcaagccctgctgaaagcccaagtatatatgacttagagtcttactaaatgaatacaggtgtgcctcagtttgtccattggagggtttctgaattttccataactaaagattttctattctgttttggctgggtgtgtggggtgaaagctcttactctctggcagttatttaagtagtaagaaatttgctacaactcttccccacccccacgttttacagataggaaatgagcactttgactgtccaggtcagacttctgattttgctacttactaactgtgacagtggttgtgttacttaacttctgtgtgcctgtttgctcatttgtgaaacagaaataatagtagtacctacttcattgggttgttataaggattcatcagaaaatatttatcctgtgtgaggaacggtggcacaaagtaagtgctccataagtgtttgctagggtatttttcttgtcattgtgtgaagtaggtcatgctagccatgcagggtgaaaaatgtgttcatgttggtccagatcctgctttctccctgagaccgttcttccgcataggcgtcaatccgtacagtgctgtaaaactgctgcctcgggcacctcatgtttggggctgagacattgcttctgcgtcttccccagaagctgatctcttgtactgtggtggccagggtactctttgtcccattgacctgaggcctggtgagtcattccagttctcgtttaaatttagccgggcagcgctccactgccatcgggtccaaatgccggggaggctcactgatgcggtgtcctgttgcctgtgcacgtggccaggcgtgcacatcactgtgcttatgagagagatgaagagcacagataccaccttactgatgggggtcctggggctgggcttgtgggtgttgggggttccagagctccttccctttcctgcctgtcagtgcaggatgcttctaaaatgtggactcagcagacattgttttgagtgcttgctacatgtcagattctgtgctaagtgcactcacagccagcatctctgtaagacctctagctgtcctgtaaggtgggtatcagtttcacattctcagatgggcggagagaagcccaagaggttagtggacttttctctagtaaagagttgtacaggccgggcgcagtggctcatgcctgtaatcccagcactttgggaggccgaggcgggcggatcacgaggtcaggagatcgagaccatcctggctaacacagtgaaaccccgtctctactaaaaatacaaaaaattagccgggcgtggtggggggcgcctgtagtcccagctactcgggaggctgaggcaggagaatggcgtgaacccgggaggcagagcttgcagtgagccgagatcatgccactcactacactccagcctgggcaaaggagtgagactgtctcaaaaaaaaaaaaaaaaaaaaagagttgtaccaggatttatgttcaggtcttctggctccatgctctctgcagctgggtgaccagggggctcatggcttcaccagctctggcctcctcagttcctctggtggcttcttgcgaggaggaaggttactgcagagggttcagctctttaggggcccaggccgcatggatccaaggactagtacgtcatctcttaccaacacagagagatcagcttctagtgatagaggccttttatgctgacttgaaaaacagaaaaagagagaaaaaagaaacccatttacaaaaataaaaatcccatgctgttaatttcatgccagcataatcagaaattcccctttctactgtttccccttaaaagccccggtgtccttattatgctggtgcagtctggaaaaactatggttgggttttgcctacgtgaggcttatctctgcagctgcaaggaggggatccggtactttattgtcagcatggaaacttccgctaaatacttagaaaaaccttaattctaaattcctagctcactttcaactgtgtcctcgggacctgattttcttcggtgtgaacagattgtgttcagcattgcagtagaaagggtccaagttaggtaagagaaaggacttcctgagacactggggtgttactgagaaagttgttagaagactgtcacagacattttgatgaaggggggacattctgggccatttgaagtggtttttagagttctttcctctttagggccattcggttcccccagaaataagaagaaaagacatatacacgcacataaaccaccaccaccaggcttgctgagaacaagtcaaatgtgccaccaaaccatcgtcttagtgggagatggggtggcactgcaggggcagaaagactgacgtctgatggacttgggtttgaatactagtgctccatggtgaatttgggcaaatgacttcacctctgtgaagcagcagtatcctcttctgtgaagtgaggttagcccctacctctcaatgtggtttttaaagtatgttaatgagatcacttgtaacctaaagcacacagagtgtgaggccacctccctacttcctgcttctctcatgaccccagcctgacaagggagccgctgagccccctgccaccctcacccggcgttgtgctctaagtggattagctcagcgttgtgatcttaatgccattaggcctgttggcacggctctccttgccatagtgagaagcagatgtggccgaccataatggcccttagcgtgatccatcgggcccacagtgctggggcaaccattattagtgttaatttgggggagctttttatggtagctgggggaaatgtggagggattgttggaaatttatttaagctgttcagcaggttaggtgctgctggggtctactatggcaaaaccctcagctcccccaacccatctctttaaggaacgtccctccccaacaccgaagcccaggcctgattacttccagagttggagagacaacttagcaggctcttgtttcttgccgatgtaccttattagtagcacctggcatcataacccactaatgggaaccagtgctctcctcctgcgtggccagtgacaagtagccctgtcagccggagctcgccgtgcgaggaagttcctattagctttatggtcaggagaacttgtcctgttcaggaaatgaatgttgccgctaaaggtccgcggccctgaccctggcggcataacctgtgcgggccggggagaccctgtgcaggatgcttgggatttcagcccctctctggttcttgtcatatgtaaagagggaatcattgtggtatgttgcagccttgaacttttgatttatgcagtgagggcgacttaaccgtttccatgcctggacggctgtgcagtgacagagccgtgttgtgagcgtatgtgcctaggtacatgtgtgtgtggggtggtcaaggggaaggagagacccccacgtgctagcaggggctgttgctgggagtgggtggatttcatgggaggattccttttcttttttctttttcttgcattcttgcagcatctaaatttcctgcgattgttggctgcaaagtggtaagaagctggagagcattgtgtctggaattgaacctgggttcgaattaatcttctgtctcttagaggctgtgtgaccgtggcaagattcctcaccactcacttcctcatctgtgagatgaagttaataacttctgattcatactggtggtagagcagtgttgttaagtaggtgatgtatagagaatacatggcccagcgtccggccagtggtgtggcctcaggttgtatacttgaaaggatgtgtatacttcagtattttttccattgtaaaattaagggttttttttctttttttcttgagacagagtcctactttgttgcccaggcttgagtgcagtggcgcgatctcagctcactgcaacttccgcctcctgggtccaagtgattctcgtgcctcagcctcccaagtacctgggaccacaggggtgcaccaccacacctggctaatttttgtatatatatatatatatatttagtagagatggggtttcgccatgttggccaggctggtcttgaactcccgacctcaggtgatctgcctgtctcagcctcctaaagtgctgggattataggtgtgagccactgcgcctggcctaagtttttaaaaattaaaaagaatggcatagtgcttttttgctctttaacagatcaagaccaaaagttttccccccatcatagcccaaagtcctaaagaaaggctacttaagttgttcgttttcttttgtttctcccatgagtaatgtttctaagtgtgatttttgcagagaacagcagtgtctgacctcattcttgaggggaacttttctgcctgcctcttcttgagaaaaaatgtttgtgagttgtctggcaaatggatgcgttacttttgctgctgttgctgccgctgccgttttaaaggcccctggtgacaaaggagtgaactgcactttcggggaaagcatgccggaatctggcccagaaaagaggggccgctgggggaagggtttggagatgacgcctcctcaggaactttaaaagaaatctgtccatctgtctctggcatttatggcatcgttgacagcagttcaaggaaaaataaaaataagttcttatctgattgcggggctgattgcaaagccgaaggactagagtggccagcgagtcgggcggctggatctggagttttggagaaagggccactggctcatttctgggcacgcacgctcacggaggcaagttctcacctcctcgtgggcttctcttcactttacgtggaaaaactgtgtacgtctcaaattaaaagcagctcttgccccgcttagagccggtgaaagctgcttcgaaggcgtttgtagagtagggattggaaatgttcaatgcaaaagttaaatcgtgacagttgtcccctaaatgatctgctaaattaaggatccgctaacatttgtgagtctacctccctgcattccccccacccccacccccgcccccttggcagaagggataaagatggtacctaaaaacaatgtgaagcggctgctaaatcgagtgactctaaaaacatttttctttccttgaagttcagtgtggaaaaccagactggacttgtcagggatgcagacctatatagggcccatgtgcctggcccctttcctcactttctagcacaatggttttcattgccacctctcccgcgcctttccccccttcataattatccactattttactttctgtgtcctgacagctacaagagtagtttttgtttttttgagctgagtagctgctaaatattccccagcagccagattcaacggctgggggggagaataggccaaaccttggcatcccctgttgcaaaagtgaaaaatatttctgtttgcagttaattttagtggcaagcagatcatgttaactggatgtaattgcttccagatatggccgagggttttgtgtgttgagatgaagggtctggtaagtgcttacttcctgtgtaaattagcctattccattcagtctttcattctggccagccctggattctgtcattctgctcccattttccccctccccagcctgcagcctggtgtgagaagccgcttgctatgttcctctaagtgtaattcttttgtcacttggagccactctcctcttggttcttgatgtgagtttgcccttaaataatgagaagggtttgaaaagatgccacctggaccccaggccacctcccgcctctttcccagcaaaggcagatctgaagagcatctcctggtcatgggggttgcatcttggaacccagaactccttgttttctatgcatttttttttcctactgccctctgacccccgactctcacctgggagaacaccttctctttctctcaattagtccgactcctcctcagcctgaactaagcacgttccagtgggtccgaaatctcagaaaaaatgaaacggctgttgcgcagaggagaaggttgtggccacagaaaggagttgcctcatcagacgtgaagccgccaccttgccttgcaaagcaggctgcacctcctgacacacctgcccctccctgcaagaaagggaggggaaatcccacccaagagaaccttctccaggttcctgtgggtttccagggttgcaactgaagaaaagtgttaagattcatgttctcctaaattctgcttttgtcctgtggccagtcccacattcttagtgctatttgcataagaggttgctgtttatcttcctatatcagccccactgataacccctgtggtctgtttaacaacctatgaggagtagattacttgataaatgccagtttttccaatatgcaaagataaactgttggggtcagggtgaggggtggtgtgttatgaaggaggggacaggtggggagccaggaccctcttttagtgggctggagaagtgtgaaagagcctgatgaaagaaaacaggtagcttgtcacatacaacagctgcatttatcatacggttgatcagcttcctgccctcacctacttttctcctccttcatgtggacatgcagagtctctgagaacatttcatcaagtgggttgcctatgcccacattaatacaagatgggaaagggtggaggttatctttgctttttaagttcccatctttttctcccttggtcctctcccacccctacaagttgttggctggtaagcaattgatgctcagaaaaatgatgttcatctgaaatcttaaatgagtggactttttctaccttccctgactttgcaggtgcttcttgaagagccaaggagaaaagaaaacttctgacctcatcacctagtcaataagctgtctgagaaacaaacaaaagagtttagactggctgctaaagctaggaacccagctgatagctttgttttgatgtccttgtaatgtttgcggatcgcagagggtgctatttagagcagggggcatctactgggacagactcactgggaagttgaaacagctagctcaaagtccaagagatgctaaagatagtgaaatacagcccaggaattgagggggagggggttcctcactcaagaaggagactttctaggagggggcgggcgtggtattttctagggacagtatggaatgaagggaagaaggttggctttagaaggaggcaccctgtgggaggctgagacaggtgggtcacctgaggtcaggagtttgagaccagcctggccaacatggtgaaacccagtctctactaaaaatacaaaaattagctgggtggcaggtgcctgtaatcccagctagtcgggggaggctgaggcaggaaaatcgcttgggattacaggtgcctgtaatcccagctagtcgggagaggctgaggcaggaaaattgcttgaaggaggcggaggttgcagtgagcccagatcctgccgttgcactccagcccaagactttgtctcattaaaaaaaaaaaaagaagaagaagaagaaggaggcaccctggatgaagactcaggctccagaatttactatctgtatgtcttgggcaagtggcttagcttctctgagcccctgtttacttttcttttgaaaatgaccaccttgtccatggtaatgaggataaaaaacgtgtaaagtgcatagcagagtgcaggtgtactgggtagacatgtatgattgcgctgtagccctgttatggcccggggagaaactatgaaaggaaccagtgaaatcttttgttttgggcactgctaaattgatgatagtactaaccctgtgctagcagccagccggtgaaataataggtgaataatgttagtacattgtgaatataaaagtttccatttgcaaagtgctactgctgttctaaagaagccacatttctaataaatgattgcttaatcctgtgatgctgccacagccccacagagtttgggaatgtttgggaattctttctgaagtgtgtgccgcattcttttgctttgccttttgggagggtagatgtgactattggaaatggtcaaaataatgcagtagcaaatctgttgactatagtgagtgataagcactgtcggctgctgtgtctgactcggaaggcagattctggaaggggtgtgtggggaaggcttgttggctcagcactggggtgagtgttggcctcacttcttaggtgggaagtggacaaggccaaggggcttttgatttccagctactatggctggactcccagtgaggaaggagtcgctgccatggattgcctgggactgggaagactccttttaactgctgtaatgtttctgcatttgtggtttggcctcctgtgagtttgggctccggggcggcacttctgttgttaaaagaacagaaaagaaaacaaaacaaaacaaaaaaccaggactgtcactgttagatgttggttgaggctagaaagaatggattgagttttgaccccctacaccccggggagtagggaggcctgggaggcacagtggcctgagtttgaattctgactctgcctctttggaaggctctggaaggttaaaggagcttgtgtgttcaaatcttagcctggtacctggcatatactcagcatgtattttttcccctttcctgacaatgttccttgccccgaacacttgaatagtggagagaggaatgtttgcttttcctctccattgaaccaacactcgcccatccactgagcccaagattcaccttaggattgtctgttggactcggctcttttgtgacctaacagtgcaggggccttgtgctgagctgcacatgctcgctctcgctggtgctccctctctctctctctctctctctgcattatttatagtaaaccatattagaacagagtgttaaagaggaaggatgagtcattcccattgaaaccattgatgacataaataaaagcaaaatgcttactatgtgttttgtgcagtatttaaggccaggttgtgctaatttgaatgctcccaaactggatctgtgaaagcatacatatgtgggaaaaaattcaggtttaactagagggaagttatttattgaaaatccatttcagtatctgctttctcccttctatttacttcagatccatattcatatcatgcttgttgttctggctaacgagagggactggcttattcactagctaaggtttgtttattttcggaaggttgaggaatagcacagagaggttgtctaagtgtccctgtctccattcctcctcttgccacctgttgaggaaggcactctccacctgctttgcaggcgtgggctctcaatgtgtccaagaatcacagtcagagctgaagggcccttggaatcatttattgcagcatgctcatttgggaggagtaagtggaggtccagagaggttctgtgattttccctaggtcacacagcaagctagaggcaaaaccaggaccctcactcccagcccactttaattcttccttcacaagcctgcctgtgactgcccaggtctgttctctgcttctaccaaggggtaggcaagactagaatctgacttgagagcagtttcagatctttgtctgtgagggatgctggggggtttctggcatggtgacttgcctcctgggacactcattaacctctctgctgctgagcctgagcagactaatgtacatcaactccttaggatttacagacaatgccctatgttgggggttttgagacccaaagattgctaagacatgggacttttccttgaagagcttatactttgagttaaaatatgtatgttgatatctatgacagagaataggaaatggaaagactatgatatatatattcagagttgaaatgacttctgtctggagtgattcattttaaattttaaaaccttgttgagcacttactgtctgctgggcacctgggtaggccctgggaatactgtgatgagcaagatagacaagacgtctaccctcctggggctttcctaatggggaagaaagatccttacttagctagcagtcctgtccgtaactgtgtaagggtgattttgatacatgttgggagcctggatgaagtagcacatgagtaggatattaaaggataagtaggttttgaagacggggacagaaagaaggaaaattgtggtcagggccaggggagaaaacaaggagtaactttctttggcaggaatgagggtgattcatgctggaatggtaggctggggtcagactgtggtgctataaatgcggggagagagattagagaaggcagcatgaagaatggagagaaaatgagtttgaagttgagcagacccgggttcagattttcatgctgccacttgcaaactgtgtgatgttggccatcaaggactgtgaactggctgggtgcagtggctcacacctgtcatcccagtgctttgggaggccaaggcaggaggattgcgtgaggccagaagtttgagactggcttgggcaatatagcgagacgatctttccaaaaaaaaaaaaaaaaaattaaaaatgcagctgtgcatgcccataatcccagcttctcgggtggctgaagagggaggatggcttgaacttataagttcaaggctgtggtgagctatgatcacgccactgcactccagcctgggcaacaaagtgagaccctatctctatttcaacacaacaacaacaacaacagcaacacacaccatgaactgtagcttcttcattcctacagtgcagttattgtgtgggatagcctgaggatttggggtagtgtacttaacacactctgcacagtgcctgtaacagtgtagttgctcaataaatataactgctgtttgttttaactgctgtttctttttggactttatcccgggagagttggagccttggaaggcatttgaaaaggagagtgacgtgactggagtgctccatactgatgtgacatccactaggcatgtgtctgactgccccctgctccttccctgccttcacgagcctgtctgaaaaggagtttagtgcgtgatcatcagctcctaaggagacctctcccctgtatcttgtacctggcactctaccaagatttgatgaaaggacatgaaatggacccttgccacctctcggtgggcggggaagctgggagaggggcctggggagagggggtcttcagctgtcaggatcaaaggaagtgacactctgaagctggtctgccggactgttacccgtctctctaactctcttttaatagaaacccagtctcccctcttgcctccctgatagtgaacagcgacgctatctcccgcgggccagtctcggctgtggtcgtagcactacgcaatgtctgcaaaccgacagtggcatggggagataagggccccaacgttgtgtaacgaggggcatgggctgtttgcccgagtggctcctggcccctgggtaactgctaacctcaacggaggagcgggccggccttggaaacgccgttccagggcccctcgctggttccacggatgcctttttgtggttggataaaggaagctcatgtaggccgcccacagcgcagcatggccttgggctacgggtgtttggttgttttgtttttctcttttctttgtcttttttaaaaaaagaagttgaaagggggatagtcttgcttggcacctaccacctttaacccaaaaccaaataaaacaaacagttcctaaatataaattaaacttcaacctgcagtatagacatcctccttccctgcccgaaacccactggccactggaggctagctttaagaaattggttttggagactctggcttgaaaaggagccatgcccacttgtctcacgtcccagtcgctggctccagggggccgtggtagaacatatattgtacttcagctgcctttcccctccaagcttcctcagccacccacagccctttcagatgagctgagccctagcactgtgccctctcccctctgccctcttagggtgatagaatccactaccctgacatctggggttgccctgttctgctgtggtgggagatgggctggaagggacttcggaggctctcccgtgttctgtaccacccagcttccccttggatccctccacccccgcagccaggagagggaagtaactgttctttgagcaggacatttcattttcaaagtattcttgatgccgcccccccgccccaccgccaagaattctgctctgtgggtgatacttataaggtaactatatggcttccttatttaggcagcagtttctcttctatgattttagttcctctcatgattcttataaccctctctcagatacttccaggatgataaatcttctatcactgtttcatctgatcacatcagggtgattatatttcgtgacataaccaggtggctttaatccgttggtggaagaaccaggctctcacctccattgtttaagatgttatgtttctactaatctgtccactgagtgtctccatcctattgtttccattgcatgctctcaggttatttcctttgttcttggctgtctgattgctcccagaggctgcagttattttattttatttatttcattttttggtggcagtaggggattgatctctctcttgcctttagcttgaatgggtggtcatttccaggcttacacattgctccatgcccactgtaggggtctggcttagagatggtcgggggagagaaggtggtgatttaaaagatttggaggcggtggcttacattgattttagcttatctaaccctttagctagaggctgctcttccctcagagtgtccaactagctgtaacttaaagcaacagagaaatgtatatcatcccttttcttgcattaattagggctgagaaattcattatttagagggataagagctccggaggaggagggttttttgaactaatgtagagatctgtggccagctgtgtgattctcaggtagcaggtgagcgggtgggggttgatgagaggggtgagaaggagcaggtgccagggtcaggcaggggagggagcccccactccgtgcatcatcccagagccctgttcctccaagcccagattagacacccttctccacgtggggcctcaagttagaaatcctgggaggaggccttattgctcaggatcatctgggaatgttgctttctgggtttaaaatacagtcaatgtttagatgagctgctgttcaggcacatggtctggttagcaaagggttaaatcctgcatcccgtttttagtcatcaagctagctcagatctgcccaccttggagccctgtgctttcctgccttagtgggcagagtctaggggacctgtggcatgttcaatgattgaggactcttgtccagattccaaaaacctactgtgatgatgctgttctgaagctgtggtaggcggtgattgagtggagtgtgtagtgaccctcaggaattcttcagaagttaggattttgacgatacctctgataagttgggtttttaatttgctggtttatcttagagtggaggctgtggcccacagcaagtagtacattttccatctcagcccagtgcatggacaaacgtacctcaaaccaaaggttcaatgaagctctatttatctttactatatgctctggtatcttctcttccattctatcttatttcatttaagaacgttaatgaagacccactaatggattgccacccatggttcgaggaggtcccccaaacagtgaggccttagccataggtattcaattcaaaaagcatttactgagcatcactgtgtactaggtggttgctaaatgctatgggggtaatgcagagaaattaataaatccctgtaagagttcactgtaaaacagaaatgacagccatatgtgtatgactttgtgtgtgtgtgtatatatatatatcagactgtatgattaaatattatataagtgaggtatgggggagcagaggagaggaattgaattttgaattttgattgaagattcaggagggcttcatggaggaggtagcatttggccaggttttagagaatggctaggctttggacaagtggagacaggaactgccatttggaggtaggagatgagctaatgtgtggcagtgtatgggtgggggcaggtgcctgtatacaaggtagtgtgctggaatggggcgatgggcatggggtaggatgggagatcaagcagggaaagtggattggggccaggtcctagaatgatttgaataccaagctagctttctggacatttgtaaggcgcacttgataggggttggatcattgcgatattattggaagacaaaactggggagggtgtgagaccatgtggctgctcagaatgcagagcccctctgatgtcctcagccttctacgtatttagtgatgggggtggtggtggtaaagagccttgcagacagcctggcttgggtgcttgcttgaagttcttacgcccactaactcctgccctgctctgtggagcctgctgaatggggcattaggctagtcacacacctgtcctttttcacattcatgctgtaccctttgcaaacattacgcagcagtgcaaactcagccctgggcctcagaggagccaggcgtggccaggagagtgggatttggaacggaagtgcttttgtttttggcattcactactcccccacccccactggcacttggattgtccttctttttctccttggtgtctctcatcctgtccagccttcaagacctcctcaagtcaggcttctctgggaagcgctgtctgtctgtcttggtgcttgctggcttcctcttctgtctcctgtgccatctccagtttgcaccatttgagtataagctctgctgcctcatttgagtttaagttttatccccccagccacaacctaagttccatgaggatagtgattgtggtttatcttctctccctcagctgtctgctgacaccatgctgaatacatagtaggtactcagtaaataatagctaattgagcatttactatggacaaagcactttacttgcattaacacatcccatcctcacaaccacctgtgaggtgaatcctattaaaaggaatacttgggtgctttcagagttattctctccagctttggacttcttgtttcatttgccctgagagctcctcaactctgttgatgctgttctttcaaaggttgcttgtgacctcttagttctcaagagcactgtattaggttggtgcaaaagtaattgctattttagacattactttcaatggcaaaaactgcaattacttttgcgccaactaatactttcccagactccagtattggctccattgacccctcctgttcctgccaacttctccccctcctcctctggtatttcctggaactccctccctagggtcagtgccatgtggtgcctggaactccctgggatctgtgtttgaatcctgacattgccactttctaagtggcaaacactttggccacctccccctcttcctgagtctgtttcatcatctgcaaaatgctggtagtttctcttctcacaggaaagatggtggttgttcatcgatgtctgttgaaaccgtgaccctctctgctgaatgtagaagaagatgaccttaccagttctcctgtctctccagtgtctttcttgacaatcttgtggtttccacaagcaaccctctgtgggtgatttccagatctctacctctagttgtttttcgttttttgtcttttcttgtgtttcacacattcttttccagtagcctcacgggcacaccagtcctgcaaggatctagaatgtgatgtgtttgagctagttcaacaccttcctctcgaatcgtctcctgtgtcctcatgttttgtggtctctgccctcttcccaggcacccaactgcagactttggcatcatctgtggctcctgtcttccctttgccttccatatccaccatttgcctctccagcctacttaaccagatggctgtcctgatttcctcaccagccttcctgcagtgcacccctgcaaggctcatcaccccacttccctgagcagagtagggctctgatggggttgctctcctgctctgaaccctgcagtggctcactatggcctattctagagaagaaacgagagaattcttagcgtggcattcaaagccatccgggatcctagattccagctacattttcactcttcatccctttctctgcatatttcttagaatgtacacccctgaaggcagggaccatctttttcacatctgtgttacaaccttttagtccactctctagcatatggcaactcagcagatgctgctgttgagtaaactcttatgcttcccttcccatgccatatccttctctggtcatcgcaacagggccaaatctctcatgcttcagtgtaaatgccctctccttgcagcatcctttcctggggcattcttcctccttgcatccagttggaaataatatgtccctccattggagctcccacaccagaagaggtatagataaagccagatacttctttttttttttttttttttgatacagagtctcactctgttgcccaggctggagtgtagtggcatgaacttggctcactgcagcctctgcctcttgggttcaagtgattcttgtgtctcagcctcccgagtagctgagattacagacatgcgctaccatgcctggctaatttttgtatttttagtagagatgcggtttcaccatgctggccaggctggtccccaactcctcgcctcaagtgatcttcctgccttagcctcccagagtgctaggattacaggtgtgagtcactgtgcccggcctggatcttttattgtttgtatttctgttcatttcttccctaagaaaccccacgtttttgtgggcaggacctggaatcctattcagttatacagccccgcttcgtccactgctccccttcagagtctagtgccctggacatcataggtattcagtacctcttgctggcttaggaacaggaggatgcctgatggccagggtgttcctctgaagcaggggtggctgagctttttgaatatctgcattgtgctaagggttaactacccaggcagtactggtggggaagggccccagaagcaggcccagactcaggtattgttaaagcagagtcatctttgctctgaagttttttcttttatcttttcttttcttttttaattgggggaaaccttgtcctaattggcatctttattgtggcaggaataggccaggcagggctgggggagtgtgaagtctgtgaagggaggtggcctgggggcccccccacacaatgcctgattgtgcaggcataggtatgaacacattgcagcctgtgtgcacccacagggtgaccacgagcaaggcctggggacgaggactacgaggcctgcagctgggtcctcttttctccctcctcacccccacccagtacccacgtgattgggccacatcccagtaacaagcagtccttgtggaagagccttcatgaagacctttgctgggagtggcgggcagggatctgcggggagcgttgctggttcaagctggggctttcctatggatgatgtcctgtgaagggtagatcctggagggacagacaggtgtctgatctttggcaggcagggatgtctcatttgtacattataggtattcagtatctcttgctggcttaggcttcataatgtctcatttgtacatcatagccttcagtacctcttgctgatttggttaacccagttgttataccacgatattgatttttcatgccattttctttaggaagattggaagatcattgaggatagggactgtgaccttttctttttttctaccccagtacccaacctggcaggtagcacagcgcaatgatccacgatgtttaataggttgaattgtagagggggcctctgattccaaagatgggggcagaatatcagtcctctccagactgcctgggaatcctcctctctccagcctgggcctggccagtgggagacagaggctgctgaagtagctggcaaggaggcaaagaagatgatgacctagctacggtcctcatgtgcccactggggaatcatctttttgcatctgagttagtcaatgtgctgtgcattctctgcagaatttgtgaacctggtataggtatgaggtgagagaggccaggaggtctggctgctccccctctagacttcgcaggtaaaacccaaggtgtgtgccacgtaaaggttcagaggttttataggcatccagatagcacatgtgggtctctgcccctgcttgcagcctccctggggcagccagccaggctcagggcaggaagctgctgattctgggtcacttggctgctcttgcttgctgctgctgtgattgttcctacagttaagatcttagctccataagggacatacggaggtcatctaggtcatctcatggctctcaggcaagaaaagtagcattattgctctcatgcccactttatggataagtgaccgaggcctgcagaggcagagtggctattccagccattaaatgtggctccctgctattctgttccctgccaggatattctgtggatggttaggggaggggtcttacctcagctaacgaggtgcattttctgtggggtgaggccattcttgtcacttaggtgtctgaggcctgatggtgttggggaatgtcctggttctattcccagggctgtaacgtgggggaaggatggaggaagacagaatggcctctggaacttttggatctttctgagttgaggccttgtctggccaactccgggaggctgctggcatggcaagcagggtagggatgcctggcctagccaggggagctccctctctcccctctgctgcccctctttccacccccatcataaacacgtgtggactttctggtggtgagaagatggttttggagggctgggctgaggtctaggcaggcaagagcttccaaatgtgtggctttgattctcagccttttcatccctcaatcctgggagactcattttaaaacttaaaaaaggacttcattctattggatgctatgtgggcaggccctgggctgttgtagagaggcctgaaacccacttcagtttcctggacaggctgggagtgtgtacccatgggttccctgctgccctattcctggaagacactaatatccctcccaaactcttggttggtttctgctttttttctgtagcattttgtctttgtgggaaattttaagaaacatatgtatggctttttggtttccacttatttattttcccctctgagtttcagatttcatccttctccaccccttccccctgccctaaggtggggctagtgcaaatcgcagtgtgtgtgtagtgggatggttaaagagccgtacatcctcacacctggtgacgcagactaaggcaattaaccttctttagtaaagaccctttcagctgggtgcggtgggaggcacttcgggaggccgaggtggaaggattgcttgagccctggagttggagaccagcttgggcagcatggtgaaaccacctctctaaaaaaatataaaaattaacgggacgttgtggcatgcacctatagtcccagctacttgggaggctggggcgcgagaagtgcttgaacctgagagatggagactgcggtgaggcgagattgcaccactgcacttcagctaggtgacagagtgggaccctgtctcaaaacaaaacaaaacaacaacaaaaaaagcatgttttcctgtctttcccttcctctcctccaccccctggcatgaactctcaactcttagcctgtggatgtccgtttctataaatgctggtgctcggtggtcaccgtagacgtccgagcagcccctggggctttggcttgtgttttctctgtacttgtgagggtggttgccacttctggccttctttgtgctttctttttctttcctttccccaatcttttgttcctccctccctccctccctcccttcctcccttccttccttctgctttcctgtttaaagtatatggctgcacctagcatgacacagttcctatttattcctcagacttgctgggacagtctcctctgtatgcggcgactgagggtgggttccagtgccccagcccactccccttccccttgtttttgtccacttggctggacaaagagaacaaaaccaaatggcctcccctccccctctcctaaaccggtcaagcagtggtattctgggatgattttccctgcaaccatttaaacaagtgctttgatgcttacgagtcattggaatgaccaggcctgtgcgccccttctcactgacacccttagaccaggctgggcctcacccttttgtcttgctgcccctcggtgcccagtgggcgtgggcagtaggactgagcagaggggccgaggctgtgctggccggcagctctgttacagtagagtggaaggaggtcccggccagaggggcaggtcaaacaggcctcttttatttacagtgctctctttcacggcctcactgaaacaggagacccgagaggctccggtgaaagggcactgtgtttgtgcattcaggccttccagggctggctacaaaggtgggggcacccggagcactgaaggggctttttgtcattggcagtttggcttaggggagaagcgagggagagccagtgtgggagccgcctctaggattgtgagcaagtgcctgtttagacagctccacgctgctccttaaaacctattttgtggtctggggttggggcgggggcacactgcctcgatcctcttgttgtgtggagcaaagtgattcctctcttcttgtgttctccagatggttccgttgtcctcacatccattgtggttgaggatacagtgcagagaagaccccgctgtcctctgctccccctccttttctctccaaagagaagtttcagggacagcaatagacttctgtggggcctttgttccttgtagctttcatttttcaattcttcttctccctgtattatcttgctaggccttagtttgtgcatctctaaaatgggctgggaggtgctagcccatacctaatatatagggccgtcgtaaggcttaggtcccataactcatggggttggcttgcacagggctctctcctttcagactggtcaggccatggtccttttatgagtctgaagagccaaaatgaagacctcactttctagtatccccaatcttcctcccacctttccctggctcttgagggttctttgggcatgttcccctctggtctccattattatatagggaagagaaattttccagaagaatatttgaaggattaaagtttgaggttgtagaatatgtgaaaacacacacacaccacaccacaccccaaaatcacccttttaaagaagattaaaaaaccaccagtgcctgtcctacattggtaaactctggcaagcctcataatgttgactttactgacctgcctgacttcagtggccgagtctacatggggtgttaaggccccacgtgtttttgcctgtgccctttaattgtatcttcaggaccatattttcagaaccagaaatcacagccacagtttggcagtggcacagaatggttcaatttaggcctatcccagagaggcttgggttgtctgtgaagttctgggtggtctgtattgtggagaggtgaacaccgtattgctgggggtgtggaggggggatgttgctgtttccctgctacagaaaggccaggcttccttttcagccttttgttccccgattcccctctcttcctccactacactcagccctgctgctgcttccaagggacaactccctctcttgtccttgcccatctttgagagaggcggtgaataaacaccaaggcaagaagaagcaacgggacccctagaaggagatgagtgtgtggcccaaggatggtggagcattgtcctgaaaggtagaaccaagactatagcctccgaggctctgtttaccatattcttggctcttgtgccacttctgtgtccagcagctggagcttgtagaagaaagatgggaaagacatagtacaggaaatgttcccattcagccagcactgatttatctgctgcctggtttctcaggaggcctaatctgtaagaacagtcgagaactttatttctgccctttaacctatgtccattttctagatagtttctaaaaaaggcatcacaccagctctttgagacaacatgtcatatgcaactgttggttttgggtggaatgaaactgaattgtcaacggacattttttctttctgtattcatgtgtttggaatagtgacaacgtcattggttcagactttgagcccccttctggttaggctcttcagtataagcccttaaaaatatttttgacttttcagggccaggcgcggtggctcacgcctgtaatcccagcactttgggaggccgaggcaggtggatcacgaggtcaggagatcgagaccatcctggctaacacggtgaaagcccgtctctactaaaaatacaaaaaattagccaggtgtggtggcgggcgcctgtagtcccagctactcgagaggctgaggctggagaatggcgtgaacccggaggcagagtttgcagtgagctgaggttgtgccactgcactccagcctgggagacagagcaagactccgtctcaaaaaaataaaaaataaaaaacattaaaaaattgactttttgagtaaaacaaaaaccaaacgagtccgtgtaaagtctaagatgttggttcatctcaacattgggatattggaataggccactttggaaggtttctctaattgatgaagggcatgggccaccccatggattgcaatgctgtggctgtttgggtggcatccagcttctaggggatggtggcaaacttgggtgtgcaggcagtaggaaggaggaggtagcttccagagagagccattgctggggctcaagaagtttctttctgggctcaagcatggttgctagtggtccacacagtgctttcgtgtgaattagaaaaagcacccttgttgtggatggatgtggctcttaactagggtctatcccacagtgagctggttggggctggatctcaaacctctttgcccctcaatcagaggcaggaggtccctggcccaaggggcttccatggttggagtggtcgtcagccgaaagctgttctggtgagatgttttgagctatcagttccaagtttccaaaggccaaggcctctgggatcagtttcactgatccttcaaccagcttatgtgccctgttagcccagatacccctccagagtgcttcgcactgggctgcaggtcactgtggccccacaccatagaagctgggggcctgtctgcatgttctggcatccataaagctgcctgcaaacgtgagagggggtttatggcacccttttagcatgactgtctcttgtgaccaaggccaagaaaaatagcacaaagatgtaggagtggtgaggaatgaagatgcacgtgcacgcgccctgcagtctcagtcaatgcgctctttagggtttagtttggaaaaccacagtgtcgtgtcttatgtaaccaatttcttttcttttcttttcttttctttttttttttttttttttttgtgatggagtctcgtgtcttgctctgtcacccaggctggagtgcagtggctcgatctcggctcactgcaacctccgcctcccaggttcaagcgactatcctgcctcagcctcctgagtagctgggactacaggcgcccgccaccacgcccagctaattttttgtatatttagtagagacggggtttcaccgtgttagccaggatggtcacaatctcctgacctcgtggtccgcccgccttggcctcccacagtgctgggattacaggcgtgagccaccacgcccggccaccaatttcttatacataggttatggagcagggagaaagagacatgcaaacaaggcagaattgggacctttgcaagaagaccttcttcactcgcccactttctcatacttttagtcaccaaggcagggtctttttaaacaacttcgaggctcaggcctagggggttaggagagtaaaccctaaatccctttcaccctagcatgcttgggtgccgtgttgacaaggtctctgaagtgcccatgggaagcagaccaggctctgagaataatttccatggaattaattattgttcttactccaatagatttgaaatctatttaacttttcagggtcccctagctttttaaatgtttcaagtgtattctctctgataggttgccttttctctccctgtaggctataattagtgtcctttacacaaaattggcttagaattggatttagagaagataagaatcaaattaccagtatttatcttgtaaattccaaaagatctacttaagacactgtattaaaaaaggagtataaaagaaaagtttattctatgaaaaagtaaattcctcatggtctgagcaaccaggggtattttaatatcaaatctccagacttcccttggaggcacctaaaattgccttttcccttgtcgctcgtttttatctccagttgagcttctgaaatatgttgccaggctttggatattggagagctggtgtggtttcagctttcattaaaattcggaggttttgacttatctattatttctgatttgtggtaagacataagcctctaaaatatgctatcttaaagagatacacacaaattttatcttagcatgttaagtttttaagccgttgagagatggcagaatagacctctgtggtctcctgtgtgcttcttcgtcctaaaatgtcagcatgctggttttcatgtgctgcctcgtacagtaagtccccagcagatttaaataaggttgtgtcaaaacatatgcctatgttttttttaacatcgttgtctcataagtgtgcagtaatggcatattgagactgttcatagactggtcagctgcatttcctgcagccgaggaaccctttattaaggtgcatttctggggttgaactaaaactgctcacccccatcaaatgaggaaacttgaggggtttgcagcccagcattttacgggcacttttgcgactgtgtacccttgcgtggcttcccgcttcagcgacattgttgacttcagttttctaatctaattctttttttcttttttggttttgatgagagtgttggataccaaagcacaaacgatggattccttttgaaagaacaaaaacatattttgtgagcagttttacttctgggagtgttatgtgtatacacacacacacacacaccctaaataattgaaagcaggaacttgaacagatatttgcacacccatgttcatagcagcattagccaaaatagccaaaaggtggaaataattcaaatgttcattgacccatggataaattgacaaaatgtggtatatacatatagtggaatattattcagccttaacaaggaaggaaattctgacacatggtacaacacagattaactttgagggcattatactaggtgaaataagctagatagcaaaggacagatagtgtatggtgccatctatatgaggcatctgtgcttatataaagcaaatttgtagaaacacgaactagaatagatgttgccaggagctggggagagaggggaatggggagttaaggttgagtgggtacagagtttcagttgggggagatgaaaaagttctgtggctggatggtagtaatggttacacaacatcaggagtgtactaaatgacactgatctgtacacttagaatctttaaaatggtaaattttagttacatagttttactacaataaaaatgtattttatgttaattgcaatacttggcatttgagaaaaaattcttagaaaatactgagaatatcatactgataaaaaccctctgctaaattttttttaaaaaaaacacacatcgcctgtactcctgagtatcagcgatcagtctagcgttgccctttaactatcattattgttattgttaaagtgatttttattaagtgctatctctcaagtggtatgattacttgttgaggtcttgtgttggtatttgtcatgtgattctagaaaaatctccccctttttggctctgagacattctctagttgacctcttcccagagagaagttaaggaaaatcttccgctctgatttttttttctttctgcacttaaataattaaataatatctgtggccttacaacacagggaggtttcagtgaggaagaaaattcaactgcatttgcaaaatgtctgaaaattatgggagagatgtttctgcttttagacttggtacgtatgtggtcaggttttcagaggttttctattcaccatctgtgacgggccttgtctcctcctgcaactggtggcagatgtagccagagattttgtgagcttctcaacagcatctttttcctgctcttcttcccttcctctttgtttggtttttattcacatgaaaatttaaagacccataaggaaattcaaagtgaaaatctatgcccaaataagtcaggatctcaagatgaaaatataagttctggaaatggaagtttcctctgcccccgtggtggtatcatagccagcagcctcgttctgtgcttttgaaggtttaatggcctgcatgtgaaggtaggggcgcactatatatatagtaccaggcgtgtgggcgcactggcacggatctgaaaaagcgtaagtttggcatttctaggtttattttaaacttacaacctttaacgccagacacagagcttctttcccacttaatgtaactatacattgattgcttttaattagtgttggatcttttttggtgttttgcagcttgggatatataaaaagtctgacttaaattaaaaaaaaaaaaaagctaactcctgacattctcacgagtcttgcaaaaaccagcacgggagccttagaaattctaacctcctcgtcctctttatttttatcttgagtcaggtgggccaagaagcaagggaagagtccaatataacatacttaatggatggaggtaatttccttggactgttttggcagaaattaagcatctgtatttagataaaggtagtggtgggttggattttcatagcataagcatagttgctgaagatcaataatatcaaataatgggttcttggtgagggggaaaggaaatgggggaggggtcttttcactcaacagtttggaaatgctaatgattatttgtggttttcagcccagaattcttcatatttgcttgcaagcttctatggcactgccgaattctacagtaaatatttcggacatcctcagccctgttctcctttcccttcagtaaattacatattaaagtagcctggtaactgagcactggttgctgtgagataagggctgggaaatcaatatgtttgccatgtggctgcttgtttatgacacctgcctctagaacagttgagcaatgttctgtttgttaaagctgcatttcagaagcttgtatcctcctaaaacaaccgtgatcttactgggggagagagaggtgctacaacagatattgattttagtttttctaagtatggaattacacttctaaacagtggtcttacagcctgtgattttttccccatgaggaggagatgtagatactctgaatatatatatacacatacacacatatataaaataaatctattttataatgtttatgatgtggtcagttaaaaaaggagtgtagtttataataaggaagtgtaggtattatttagatttatctcctctcttggcacctggcttaaaaaaaaaaaaagtagtaacaagaaacatagcagctgctgggaaacatgcattttaatctaagtctccagtgtggttttagtttaaccagtggatgatactgtagtctcaaggcttagcctgctggtgagtcaatggttcttaaagctgtgtggtgtcagctcaagtgagcgaagcagtgtgtggtgtgtgtgcattggagggtgaggggtatgaggaggtagtcagccttggagggagaagggagacaggctaggtcttcttcacgtggccttccattttggaaaacagaagcgatgatacaacttctcttcttgcccaagggattcagtagaaaaaaatacatttccaaacacattgcgctacagtcattgaacttcaaagtgtaaagcatggattgtgttggtgcacttgtgggtgcccatgacacacactcttcaatgctcctgtgccttcctaagaggtgtctgtctttctcaaccccagtgtgtgtcctctgacgtctagtggattgctgcatacacagtcaaccctccttaaaaggtttaaaaagaaacatgagctcccttttagagcaccccaaagcagctgcattcttgagttggtgccctgcactgggattcccatggactgggaacatgatctcttaatgacactaatatattctgagatctgattttttgtttgtgtgttttttaacccaggttggcaggttctccttaatcagtagtggcaaaatgtctctttcctttctccacgtaatgctaaatggcttatccagtcatctctctctgctcatggtcagcccgaggtgacagttaaaattggatggaggtagcttggggtaggaagacttggtgattttggcggcactgggtcaaacccagggaaactgaagctgtgtctgcacagctggttgaaaggctgtgttgtgatccagggatttaagtaaaaatattctttccttaccaccctctatgccccctactccccagtaatatagtaggcatgggggttgacttattttgaggggactagtatgtatttaatatttcatctaatttttgtagccctggcctggctggatgacaaaagtgtttaaactaagaccgatttgagcaagtattttatcctccctctcgggagactatgggcatagaacggtgtggggatttggaggtgctggcaagtctggcccctttcctcttgcgtttactcaggcacagatggaaaaagatgaaactcaatgaggacccttttgtgagatgcggcacatttcgctttgtggaattattaaccttttataagactgggatacttacaaacttaccgcaggaccagacagtgactatcagaatcctctcttctaaagatcagcgatctacagctttcgcaaaacttaaggctgacttgggaatctagacagcccctagtatggtgagtgaccctagagtggtttttaatgaggagatactcacgggagccagcatctcgggggtccccggggggttcatggccaggagcgttgcaagctggtttgtttgtttgtttgttttgagacagggtcttactctgttgctcaggctggagtgcagtggcataatctcggctcactgcaaccttgcttgctctccctggctcaagcaattctcccacattagcctcccaagtagctgggattacaggtgtatgccaccacagcctgctaatttttaagttttttgtagagatgaggtttcactgcattgcctaggctgatcttgaactcctgggctcaaacaatcttccctccttgtcctcttaaagtgctgggattacaggtgtgagccacagcgcgaggccttgtttggtgtttttgtttgtttgtttgtttgttttatggatcattacctataaagtaatttagaatacccactcatttatgatccagccttccctgcattttctagcgttgaggtcctttggggccatagaagtatgtttttccaagactgattgcttcgtgtatttaaccaggttttttgtgaagggtttgatataaactgagtgactgaagagaggaacatggtgtgatttggtagaaagatctgtaattttggagtcaagactggcctagatggacagcttggccacttttaaaattttgtgtccttagccccataaacattttgagattcagttttctctcctgtgaattggggacgatattgcctaacttgtaaggttcttgcaaagatcaaatgaaaaaatacacatagatctcctggctattattggagtgcccagtaaatgctagttgccttatcctccattttctttttgagagctgaagacctgattttatttccttgcatttttcatgtcattgcctatagggagatacattcatatatttgttgctcatttttgtatgtgttacagtggtgataaagaaactgatggtatcccagatggggaggggcaggtaaggttttatcagtggcttttaatttctttatgaaattggatgtggctctagggaatagatgtctctgggatggtcatgttttcccttgccttttggctcctgcaatgaggacctctttctgttggtgtgggtcttgtctgagcatgccagggatggcagtgaacacatcgatggtggttgggacgtcctcattcccagacctctgggacatactaattcccagacctctgaaacatgggtctcagctgctttgccctgcagacttgttctcagtagctatttacctttaggagaaaaaaaaaatccttaaccaaatgctttaggaaggctttcttatcgtggctgtaaggtgctggtgggttgttggcagccaagtttgggtttaaatctcactgggggttgaggctgctgaactgctattcctaacatgctcttgtgtttttatgcatagaccgtcttctggatccttggtgagttttttttactctggggttttcaggagaaaggtttgtcattcatcatcactcttctccttcatcacagcagtggtaacagtggttagagggaggaggtagaatcagttgttcaagttcttttttcttccaggtaagtcccccccaccccccggctgcccctgcccttccgcattttctgggaagtgaatctattgggaaatgcatgggcctgtgtttctgggatgattttagcatatgtagtaagaggggtgctttttgctgatagcccaggcgttggtcctgtaatcctgaggtgtggtttaataagagctgaacagtcatttaattatttattgggtgcctggagaattttataggcaggagagcctagagctattccagaaaaaaggccaatcctagagctttttgtgtggctttcttcttgggcttgaagtttttgatgctcgccaacattcatagtagcccccaatgccacccacacattgggaagggacaatagagccagctaaagctctttctttgtgtgtgcccatattaacccatctagtcaaatgtgggtacccttccaaaccattatgtcttgttcctctcggctgctgggaacattaaaagaaccttatttgaaggcaaacattactgtatcagtgatgctgaaactggaggtctgtcaatggcacttcattgcattgataattgtttctgctttgaaccacaacactgtgattattgaggttcgactgtaagggctgagggagccttgaggccattgaaagcattctcctgcctttaggccaggcctatgttataagtgagagacaggtgtggagtgtgcagggagggaattaagatagatggtgacctggaattcagaaggtggacccccaccaccccccagcctgagaccaaagcacagtttaactctgtcatgggtcatgtgcagagggaagggactgccccagaattagcagttggctgaacaccctgcttaaaaactttttcttttcctttttttgtgagtaccgtccgcttggactaaagaagttttggtcgttgttttcttaattttgggctacagagtctctacctacatttgtgttttgtgttttggtaaccacatgtaacagccggtggaatcttttttctctttgctttctctgaactttccaaagagtaggcccctatctctcgggggattaactcctcgtggcccctgggtcgttggtgctcccccaccctgtgtcagcatctaaacctctgcacacaggatgttttctctagcgcttatcagatgctttagaagatgcggggtggagatagaggtaacgtttaacccatcctggattcctttcatgaactcagccacagagcagagggaggcttggctggagcaaacaatgttgggccttctatttcaaacagaggtgtgggggcttgtggtggcatcagtggtgcactgaacaaccctccctgaccctagcgtgtgggtttggagcctggggaatcaaagagaaatctaacaaactattctttttcacgtgtgggctgaatgaatgtgtgggttatccacatcagtttcttctctcttctcatcctccctccttcctcgcagaccagcattttggccagggtgcccagtttgagctcatttaccaaaggtgaatagggaagggagtagaaaccaaattaggcacctgtctgacaacacaaggatcttttctacaatggtgcatttggattatgcagagttttagattttctgttttatcccagggtgaacgtgtgtagaaaactgggacctaaccatgttcttctcttcagtcttatggtcattgctactttgaaggcagaaaggataaaagtagcatagggagtggtttaccataactgcaagtaaataccaagcatgtgcgagcctgtagacattgcctgctattggggaaagacggagttagctggggaaatacatcagtcttcactcccagcacccaagatgtaaacatttcttactcttcctggatcaggctatctctgctttgccttttctttcacctacctccttctttcatggcaggaagggaaagggaagtacccccaagcagccagcagtcagcactggggcctctagggaagagtggattggtgttgttttgctgtggtttgctgtgcgttttccagaatctctcttggatgactatcagattcagtgaagggatggacctgcaggaagctgagagataggagatcctgtggcctgggaacccagaggcctgggccctgggaacaactcaccacaggactcagcctgcgaaataggaaacatcattgtagcttctgcatcatgttttccatgttccactggaaaaccatctgttaaatggacatagaccaattcttgcttttcttctttctggtaccaaagagaacggtggtgtctcttgtcatctagatgttcttgtaggggcaccagagtcattgcaaccattttgagtaaagattgagtccactggggcatcagaaggggagtgtgtcattgctgttgttaccacacaggccgtggtacttgccttttcctgacccattttgcagagcaggccagctacttaacccctcgccacccactcacctgtggaaggcacatttgcaaaacaatagaccagttggtaatttggcacttgttaggtagacatagtggtacattgaggaagttcctcctgttaactaacctagtttttcttgctgtaatccgaatatacttctctgattttttgaaaaagcctgtgagtggagcctggctcgacagcccaaaacgctgaattaattctgtctctctctctctctcttttttttttttgagacgtggagtctcgctctgtcacccaggctggaatgcgctggcacgatctcggctcactgcaacttccacctcctgggtccaagcaattctcctgcctcagcctcccaagtagctgggactacaggcattgccactacgcccagctaatttttgtatttttaatagagacggggtttcgccgtgttggccaggctggtctcaaactcctgatctcaggtgatccaccagccttggcatcccaaaatgctgggactgcaggaatgagccaccgcgcccgacccaattctcttgagtgacatgctgagtggggctgctttttggtggaggtaacaaaaaaagagttgaggtattgattttagtttcatttgagacagcgatctgtcccctccctgagttccctcgtttgtttgtaaactgcttaaatgaactttttcccctgttcctccatcactctgctgttctcttctcctcctcttatcctaacagtctcataggtaaacttagaaggaagacaaatacttacaaattgtcaccgagggtaccataaaagagacatttggacagtagttctggggagatccttgtctttgcttcatgttaatacagagggattggggtagcccagatcaccaggggaaagtggtttttcttcatttagcttttaattgctttctttcacttttatgtataaaagattgtccatttaattaactcaagaatgcaatttcaaaaacactaatgctttacacatgacggcttttaaaataaaagtagcattctaatattgcataatgcttttctatccccttcctctccccgcgttcacccccacccctccagactgtattaacctttcatagcggagggttgttaggaggaaaacgctgttctggatggtgcctctctgcctctccttcccaccaaccaagtacagcagcacgacagccgcaggcctttctgaagtgttccgtagcttctgtaagaaagagactactcatcccttcccccttggccggtttcatgcctatatttaccctcttttgggggtcactgtggctcctactcccattgctgccttttaagaagcatcattatgatggattacatgggaaaattaaaaagaaaataaaaccccaacatttagctctggtttcttttgaataatttcattagaagaaacttgtatacattggtctatgatttcacgatcttcttttttttttttttttgagacagagtcttgctctggcacccaggcttgaatgcagtggcacgatctcagctcactgcagtctccacctcctgggttcaagcgattctcctgcctcagcctcccaagtagctgggactataggcctgcaccaccatgcctggctaatttttaaaatttttttagtagagttggggattcaccatgttggccaggctgatcttaaactcctgacctcaagtgatcctcccacctcagccgcccaaagtgccggggttacaggcatgagccactgtgcctgtcccatcttctcttttctgatggaaaagaaatctagctctttttcattcctttttatcctgcttccaaaatgttgtgacttccctatggcattggtctttcttattttgtaatggaagttcccctgattccagaattttccctttataccagctctcatagcccagtccctgctagatgggctttttatttttgaaagcacagtagtttcgacgagttttattttcaacagttagacttgggaaggggcaggatgcagatggagataaatgcacatacatatagatgcccctgagaaagacagctctggaacctgctagagtgatcccagccacgaggcgccagggccctggtgatcgctctgattttctaggtgagataagggaatggaatcacagagggatcagtgacttgcgcaaggtcacgctgtcaacaagggtcatagccagaatgagatccacttcctaggtgcatgggaggtataagcctcacctgccttgaagcctgcttgtgttttgtttctgatgatatccagaaaagaactttttagaccttgtaatgtgcattataaaacacttcgcatttagatctaacttcactccctcaagtctcagattaagactgtgttcttgtgttccgtcctccccagtgatgaaatgcttggttgtctagagtgaacaaatccaacaactctgccaaggggttctctgtgcaggtcacttttcaaagggatcttttctcccttggtgtctctcctccaaagagcatgatttctgagcctaccaaagtgattactgtgctaaaatttccaccctagaagaactattgtgtagctgtgagaagcgactaaaagattattttcttttcccagggtgggtgcgcaacattgactttttctcaatgtgtgatgtggagatatatgcatcttgggaggagatgcataatatgtgtctgattctataatatgttggtaaaaatgaccttggtgatgaataattttcaaagagaaacaaagctgggctgagaagagtggagcttggattggagatgatgtgcagtctacattttttgttttctgttttatttgaggagagagattttcaaattaatttggagtgaacagaaaatacagtggaaatttgggacttttttttttttaaagcctgtgttccttatagtgggatcccattttcacctcctctcctcccacctttattatgatgattattatcattattattattagtttgtactcaggaagcattgtaaaagatgctgggagggtttgaatgctgcttgtgagaggaaaggatgaggagaccatacggctttatcattcattaattcctgggttcattcattgagctatttaaacttctgtgtgtaagacggcagccccagatggtcttttggtgcctgcattagctctgagaccccaggcccggacaaaagagggtgcacagagcagctgagtgtgcagaatgtttccagccgttagaaagctgctcccgagtctttcagctcaggagctagaacacctatcatctccagcatctagagaatcccttttcaggtctttttcctttctaaaaggctcagtgcgaatctgtgagccagcttctattactgcagcagtagtcacagtatctaatttttagagtgaaattgatggccacgggcttatttgcaggtcttcttagtaattgctctctgtcttcttgttctggaaggagttctgttaacactggtgaaaactttgagctcatctcccttcttccccctccacattccccttccctgctcaactctctaaaagacctgcagctattaagaaatttccagtctgggctgatgaggctagatgggggtggctgcctgggttgaacacctaccgtctgcccgcctctgaatgcagcgatggtacacacagccccattcagtccctgcaacaggcctctggcatcctggcattaccgatgagaaacttcagctttacagagaagttcaaagaggttagatgttcagctcatgcttttaaggtcggtagctggaaatcaaatgcaggttttcccgattgcttggcctgagctcttaatgccttcttggatttctttgtggctattgggacaggctggcctcagtgttgatgggcaggtaagggtacccagccagtcctagcttcactaagttgccgctctgcctacctcctgcgtgtgcttccctagtggggctgtcccacttttggagtggggacggggctgatctgtgtcctaatccataacaggcctaatggagctgagacctggcactgcaggagcggaggctttggggtcagtcaggtggaagaaggagaggagcatggggcatgccccatcctccagatgtctgttcttctagtggacttcactttggcctttcagtagctctccatctgaatgtggcagttgtctcaggaattttgtcctagcattatctgactttattgctcttatagaaaatgctggttccccagaaataatagctggtctgtggtgagtgaggttgggtcattgtgccttgaggtgtgacatcttctttggcttagtcaggtctttggcttgactacaaatgtctgcgccttttcctcacatctcagattcttgcagccaggctctgtccgccatgccctgttgctccttactgttggagagacctggaggttggtggagttctccaaggctggagttggggtacacaatgaggccgagatgttttgcatagttccttccattgccccgatcaggaatgtgttcccgcaggatgggttatggcctggaagtgagcctaatgtaaacatccttgcagaggccatcctcttaatcaaatagaaatggtttgagggatgagcaacttgggggtgggggagataggaaaggaagagttgggggaggggagagatttagggattgaactcagagagagctgtctgggggccatccttccagcagtcctgacagaaaactggcttcatggagttggtgcagtgcaaactggaatgattctcttagggaacttggttctctcagacagtgtggtatgttgagggaaaggaaggaaatcatggtttggctgaacagctgggcagagcagcaagggaaactgaagtatgttagaagagcaggaccggaggatagagcagacgggggccacaggaggacttctggaaggagcccacaattcaactcctttgagggccttcaacatctatttaacgttgtaacattttgaaattctattttgaggggactagactctcagagaaggggcgtgaagaatgtgggggacttaggtgcaaatgtgtgtgctggggggcggtatttagggctcttggtggagcccctcatgtcatggagaagcgaaccctttccactgtgcccccacccccttttcctagccctatgaagggctcagactttcttggagatgtggagcatttcagccagaccctacggtcaaagatcagtcacagagcagtcttctgtggcaacctgtgcacagtcccccaaggcagcaatctggggtcaccagggaagttactgttactaatctgacctgggaagttttctttttcgtaggggaatctagaaatactccagggaaagccacggccaagcctttgcccagccagtaaacttttagggcttttgcgtgaggttggtttagaagaatttgccgatgccaaggctgctatgttggtttcactgatgcagatttaaagaaggagggccagtgagacctcgggaataggaaggcagaggaaacctttctattctgatgtcttcaagtcttggtgcttgaatgtgccaaggagagtgaggatgtaaataatttagtttgccttcaggatgcaggatctaatctaaacatgattaagctgatttgattttatagattggaatttataagtgatagaaactgatgaggttaatgtgaaatatttacgtaataaaaagcttcattacctgatgctgaagggtagagggagaaaatattcttggcaacatgtttaatcttttggaaatgaagttgggttaaagttttctttgtaaaaactgaattctgtgatcttgtttttacacatgctgtgcttaaatattaacaccaattgagcaaattgccttttaactgcctttatttgctttcattaacagtataatttaaaagctcaagaatttgcatggaacctgttgtgcatgttggggggaaaactattcataaattaattaatcgtgagaacattatctttaaggaaggtcacaaaacatgagcatgatttccaaaaagcagtgacatgtttttgccgtttcttggggacgtgatgtacttttggcttagagatctgtgctgcgtgtgtgtgtgtgtgtgtgtgtgtgcacgcgcgagataacttggctggatcaagaaaaattttaatgactgggcatgttttaagttaagttgagtgaacctaattacactgtagtttccagagagctaaaggcaataataccattggtatttaagcactagtttgaaaattaaagccaacctatataattggctgtgctccttagatggtttatttctttcttccctccatttctgaaatcccccttttctttctctttcacatttaaaccaatagagagaaagagagaaactgcctagcgctgcgaaccacaagacggtccttccagtggggaacattaactgcattgtcctctcatgaaatgacgctaaataatgttaaaggtttccagtatgatttcactgaaattggttgcttccttctgtacagatgtttttgtggtttagaacctcagccaaggcaaacattatgaatgagatgcagagaccaccatgtcctatgaagggctgagagttcctttgggagttattttacttgtgattctgacacctctgttttgacaaagcttcattctttcagtctcttctttccgtctccctctcctggtgctattggtttgttgtgggtggttttcctaattaagttaatctgcaacctagtttttctgggtccacagatgccagaatgctgaatttatttatcttgaatgtttttgttggctactgttgagacacattcttcctcttccccttttaccccaagtctgttttaaacattttttttttgaggcttccagacgcacttcaataaagaaagaatttctctctggtgtccatttgtcaatttttttgtgggggatgtatattgtaaataatataatagatatgtaaaaggttgtaaataaaacccaaaggttatagaggaaaagatgtgtaaatttgactacatcaaaaatttaaaactttttgcatgattttctttcggatttttgccttttccttgcacatttgttggttctctttcgatataaatcagaaaaatgaatcttttatctgtcaaatgcatggcaaagattcttcccagtctatcatttgtcctacagttttgattatggttcctttcatcacagaacatttctattatttatttaactaaaaaatgtcacaatgatgtctgtagcgtagattttataaagcatctgatggtcatattttataatctaaattttggaaaagtatttggataatgagagatggagaaggtagagggagagcaagggagggatagagagggcacgaagatgaggaagggagggatgaggaagaggagaaagactggtgagaatgaatgatgttaaaagattgatttttcttcctgtaaaaaagttggctgtcgtcaaaacaccccttctgtctaagggaaatattgtccttttggcatgtacttgaaccataaagatttctctacttgaggagacctttcctaagagttacctgtccagaaggcagtcctactgttctctctcatagctctacccagtctttaagacctagttgaaatgtaggctccataaagccatttctattttcacacagttcattttcttttttttttttttttttttaagacagggtctcgcactatcacccaggctggagtgcagtggcctgattatatagctcactgtagcctcgaccttccaggcacaagtgatcctccctcctcagtttcccaagtagctgtgactacagggaatgcactaccatacctaggtttttaaattttttaaaattttttcttagagatgggatctcactgcattgcccaggctgatcatgaccacctgggcgctcaagccattctcccgcttaggccttctaaaatgccgggattacatgcatgagccgctgcacccagcccacacacttcatttttattctcaaggtacctgctgctttctggcttatggaagatacatctctgcatgtctaatctttcttagagtgtcatgtgatagcagagatgctgtcttctgtctcactcgtctttgaattctatactgtctttagcggtgtataacaaccatttataagtacataagtgatttaccagacaggtcaattcttatccattctttcctcctatacgttcttctgggacattcttcaaaagagatatttggggtcttgaagtccaacacttcgggtatttggcataaattaggttgaggacactggttggaattttgggaagaatgaaggggagagaaccaaggaagaaggaattccagagctggtagcgttgatttcagagtattctcaatctaaaaaccctgtaatcatgacctattcccaaaggtgagttcatggcagcttattcaacagatatttattgagtacctgacaagtgttttgctttgagtgaggcactgtagggcaagtaggagtaagtaaagatctttgcccttctgaagctgttctccagtttgggatttagaaaatttgttcaggaagagggcttaaaaaatagagacattctgtaaatgacctttctttgaaatcccttattctactttgactactgctgtctattcctcttcctaaatgaagctagtggaggctttttcaaaatcaattctatggaggttattggggcagatataagttagtcatctaatcatccagttagtcctgaactgaaacctggaattcattcttttatttttatattcatttattcaattagtcaacacaaagttgcacaatcaatattagctaaattagccaagtttaaatccatggtaaggcgaaactcccacttcttttctattagaaagctgatttcttagtggcagtaatgggtggtagggataaaaactcatcccatggctgtcttagaaccttcaggtgattcagtagaaatagtgctgtttctatctccatgatttattttcgggaaataagtagagatactggggtccagaataacttgatattctagttgacaatgatttctggagaacatgtccctgagacttcgtccatgtcggccacaatgttggggagcagtgaatgtctgttgaaagacagaataatggatgaagtccaaaggtaggaaatttacaagcgatgttactttgggatgacggggatgggagggaaacctgactggggagggaccaccgggcttcagtgtatatgagcagtttgctatcatttgttagaccttttgagcatctgaaatatttaaacagtttcttgttattctcctacttggttgatctttatctttgctgctgagttccaggcttagctcaatagagggaacagggagatgactgaaggcatagtgtttgtaaaaagagtttgtttcagttcttatcaaaaagttctttccaggaacagaacatacttttcattatatgggatggaaatcaggatggaagtaaatatgttctctagaatgttctagctctgagttgatttgcatagaggtcctacagatcattctatgctatatgttttttctttttttttttttttgaggcagggtctcgctctgtcacccaggctagagtgcagtggtacaatcttggctcactgcaacctctgcctgccaggctcaagcgatcctcctatgtcagcctcccgagtagctgggactgcaaggtgtgcactaccatgcccagctaatttttgtatattttttgtagagacagggtttcgccatgttgcccaggctggtctcgaactcctgagttcaagtgatcctcccgcctcggcctcccaaagtgctgggattacaggtgtgagccactgtgcctggcccaggtcgttccatgctgatgggctacaggggcacagaaataaagatctcagggcactcattattttctttcttcctttcttcttttgttaagagggaggtaggagagggttgtgtaaggatggaatattgctgcaaacctgtatacttctttaatttctctaccctcgcctgagacactggagccttttactaccatctttgggaaagaccttctagagaaaagaacctttgcttttataggtgagcagggacggtgtatgtcctccagcatagtttaaagtgtttggtctgttgcctctccagaggtcaaaggtgagacagactttttgttggtgttgttttcctccctccttcctcctttttttttttttttttttttaaactccctttccttgttatctgaacttccaaacatcagctttgatgtctattgttgggacttcaagaggactcttagcacatcggcaggtgttggttttagtgagcaggcgagagtcccacattcttccaaggagagagatgggtcccaccacattcctacccctagagcagaagttcccgcgctgtgcctcttctctggctgcttgctgaggacgtctcccagtggggtactgggtgtacaccagctttccttcccgtctttctgaagcctgtctgaagggatctgtcttctttcagagcagctgaagagaggttgtctaacagccacgtattaaggtttcattaatcaaagacacttccactgcccctttacagaaacacaactgctgtggctgtcctccgctgacggcccgctaatttgtctttcccagaggaggggaggggagaaggacagagaggcaggcgctgcccctaccctgcagtagggatctccatactggctcccagcgagcatgcgttcatgtgctaactttaggggactgtgcccggggcttcacattttcgtgcagagccatgggcagctggctataccccctccccaccctgtccatgaagcagggaatcaaaaccactggaagcaattactgcagatagataggtttaggttgtcttttatttgcaagaaaattttcatttcaagcttcaaggttttcactcccagcttcaaggtttgctgaaattgggggcagaaagctctagaagaaataagaatatgggtacatgtgtttaagtatgcttaatggacagcctcggcgaagtgaggggtgatggggacattaatagctggggagccactgacctgaaatggtacagtcttcctgtagttactgacggatgaaatcatgactttatgaaattttaatccttgggtatagaggcacaactgactttattactggaccccaggtgtgtgtgtctgaaatgagtgttttgaatctaactgcatatttgattactttctaaaatttaggcgttgctgaacttctcctcatgcttaggttggaatctgaccttctgtaaccctcagctcagaagatggatatttgggcatttgaaaacctctcagggcctcctaagtaggtgattgagcattgcgtcattgcatcgtcatcttctttttttaaagctaggtcctgtccactggggagcagctttgaactcactttattcaactcatcaaatatttactgaatacctactagatgtgtttggctctgttggagaagtaatggtgaggcgtaatgcgttcctagctcttaatttggggttagaactagtacacacatggctgtaatgaaagatagaataaaacatgttccctaagacaattggtaaatgcagtgaaagctccaagcggggaatgatcacatctgacttatttattcaatgagtgtttattgagtcctactgtataccagacaatggagatacagaagtccagaaacttgaccctcgtccccaagaatctaataagctggtaggggaggcagacactgagacatagcagcactttatagtagaatacaagtggtaataaaatgtagaacaaagtgtagaggaaatggaggtgaagcagcaattgactaggttttgggaggggctatagataaggctttgctgagaaggtgacttgtaagcaagatcttaaaagatgagaggaagatcactggttagaccagagggaaaggcattccaggtagaggtaacagcacacgcaaaggccgggggaaggagggagagagagctgcaggccatttggtttcaccagagcttgagatgtataaagaggttggtagagatagtagctggaggtatggttgtgagcctatcatgaagtcttgcttgtgcagcagagagagaagccgaccttttattctgtaatttgggagaaggtgttgaaaggttttaatcccgggagtgaaataataggaattatgacttggagcaccccgagcacagcattggggatggatatgtgggagtcagaggaaccacctaggagcccgtcaagtggtctaggtgagagagaacaagcagaggtagggaagtagcaaaggaggtggagagggaagggcacattgtagggggaaatgaacaggtcatgttgattgggggtgaagtttgaggaaggagttggttgagactcctgaggttttggcttggataactggtggatggtgggaatagagaaggagttctgggtggaaaaccaaagtctctcttttggacatggagtttgaggaggtcttggaaaaactatatagaggtagtctgcaatatttgcagtgggtcttgaaggaaagatattttgataagcagaagttgtcagtatactaattcatttgcattcattgagttctgatgatattttagcatgaacaagaatgagaagtatcttaatttcctggcagaaaacagtatttttggagtcccttgaataatgtaaagtgttttcatcaaagaccttcattcatgtgtgtgctgacatctggagagcagagatagatattttccttaggtctgggttcgtgagctataaactcttcccttgctcctaattaatcctttgtagttactgactgacgaaatcatgactctgtgaaattttaatccttgggtgtagaggcacaactgacttaatcacaggaccccaggtgtgtgtgtctgaaatgagtgttttgaatctaactgcatatttgattactttctaaaatccacagggtctagagaaaacagattagaggtgtttttgatttttgttgctgttgttgagacagaggctcgctctgttgcccaggctggagtgcagtggtgcgatcctggctcaccgcaacctccacctcctgggttcaagttattctcctgcctcggcctcccaagtagctgggactataggcacctgacaccacacccagcaaatttttgtatttttagtagagacagggttttaccatgttggccagactggtctcaaactcctggcctcaagtgatctgcttgcctcacctcccaaagttctgggattacaggtgtgagccaccgtgcctggcccaggctagagttttgggaaggatttgtttatttatttatctgtttatctatttatttgttgggcagtcttggaaaggatttatttaatttatttacctatctatcagtcatcatgagtaattctcaaatatctattatggaatcttagcacttggggatcacacaatttgttatctttcctgaggacacttaggcctggggagatgaagtgactggaaccagggctttctgcttcatattgcatttctactctcacccctaggagaacaggtaaaagataatttgtgttgagtgaggggttatgaagagacaaatgtttttaataaaaggagggttgcgtctctgtgatgagacagagtgttctggctttcatggttttccctgtctgaaagtaacaagctctagattacaacagtgaggaatggaggatgcacagatggctcagacagtgacttggagttcaggttgacatttcaggttgacttttgttacaaagaatttagagggggccaggtgcggtggctcacacctgtaatcccagcactttgggaggctgaggcaggcggatcacctgaggtcaggagtttgagaccagcctggtcaacatggtgaaaccatgtctctactaaaaatacaaaaaattagctggatgtggtggtgggtgccttagtcccagatacctgagaggctgaggcaggagaatcgcttgaacctgagaggcagaggttgcagtgagccgaaaccacaccactccgctccagcccgggtgagagagtgaaactctgtctcaaaaaaaaaaaaaaaaaaaaaaaaaagaatttagggggcgttgttagggggtattgtatacgagtttgtgtgtgtgtgtgcgcgcgtgtgtgtgtgtgtttgtgtctgtgtgtgtgtgcacatgtgtgtacaggttcactctctaccactgctttcccctttgctgacctggactggcctgctggatttcccaccaggagctctctaatgcagtgtcgactgctattctcaatgaggcccagcactgtcctggtgaaactggaaagagaaagtacgacaggtgctgtgttttttgtatgggggttgtaggatcagagaagtttagagttggtgggacactcaaggatggatagaaaacttctgtttgggtctctgcagtgatggagcaatgtggattttaacaaccagagtagcagctctcatctcatgagcacctgtatcgtgtcagtctctgagttaggttctttaaaagacagagttttgttaatcctcacaattttgtggtattgttaaatcagagtacagatgataaatggaagctcagagtggttaagcgctttacctggtgtcacacagctagcaagcggtggagcgaggatcttgactaatactgcagcttttcccacttccatggcacgctgcctccttctagcattcagtgaggaaagctctcaccgctgggagttgttcactctagactgagcgcctttcttagagaagggatttcttggagaaagattgcagagtcttctctaatgattacaagaaggacagagtcctggtggacacagttggagggtcttgtctggaggcagtggaatgagccaggtggcctcttggagctttttcaggagggaaatctgtaagggagaggagatgggactctaccttcgatcacttggaaggcggttggctgaggccagagagtatctttccataccttcccaggagccaccccaaactcctcaggcctttgtttctgaggttctctcagaaccactccaggcagagcccacaacacatcctgatgttatgggatgaatggggacatggggcagggcagcagcctggaagcaagtgaggttaaagaccgccttagcgagttttcccttccaccagacttcccctggctccccctggctttgttcatcttgaactcccttcacctcttctactgtttcatccctttccttcagtccaccctggatctcatcctttaaagccgaatcctctttcctgaagaggaaagaaggaaatcctgactccttagatcactatcctgtgagatgaaagttgctcttctaatttgtcccattttcttcaactcttcttcccctctgtccctgctccacactcaccactggcaaccactgagtctgagaccctcccgcacactttctctgcgtgtcttcggatgctgtatttacttaagctgaatacagggtctaaagggtggcagtgtcacattagggcccatcgagggagcagagggcctttgtcagagtctgcaggttgtggggatggtgactggcctggagtcggggtgaagcaatgggaactgtagaagaaaggggaaggagagcagggcagcgtggatgctggacctgtctcctcttcagccttttggactctgtgttccctctcctgggaagccatacagccttggccgcttcaagatggtgcctccttgggcagcacctactctggagtcggtctgcatagttaaatggttggaaaaaagactggagagccaatcagggatgctcacttgcagttcgtgtgaatcctgcctgacccacgtttagagacaccatagaattgtacagaaccttaggtatcaaactgggtttttcagatcccactttcctggtgagaatattcttctgttgatgtgctaggaaatgtttaatccaggtgagaaacaccagactggtagtgtttgcgatttctgtggtgtagatactcccaccatggctaattccaagctgctggtgtggtcactgaaggcggagttgagaaaaggtgtacacagtggtgcaagccagctccagggcaccgtggcttctgaacgcaagtgtggaagcgctaggagtcctagttgctaggctctagagtggaagttgaatccttggtggggctgccagtaaggtggggaggtcattttctcaccaaatcaaaacacaaaaccctggctgtgtcgtctttcttattctcatgcctggttcttgattgtggctagcaccatggctatttcaggatcccactcatactgctgccattggttgaatgcttacatccattatctcatttagtcatgacagtaatcccatgacatagggactggtattatctccattttgcaggtgaggaaactgaggcacagagtgggtcagtaatttgcacagggttctacagcctttgagtggtagaactggaatttgaaatcatgactgtctgatcccagatcccaaatccttgcccagtatattatactcgcagttttgtagcttttcacagacatttccaaattctgagtctactctcaatgcagggtcttctagcataacctttgttcctgttggcaacacttcattttggactgtcaagatgcatttcctgagatgtgagatgtcatgaccctgtgtttggtaagtttggctgcaaggtactggctgtcctctaagacacttcctgagtcccaagtccacagattttactgaggactgaaatggctgcattcttcatagacactgagtttgcctgttccaaaaatggtgatttctatagcaaccatttattctagcagatgtgtgcctggtatggttggcagagagggtgggaccaaaaatggaaacggccttttattcttcacttcctgaatgcacgccctgtatgtgaggcatataggaggaaaaacatggcatccttagaatctgtaatagatctatggctcaggaaagaaatacgtgttgcttcagactgctttttatctggagcttgagttgggctgtgtttggtttgtggcgtgttctttggcagatgtacctgttggtttcaattcaatggatgtttgtcatttggtctctgcagaatatgcacatttactgtgggggtaggtggctaataaacagagagaagacactggcttggctcttaaagatcacgacgtctatgtaaatgtgtattacatagggctttttttggtggaaagtaaaataaccaatttatgccagcctaagttaaacaagaggatttaatatcataataaaggaaggttttatggagcccagggacaggagcatggccccatctttgaaaggcaagtgagcggaactaagaatgaactgttagaaacttaggtggaattctctctctctttctcatgcttgtttagtctttgcacgtatttccattttcacctctctgcagaccacagagtcgaaaaatgaccaccccaggactcccaggcttacatgtgaccaggcttgattcagctttccctgtgtgtatcccaaattctagaaagagacacagtctgtctgatgcagcttggatagttatccactcttggccaatcactcaccgaaggctttgtggtgagtgttatttatctaagtctgctcaggctatcataacaagatactacagactgggtggctcaaacaacagaaatttatttctcacagttctggaggctggaaaatccaagattaaagtggtagcagatttggtgtctggggagggctctttttctagcttgttgatggcctccttctcgccgagtcctcccagggtggagaaagagacagtgagctggtgtctcttcttacaaggacactattctgtcagatcagagacccacccttaggaccgcatttaaccttaattacttccttacgggttctgtctccaaataacagtcacattcgagatcagcgcttcaacatattaattgtagaggggcacaattcagtccatagtagtcatgtaggataacatggctgctgggatccactcttgggccttgggaatagaatggatctcattggctcccccagaaggagaccagtgcagatgaaaaggctgaataccctgccaagacaatgtcctgtgccagattagaatctaaacctcattgtcgaactcaaacacattgcacttggggtgaatagtcctgctgtgcgtgtgtgtatccatatacgagatgtgtgcatatatacacatatgtacaggcatatatatacatatatgtatgtatgcacatgtctgtctgtgtgtatgtaattagagaggactttctggaaaaggaatgtttgagggtggccttgggttcctgttggctgtgaacacactcctaatgagctgccctgtgtctcagtttacacgtggtatttgaaattgagtctaaattcccatttcttgtactttctgaggagcagtcaagaaagagccagatttacagtttgccagtctcttagctctatgttccaaaggaattaagtcactcttcttgacagtggccttaaaatagggttttaataaaatgaaaagaggagcagtggagccacccacccctgtcacctgtggctaaatggatatacgggcgccaggctgctacgggagccttttgtggtgtcacctccagtgccagtgggatacgtgccgcaacagagaccagatgatgaatatatttttaaacttggaacccatgaaccacttattatttctgaattaggaatcaaaacatatgaataatttcaacagggtttcagcagatgtattctgcttttaaggtcactctgctttgcggagattggtcgggggtaatggggagtgaagtccagcctgattctctttgtgactcttaggacatctgtgtcatgtttgctcaatttagcagtcaccgtaagtgtgatgcgaggccctcattgcggggtcagggtaacttatggaagcaaacagccttctttattttttaatacatcactgtcacctgcgcttatgccaggggttattagaagaagaggggctctgggtggccatgtgttcatggctatgatgactgaaaaggccacagcatgcaacagagtcctcagatttacccccaaatgcttctcccaccctctattctctcttagcatctctccctgaacctctttcgccaaccccctaccaaacaaggtccagaattgaggtgttctggaattccagccttgctaagctctgggattaaggccagtcatttggaaaggggatgggggaagaggcaaaaacaaaacaaaaaaaaaaaccaaaaaaaaaaaaaaacaaaaacaaaacaaaaaaaaccaactgaacattaaccctttgggtccatagcactgagaagacctcaccatttcggccactggcaaatcagcatctcttggccatatccctgaaacctgagcttcatgtaccagaaggagacagttaagccaagtcaggctgatgaaaatctctccgttctaatgactgtgcagggtacacctgttccagcctctcacttgctctcattgtcagttggacgcaggtattgaatgaccactgagtgtggagtgcagcacgagggtgctgtggaggaggagagttcatgagcaagaagagaagcagtctcttgacctcaggaagcttgcactgtgtttggggaggcatggtcatgctcactctcttgctctcccagcacaaagggagtgggctaaagggtgggagggaggcagatagttactgggcctgaccctcttctcggggtcagccacagatcccagatcctttaccttcctcatctgcctgttttcctttatagttctattggagttaaaaaaaaaatgacagcagtgtcagtaacacacactcattttaacaagagaggcagtacaaagatatctataaagaattaacagtattccttatttgctctccatttcagctctcctctagggaaatgaatgtgctttatttttatgaaataatttcaagcttacagaaaagtttcaagaataatacagagagcacccatatcaccttacccatttggagtttactgatttttaatagtttgccccactggtttccttcctgatctatgtaaccgtagagcagccttttgaggtaggagacaggtggtattatctttttgtgtgttagaggtgagaaagctgtggcccatggagttgaggagtgtgcccaaggttatctaactatccgacaacaggtttcccacacaaattccacatgatgtcattcttgttttcatttttgtctttccttgtaggacttttttttttttcatcgagcctgcagaaggggcctgtcttgccttcacaaggaggagatggttgcaggaaagtaggaggtgaaaggtgtcctccaagtctcctcccccagatcagtcggacctcctggcctcctttggttttccctctagggcagaagcggtgctggctggagggggtccaggtgctgtttgttgcaggagcgccatcttgctttagacctttttcgtttcagacagctagaggaggtcttttacggtcctacttgacccccataaaggaagttcactccacaatacgcatctcttttcacatgaagaggcaacagagggaacaaaaggagcaaagcagccttctcctgaagaggtgaaaatatcactgccttttggagccagatctgggtttgcacactccaactcttggagtgatgtgtccttatttgtaaaaggagagttctggagtacattgggaagcaagtcatcagtcatatccacagcctcctgctcctgttaaatgtgtcctcctagatggaaaggttggaacaagctgtgccccataggttctgccatttttaggatctttctggcactgagacttttgcttctgtgatctctcattggaatccatttcttttgcccaggcgtggataatgcttttgtctaatgccagctctgccccatctggtcttaaaacgaggtgaatctgctgctctgtattgaaatatgtgatctagaaggagccataaaataggaaccttaataactctttctctctgtttcattatccatgcagttttcctggcagctgtccattccggcctcattcccacctctgggacatgtcaagttattgaggtggtactggctgtgggtgactatagatctgggccagcctgttcaactgggtcttctggggttggtcctgggtagagctgggtggatgtagtctaaaacagagaaggtagtgaggcccttcacatccattttaaggaagctgagtattgttgttgagagtggccctggcattgtcttcatcaagaatggggttagggatccggctgcagtgacactggtgaggtgagaggttgaagggatggtcagacattactgtctcttgagcgaggttctgaaagtctattccttggagactttcacaaactggagggagaccctgtgtgtccttggctgaaactagaggcccaggtcacatgaccttgggagagaagccactcatggcctgaggacccagtgagctccttgacctacgaggggccatcctgatttctccacttcccagtcaactctagaatggagtctctgcctgacgaaattgtggttattttgaaatcagcttgtcatgttccttgattgttttgggtgtaatagtctcttctccgcagcaggttgtaagcatcttgaaggccaggaccttgtcctttcttctttcattggagcagaggttagggaatgctggcttctggacccagccttggaccccagggttagcactccctggctcttgcagttcccccttgccccccaactccactattcccctggatcacagagcttggtgacagcagtgtagccccttcatctcagcgtgatggtgggagggggtcgtatgcattttcaaagcctttcctgtgtgatgtgccctcctggtgcagcttctctcatgagaatccccagcctagacgtctcttctcttccattgcagatcaagggttctcaaagtgacctgctgagccacgtgcattggactcccatggtgtgcgtgtgaaaattcctcagcccacacggatgggccagaatcagaattcctggagtgggagcagaactctgtattaaataagccccctcagataattccaatgtacactaaagttagagaaccactgtaatggtctgatgtccctcacactccccaccccagtacacacacacacatgcatgcatacacacatacacactctgttaaatggctgcttctgctgttgctaagaatactttgcttttcaggtgcttgtggatgggtaggaggcagtgcctgattttgagctcttgactaggaattgcgtcaatagttagaggagggaaggatcagaaaggggacctcagaatggggttatttaggggctggggagtcagaagaactcagaaaggggcctactgcattgctggtgaagcctgaatcttccatccactgttagcacatggctatgcagactctgattcccatctgatgccatatgtgcttcctccacagtccgggagaggagctttgggtcatgtgattagccttttgccctggacagcgcacctaagctcagcacatgtcttgggatggagctgcagaatcttggtgccgtctcccccttggaaggctagagtcttggcactgagaggaagtccttcctccatccccagcctcctgactccattgctagcgactcccagcaagttaagaaagattcagtgggaagggtatagggctgggagttgtctggatctaagcctttcttgctcagtttgatagactttggaaaatctctgtctctctgggaactcagtctcgtctggtccctggctttagcacagtgtgtccaccattgcagccatgggcgagaagccactagagctatgtctcttccttaggagagcctgggggggatcccaaggtgttggtggtttggaagggcagtgaccctgcatgaccaggatccatttgcccaggcacctgctctctgccagcctgaacacccgggagcacctcccggatacgacagccacccactacttctgcatggccgtggccacatgggcacagtggggtgaagtgaagatctcagactctggagtcagacagtctggggtttgaatccgagctccaacacttctagctgtaggatcttaggcaaattgcttaaacatctgacctttagtttttttcacctgcgaaatggcgggtaaaaactgcgactagctcctagggtgtgttatgggatgcagtgaggtgaagccaataaaacccttattagcacctggcacacagtaagcacttcatgagggttagctgtgcttgttgttcctgggtgtgtttggaggagacttgtaatcttgtaaagtgaagttcaggtcctcagagacaagtggtgtctggctgtgggttctggccattgaaggcctgggtggtttagaagggttttaagttagtgccttccctagaggtgggcacacgtctgtcacctgcccctgatgtgctatttatcctgccaagccctggggcactgaagcagcccagaggcggctactgcaaacaccagggagagatagagtctccaagaccccaaatagagtttgcaggacctcttgagctctggagcaagaaggaaagggacagagacaggccccagtgtcagtggcgggttgggagggagcagagcacagctccccatgtgcgttcaggtgcccagaatctgtttggccactttcatctgggtctgcgtgggtgggggcgtgtggtagcccagaacccacttggcaccaggtacaattttgtcttcagctccagtggctacttttctctcctttgcttcactttgaaaatagtcagcaaaatccttatttccataagcatttttctggctgtaaaaagctgaatcccaaacctgttattatagctgttcatgctattttaatctgctctgtttagaggtgagagggtagcagtgactctgcaattactgagtacatttgatccgtggcgcagccaccggagccggcagagaacccttggagtaggatggtgtcgtgtgtggcaaatcactttcaaatttactaaaacgatgcccctttgcagccatgcagatatcataattttcctccccaaggcttgttgaaatgcccatttgcttcctgccttacgcaggctcccagcacgcgccccttggcccacctgcctattccctttcattctttgtcttggccagattctgtctggtctctcttgccctccgcccctttttcttcttcctccctcttcatttcctgctcagaaatattttatattctactgactggcatgcttgtgaaaccattttccatttgccatggtcagaagaaaaatagttagcattttaaatctaccaactatttcacatttaaacaagctggcaagccgcaatgacgctgcgcctcctacatacagtaattgttgcatccctaggctcccttttctatctctgttcctatttcattcatttttctatttgcagccagcacagaatatgggcttctcccccctccttctctcctgcggcccgctttctatccagtgaccttggcttctctgagtgccgcaccgtaaatgaaatgtggcattgccacatgtatcttgataaaatatatcagtggatgaattgattttcatattgatttccttggacgagcaaggtgtgtgtggaaatcaagtgtctcttaatgatagtcctagagagagacaggatgcccagggaggagcaggctttgtttttctttcacttacgaaaagtttctgcttgttagcttgggagggaggcctgtttgctttgaaggcacactctctttctgggggtaaacagcaaatgtcccaagggtgtgtcctgatccctgagaagactgcatcatccaggtgaccgcctagagccttagggaatgtatccctctggactccgccagctgcattgtctttggagagagctgaaaaactctcaaggcatgttggaggcccttgtgcaccctgcagggtggagggtcttggctggagagtggccttctccctggccacttccactttcatatttcaggttagttgagacgtggcacttgtgaatctaggactgatgctgtgccccaagggcatgactgtgtataattcataagtgtcagcatcgatggctggctgtgtatgggcatgtgtgcttgcgagcacacgcatctacaaatatgtatgagctttgtatatgggttggctatgaatgtgggtaggcagcagtccctaggcttgcagtggcttttattagcgagctctggacaaccaaaaagacagcatccagtgaggtgatcaaaacttcatttcatctcctctgcagttgctttcccaattcactctcccaactgctcctaaataaaatagatgctttcagctgagagttgaatttctttatgaggctaagtaagcgtggcttaaggtgatactgtgcatgtgtgtgtatgcgcatgtaaagaaaatgaaacagttaactggaatattcaggatagagcgatgataattcattacattttctggctaactgaggcttaactggaaaatccttttagttcaagcactgctgaaatgctttgcaaaacagactaggatattttcctgcttttgtaagtagaaggtagtgaggtaattgcatcctttgatgtttcatgatcttgcagcacacgagggccggtattttggttatcatttgtgattgcacagtggcatacaggagatggagaactagcttggattcatgtttaccctttgatggtggttctcaatgggggacaatttcgtcctccagggcacatttggcagtgcctgagacatgtttgcttgtcacaacctaagaggttgtttactgatgtgtagtgggtagaggctggggctgtttctgaatttcctatcgtgaacaggacagtctccttctcctgctcccccaccccactacaaagaattatttggtccaaaatgccaatagtgctgaggctgagaaaccctttcaaaatttttgtcccaaaatttttactaaattcttgcacataaaatcttttgttttctctgtttttttctttttaagggtcaggtgctggaaacgttctgaataattgaaacttcgaattcattgacgtttattgttccacagaacaaatagggaagcctgccagtttgcagataggcaggcctgtccccagatggccctccagtgaatgcccaaattcattcagttatttagggccattaaaaaccatgagggccacactagctttaagttgagctaggcagaataaacaatccgagaggggggacatagctccccccctttttttcattgcagttcaaactaaaatgctcagagacttccggtagcactttctaatgatgcagggtttattctgcttaccgcgggtcagagacaatctgacgatgacagacttagaactgctttcagaatgtgtaaacatgttcattggtttgaatggctctaagtgagtcttcggcagaatctgtctggttttggtatgatatatgtatcttggggaaaatggggagattttgcatgctctgtatctttgactttctttgagaaaatacttgggagtcaatgagttcacataccaaaaaagccttatgcagaatctaactgggtgtgtgtgaaagggggagcggcggaagttaggaagactgaaggacctcctttatgacagtaaaaaaaaaatcttttaaacttaatttcaaatgaaactttaatgtcaaatgttctggaactgtcacacatcattttgttaacctatacctattaggtataggtataggtctagaatgctgtacaagacgggttaaatgaagtctgtgtgtgtctggtgaatgcatatgagtagttagagatacaccattcaatacttgatttatttgtgcaggttacctatcatggtaacctctggcaggggctcattatttcatataaactaaaaaggaaaaaactatgcctgcaagactgattgattttctgaatcactcacaaagggcagccatgcagcccaaacacacttcatctctcaagttttattttagccttttgccttacaatgtctgtcagtagggacaatggtagcaccagaggcctgggggtagagtcggagggatgaagttccgctgccctctagctgtgtgaccttagacaagttgcttaccctccctgagcctccatcctgccccctcgcaagcttgttttcaggataaagggatgggaaagccctgtgtaaattgccaagagctgagtaaatataaagtgctctggatattgttccattgttaagcaacggcaataccatttataaaccaggttttgagtccatctcgagcattgttcatgagaggggccggagcctcccggcaggcactcctttaagagctgttatcacggattactccatctgctgcttgctagccgaaatgctaaatggagttgtgggtgtacctggggtctttcttgttacagtatagactctgagggggtctagatgtgtctcccctcctttctctgagatagaagtgtatttatagcctggtgtaagtacaatcagaaggttcctataaaactctgttattactgcagtacaaagttagaaatgcttgaggtttcggcttcttggctcttccatgcggcaatgaatattttatgggaaaggaaatacttagtgtctgactctttttatagtgcagctactcacagtgctggtaaccttccaaatctcgccaaaatcaaaattgctgcctgtccatctctctactcccttcttcacaaaattgactggtgtcctgcctcgctgaggtgtccagactctcttggtggacgggtccatttacaaaatgtggggggtgcagttttcaatcctagtgaatgccctaaaccagaggcgttggctcctccccagccctgccccacccctggcaccttgtggtgctggtcagccccagcagggcctgctggcagagtgcccactggatcttccattgaaggtctccatctgccttttctgccatgcccctttcctgcatgcccactagccgctgagtggaggtggcccaacctctccaaagttcactctgatcttggaattcaaaaagcaacaggtgagtttgaggtccaacaggcccctgaggggcttttaaattttaaggcttgagcttcggctgaagccctggcacagagcagtcatcgggctggtaagatttccctctcaggtcctcttcctgtggtccctttagtgaccccacgcataaggcaggaaaattgggcctcagtggtcttggccctggtttactagatcagggactttaagtagaggaaatgggtctcctggcaggtcagcatccatggaaattgctcccctggtggcccaagggcattgtggcacaggtgttccactgggttggccccatggtcctcagagacctattacgactatagcaggaccgcagactaggctgatggccagattacagtgtcaaagaacacctttctcaggcagctatccctcatggatctccttagaggcccccacaggctagtgaaatgttgacatctcccatggaggtgggctcagtggcctcgtctttttaccagtacccaaaaagcccagagtggagagcttggcaggtgtgaagtgtggctcctgagatgcacgggagcacagctggttgtgtctcaacactggatcgtgacagtttttcttagcatgggcagggctgtgaaaaatgcttaacataatctgaatgtgggctccacacttaatttagtaggactctgcgagctcaccagcatcattgcatttgccttctgctctgcccctggtgtttgtcttggcgccaaagtaggtaaagggaaaaaatgatttgcaaacctctggcagctttggtttgatctcccaactctggttgcattgctgccaaacagagctgtattttcacatgacagcttcgtactgggccttttctttctttctttcttttttcttttgtactttttggtatccaaacttggtggtagcagaaggcaaggtggggaatagagagcttttggtatcacaggcttagaagctcatttgtctcttaagatgtgagggtaaggaaagggctagttattatttttgataaatgggaatggggtcagccaatggcttactggagaaactagatatagccctttatacttaggactgaccacacagttgaaattaattagcacagttgaagtaattagcacagttaaaatttagggttcctatgaccatgaagttgatgggtgggagataggtaaggctcgaagaactgaaaatcctcaaatgtgctaaaagcttcattattggtccttattcatattttaactcaccctcctcatctgtgaagtcattttttttaaacaatgaaaatggataaaagaaatggaaccagagagagaagcaagagagaaaaactttaattaagtgcctattgtatgatagacactgctgtgttcttttaaataaatacctttcagattaattccaaagctaagatttagcaattccctggttctgggattatttggccctaggatcagataagccaccagtattcactgagtcattcagactccagagttgcgccagatcccatggaagatgcaagaatgcatataggctgtagttccttctcttgggggttgagatcacacagctgtatacccatgtgtgcacacacagagacagatacagctagtggatcatgccggggggaactatacattccagtgctccagaaattcctggcatactgtgcctggggtattaggaaggtgacttgtgagtccctccgtgggacactccacctccttatggcagcttgtggctgccatgatgaaatgaaacacccactcctgaagatgtacaatttgtgagtgtggtagacaaaatagtgactccctaaagatgtcatcctagtctctgtaacccatgagtatgttagattacatggcaaaggaatgacttaaggctatttaccagctgagtttaagatagagaaattatgctgggttatccacctgggtccattgtaaccaacataacctcaacggtctttaaatgtggaagagggaggcagaagagtcagtgtcagtgtcagagtcagaggaggagtgagccatgggcccaggaatgagagcagcctctagacactgaacaaggtagggggacagtctctccttgaccctccagaagccacaaagccctgccagcaccttgattttagcctagcgagacccattttgaactccttccctacagaactataagatacatttgtgccattttaagccactcagtttatcgtaatttgttatggcaacaaaagggaactaatatagtgaggcagaagaaatctgagtggctcatccttgggcaaatgggagccagtgctgatccttttactgttctcgggtgctcttgcaacaggaagtgacttgcagaagtccttttttatctgaaatgccagggaggatggactcttattcagcctagcttctattcagctcaaaggaaagaacatctgcctttttcccacatcttctctgtacccctcacttccttcttgtgggggagattccttttcttcggtgagttccctttgcggtgtggaatctcgtggcaagggctctgagtaaaggaggagggttgcatggaatgccattgaattcattaggcttggactctagcaggaatgttgcctggggtgctgatgtccttctcaaccttcctttgctggagtccttcttgtaacttgtcttccttttgtgaacaacctgggtgtagtttttaaaataagcgaattctcctagaagtgttaaaaatgagccttcaagtactatctcggcattttgcaaaggttaaagcccccactgtttgggggctgagggtgctctatggggggccacccaaaagcaactgtggaaacagagtctggcttcagtctctccagatgttgtgcacataagggagggactcttgagctcatagatcacagatctgtccacaggctgtcagtaggaaagagcatcttattttacagatggggaaactgaggcctagagagcataagtggttcatgcaagatcttacagagagtttgtgagagtctgagagctgttccccctactattgcaacatttggaatgttctgaggttcttaccttctattatcagtttgagggctgtagatgagttgtggtagctacagagatgagctttccagtgtgcccccaccaagagatgaatgaaagtcatcatcgggcagatcactgcctactaaaaggggtgggtttttttggggggaggttttactcttcgtcacagaacttgagaatatttctactgaggatgactttgtctttggggcttccattttatttttaagattcaagtgtagttttaactgcagggcattagctcccttgtaggtcacctcgtgctgtctctggggtttatgactgagctctcattccttagtcacatgtcctatactcacacttcctatcccattttcctgcctcaccaagatcaccacaatgatcccaggttctatatagcatttcttttctggaggtctttaaaaatattctgggagatctgtctggaatgcttgagtacattcatttattcctgtatgcatagagggcccagggacctcccaggctctctgagccctctgattcttagagggttaaactattatggaaacagacattgcatctgtgtcttctcttgtttcctgcatgcagcagtgacctttggagtacattgttcaggagaccgacccttttctaccatttgaagtctgctattctcatctctctaccaaaagagaaactaaacttcattgtcgtgattaaggtcacagccaacagcagttaaagaagccgttggtcttcccactcataccgctgccctctccctagctctcaggaggaagagctctccaaaatggaagtgtcttgggaaagaaatggaagtggaaagagaaagatgaaaaggccaccaatggcacttcccgtgtctcagcctcaccagagaaggaacttggccacacactggttgggtataccaaagtgacacaatgtggatgttccagtggcaattaagtatttatatgactagacttgaggagttccaggccatgacacttccaaatccttccagcccgcttgtggagagaggcccggaggcttccagcgagacaattagagtgtgaattagattgtgtcttctggaagggagatgaagttacctgcctactctattacagtttatttcattaaggttgaccatgcccttttttttgggcagagggaataggatggattctctggagaaaacagtgtagcaaggcaatggagaaatgtccacactggagtaaggggctttctgggacctggatggagtctccttcctcccctagggaataggacagaggtgggaaaggtgctgcctgactgctctgtgcacatctgcatgttggtgatgagtgtggccagccccatgctgtgcatcggtgagaggaccgctcaggcaggtgttgctgtgctggcagcttcttaggaaggcaaggagcaaggcgtgggctgtggggcccttggggcagagcctgtcatggagtgggatgaaagggtgcacgggacctgttggcagccccagcggccaggctctgttcccaagctggagagagaggcaagtggtgagggagggcaggaggaccagtcatgggtttaatgcaaaatgacagttacgggggttgccattttagagtaaaacaggccatgtgactgaggagcaggtagcattcatattattcatatttcgagcttggtagatgtagaattttgcagtggaggccaggagaggatgtgagagctgcaggacagaggcataggtttttggaggtggttgtggtgttccccgatggcaatcaacttcacggagagaagaggttattttctacttaggttgcctggagcctacattccaaacttttagtcctcttcatctagcactaagttttgcatctcccttattcctgtcatacattattagtgtgcactgttttaaagtcttttacatacatatgtcttgcattccctacttaattgtaagctccttgaaggcattgcctgtgtattatgtttctttgaatctctctgtggtggctaatgctctgccctgcatttagtaggcaataagtttgtgttgagttttgagtcaactaccactcttttctcccttcctcttttttaatttttttttaaattattttttattttttatttgacacagagtcttgctcggttgcccaggctggagtgcagtggtgcgatctcggatcactgcaacctctgtctcccgagttcaagagattttcctgcctcagcctcctgagtagctgggattacaggcatgcaccaccatgcccagctaatttttgtatttttagtagagatggggtttcaccatgttggccaggctggtctcgaactcctgacctcaagtgatccacccgcttctgcctcccaaagcgctgggattacaggcgtgagccactgtgcctggcctactcccttcctcttacaaggctccttactcatttcctgcgtctcacctgctctctcagcccagttttctaaaaaaagaggtaagagatggatgccagtctctttctcctccagagtgattttgtgaggatttgtacaatgcaagtcttgagatgcaaatggacatctaggaacagaggaattgctggagcatggagaccacacttctgaagatggaaggagacccttctccaggctgtcgcttttgatttgcggttttcccattgccaattgctcacactgatccccagtcctgaaggggatgggggctgccgctaattccctggcatctcatgacttcctgttttcctccagttattatttttattgtacttccttcctgcttcttcactctccggcttcgccagtttgttccgtgtgatcatttcagctttatttggaaactggaagcctcattttactataatagtttcttgacgattttctaaatgaaacttgcatacttcatctgctcccccactgctcagatattaaacaaatatctctaagaggtttccttctccccccccaaagaccagcagtttgctcaaacagatggcgagagatggcgtgtgtgggtatgtgcccgcggtccacgtgtgtgtgtgtgtgtgtgtgtgtgtgtgtgtgtgtgtagtagaggattcttatggaaggtgccagtttctgcagcatcttcttgcctttttggcatccaactacggagcaagacagagcctcctggcaagtgaccaaacagagtgagtgtccggaaggcccgtcaccctgatattcacgcaaagaatctgtttctctgtgaatgggcggctgtggaggaggccgggggagcaagtggctggccagcctccaaggccagatgttctgtagtaccatatgtcaggataggaaggacggcaccgagggctcctagagcgtgtcagacctcagctcttgaactctgtaatcctcatgcccccttccgtcctcggtcaagaacgaacaatgcttccctctttgtctgcttttcaaccccacctcttttctccattagctttctggtctaaactcattattgagacccctccacaacattcaccttgcctctcctttgcctggccccaggctggctgcccctttttctggaatgatgctgttttggtgcctgtttccctctcatctgaaacaaccacctcctcttctatgtctgctgcctccttggtatcttctaagcccaggcatgagcccccctccttggggaggcctgagcttttgattcccactcaggctgggtgttgagattgtcctcaggacctgacgtgcacatgtaagtactggtttctcttatagtgtgtattgtcttccctcttcaactaaagctttaggagggtaggttggtgtcttatgctttggttgtatccttcactatgccaaataaatacctatcaatcaatcagtcaatggattctcaacttgcctaggcccagaacagaggagacctgtctcctagccatgttgagttggtagccagtgcagggtgctgaaggaaagaagtgtagctcctcggctgcccattcttgctgccatctgcattctgatgagtagaggatggcatgtttagttggttggaggtaacgaacagaagcaacagctcttttgagttccctgctgtggtaactcttactccgtggagtcactcaggcacctgtgctcgggagtagatggagataggaggtttgttccagtctctcttttcttgtaccttcctagggaatagcaatgtcctgtagatgtgtgacagtgataccatgttggcattttgttctggaaggctgacctaactactgtctttggaaacattctccttctcaatttagaatttgggcccttttctctgtctgtctccttccatggtccctgcccacgctgagcctcccgcgcccagccagctccattgtttcaagaagggctttggggctgctcgatgactgcagcactgggaccaaagtcctcagcatcagtctcaggactccgcatcatcagcccactctaccgcctccgcaggctcctcgccgctgtcttcaccacctgcccactgtggataagccaggccagcctcctgaaggcttgcccggcggggtatgctcatttctaacaccaagtcttggctcatgtgatgcctccatcacacggtgctccccgtctcatccaaggcttttccattcttaacatttccaaacatgggtagctagaacccttcggagcttccagagcccccgaaaggaccaactgaatctcaccatatcctcagaccgtctgcagtgacagcagctactgttgatctgctcctcttctgcacacccatagtgatttgttgacatattggcacatcaccacatcctcctctgtctctttctccatctctgtcttgttgtccactaggttatggactggccagggacaggggcctttctcttctttagtcttacactagctacacacttatcataaagacattatgttctcagtgttgtgctaagttgttttacatgcacagtctcatttatgtaccttcgcaggtaacagtattgttagtctgcttgacagatgagaaaactgagacttggaggatcccaaagtcttagagcctagcaagttgtagatctggaattggcagacagggcttgtgtcagcctaagttcttaaacttcccgttctactaactagtggtatcaggctctgccacttacaagcttaacgaccctgggtgagttgtttatttccttgtgcctcagaaagaaatagaaataaaaatacccgcttcatagagttgtcctgaggatcgaatgagataaggcatgaaaatgcgcagaatagtgcctggcacatagtaagtgctcacatatgtcttgtacagatttgcttctaattcttcttcatcaccaatatcatctaaacgttgttggtattacagttatcacttttcgtgtctctgacatcattttagcacctgagatgatgttatgctcttggcttgtgctcaggaaatgcttaatgaatgactgaaaaggcacttgggcttctggaggtgacttggtgacaaatgctcagtgtgatgttgtctttgtggcagatgctcattatgaggttgtctttgcctatattcaggcttggcaggttcttgtggcagcggtggttaaggattaaggcattgtgtggagtatggtgggggctgcagccgacaaccttcctgttgcctaaaaactttttctccttcccacccccttccccagtagctctatgccctgccaagtctgtgcacaagccttgaaatgacaaagtaccctttagttaattgcacaacggattgcctagagttaaaagttctgatttatatgactatagctctaactgctcaataacacaggcctgtaatctaccttcatttcaaacagaacggtgatttatagggcagcatgccgctttagctcagaaatgaggtgttcaacatatgcgctgttgacataaatttggaatttatcgctgttgtcaaaactgcctgttggacaaaggtgggtattaaggcaataaatggctcagaatagttttctgtcacatttcctaaccattgtattcagtctatttgagggaaaaatatatacttaaaagtaatcaaatgtccaaaatccatgcatcttgttttgaatggtgggaagggaggatgtagggaggatggaggagcatggggccttggggagggggagctggggggattgtggaggagaaagcttttcatgaagttatggcccgtttaaaaaagattccactctgcctcctcccccatccccatcgggaggtgggctttcctttctcatttacaaaaacggggaggaaaaatgaaagctcattaaataaaaatagtaaaggacatttttatgtgtgggcttaaaaccagcaatgtcagggaggagttagtgagtggggctgtgagggaggcagaacaggattttgtttatggggaaataaagcccctggccagcgttggtttctctgctgccttggtgagcgtgggcttgctcccacctactctcccaggttccgaggctcctgtgcacacggtgaatgtgtgctggctgatgagggtgaggagcggtgggtacccggctctaagcaatatgttctactccatccaaatcccgattgatttattacccactgtacagccaagatgcatccacccctcatccatccactaatgctgtgccctttgcaaggcttgagaatacaagatgaatgaggcaaagccctgtcttcatgtagctgcccatccagctggagagacagagaaacaagcagatgcaccctagtgagtacatctgctccaacagaaacacacttaaaagacagaggctgggggggaaagggggtcagctttgagaggggacagaggggagctactggggaaggcttctagggatggtactgaccctcttgcctagtgaaatgtccttttggaagtatcaggttcctgcagggagattacacaaaaatgtagaaaaaatacgctagtgacaggtcctccctccatcccagatgtgtgatgttgtggtcaggtgatcactgatgtgtgtcagtgtattgtaagagtggggccaacgtccttgtgcattgaggctccagcctctcttctcctccatgccatggaccgtcgctgcatcatctaagcacagggcacccaggcgggtagcacaggtggcttagcaaatgcagtcagagtcaaggttaagaatcgatctcttcattctgtttcaagattacatagcatgcagtatgttgttgggtattgtgttgcaccgtgagactgaaagtgtggatgtttccagagagccgctgcttggcctctgtgctcgttgggcctcgagtcactggtattatgcatttcctgtgtgctcgggagccttgcgtgtaaggagcaagaggagcacgcaagctgcctggtgcttttccccatgaaaatgaggcccagcagggaagaggattcgtatttgttgcttttattttatttttccttttatctccatgcccacacgcttggaccgtctcagcattgataaatgtgtgctctcacaaacatgcacacaatcccctttctctggcctgtgtgtttgccagacacacacacacacacacacacacacacactcccacgcacactgggcatggacaccaattgtaaacctcgtctgtgtggctcaccctccttttgccaccaacccctgtccttttcacacaaagctccctgttgggaaaactcataattttcacaccacacagccttgactggccattgctggaattactgtctctttgaagtgctttctactggggcatttacaggccgttttaattacctgcagcttgcaaagggccttgctctgtcccagcctttgtttgtttgttctttgcaaggagtctgtgtagaaaggaatacggctgacttcttttacaaaaaagaaaagggggtagaaaaagaagtttggggagcccttaacagagcttcttgccgcagcctgctgtgggacaccatgcccactctaacaaggccaggaagagaggctctcgcccttggctgtcttctcagcaggttccagcaccgtgggtcccactcctggagcttgcctgggatatttttgttcatgcgtttatgttttaattattattaagtatattttcaagctttctaccagagacagcaagggctgtcaaatcatgtttccctcactgttgaccaaatcaaagctggcttcagttgagctgggatccctcttatattttcaactaaatctgttcaaggaaggtgcattattaaattattgagtttagacgtgggctggagggtaggggttgaaatcacatatgtgaaaggagtgcccactttgagctgtctggtgtttttctttccttttcttcatttttcacttgattctctaaaaggaactacatataaatagcattctttggggtttctgttaaatatgagtgtagcatgtcatgtctgcagatgaagatgctagtttaccaaagaagcctcagaactgtatcccctttttggggggcttttacagcagaggaaatctttattcatttattcacttagtccaaaaatgtattgagaaattggaaacctcatacattgctgatgggaatgtaaaatggtatagctgctttggaaaacagtctggcagttccttaaaaggttaaacatagagttaccatatgagctggcaattccactcctaggtatatacccaagagaagtgaaaacatatgtccacacataaaacttatacacaaatgttcatagcagcattattcgtaatagccaaaaggtcaaaacaaccaaatgtccatcagctgatgaatggataaacaaagtatggtatatccctacagaggaacaaagtactgatacaagctatgataggaatgaagcttgaaaacatgctgtgtgagagaagccagaccccaaagggtgcatattgtatgataccatttatatgaaatgttcaaaataggcaaatctgtagaggaagatagtacatatgtggttgccaaaggctgggggttgaggggaggaatggagagtgactgctaatgagtacgaggtttcttttcagggtgatgaaaatattctggaatttgatagtgatgatggttgcacagttctatgaatatgctacaaaccagtgaatggtatacttgacaaggataaattttgtggtacgtggaaaatacctcagtaaagctatttagaaaagtgtactgaatacttactctatacagcacaccctggcatactctgaggttatagtggatggtttctgccttaatgtaacttatagtctagtagagataaagaatactaataaaaagctaatatataactgaaaattgtgttaaatgttataaaggaaatcaacaaaatgcaatgatggaaaattgcgttgatggacaacctacctagaagggctgtgggtcaggagcagcctgactttactggagtccagcatacggtaggcgcttaacagatatagggtgagtagcagtggggcatgagtcggcttgccttccctgtagaaggttatgaagtccctgcgagacccacagcctgtcagtagactctgggtaccatcattcaatttactttttttcttagaggcctctctgttcttgcttctattcaattagatggagaaaatcccaggaatgctctcggtgactcctttttagctgctggttttcctgcccctttcagggaaagactctggcttaggtaggaatatgaaggcagaccctgaggtgagaagtctggcgaagtctgcctgtttataggggcaagtaagtcatgtggcctcactttctccatccacaaaatgggctctatactgtccatgtcagccacagggtggttgagatgatcctcaggaagccctttcaaagtcagacatgatctataaatgcattaccttctttatcattaaaacctcagttggggccaggcacggtggctcatacttgtaattccagcactttgggaggccgaggcgggtggatcgcttgaggtcaggagttggagacagcctggccaatgcggtgaaacccccgctctactaaaaattaaaaaaaaatcagctgggcatggtggctcatgcctgtagtctcagctactctggaggctgaggcacgagaatcgcctgaacctgggaggcagaggttgcagtgagtcgagatcacgccactgcactccagcctgggcgatagagtgagattctgtctcaaaaaaaaaaaaaaaaccaaaacctgggttgactagatgttcttttttgcatttttctagaagaaaggaagaaagaaccagtaaggaagctaatatctgtttggcttttgctttttttcttcattaaaatgacaataatgtttacaatgtgatttggtacccgtacaggtaatccgttcaatctcttatcttgtgttcataattgatgtttagagtgatagctctccagctcagaatcctcatagaaaagtaatttaattttcagtgtaccaaagcagaaagaatgaggcaatatacattaaaaaggttttcagaatggtttaattccagaggaactttcttcttaggcctttaataaacctcagttattctcaacaatctctgagtttccatggctggtccatgggatctgaaggtagcattgtgtctccctggctagagtggaaacatataaaaatgatcctggataaccaggagacaacatttccttcgcatgtatccaggcagaacaaggagataaaggaaaagtctgtagctttttgaaaactgttttcccagaaatcggttatttgtgctggttaaaagccttgtacgggagagggagaacaaaaaccctgttcatccataaccatagtttaattcccttatagggccttttaggatctggagagaatattttggatttatttttgtttcccttgggctgacatcatcaagcatgcatcatggtgccctgttttgggtttggaaaaagctcagagaagctataaatcttaaagcattttactattttttccttttccttttctaaaagcacaacttttctggtctcttaaaagaaaaagaaaaagaaaaaactacaaaagtatgtattgatctcttcccctcggatcttaactgccctggctgtaataccttgcttacatctgccaggtttttgtgcagttttgcaacatctccttaatccagtgagcataaatagaacatttcaatcatatttggctaccaggaacttcacagataagcacgctaagaccttgttgaaagagactgtatgagattgtgtgcgataagatcatcctatagcccagtgcacaaatgaaaaacttttgttcttggtgaaatttgttgatagagatatttcaaataaatgacttaggagaacttagtattttaaaacaaaggaccggttacgtagcagccagaagcccaggcctcttggttctccacagccacgaagatccctccttgagcagttgctgcagggagattagtgtgcccctttgtcatttctgacattgtgttttagcactcgcaggcagccttatctgcaagtgctgtattcggtgtggtcatggccccagggagtgccattgtccttcctcatattttcaaggctcaggacagttccctccactcttcagtcagctccagattggccttcatccaggccaaggcaggatgcataggatgcatggctggctggctggcttgcttccttccttccttccttccttccttccttccttccttccttccttccttcctccttccctccctccctccctccctctctctctctctctctctgtctgtctgtccctctctctctctctctctctctctctttctttctttctttctttctttctttctttctttctttctttctttctttcttctttcttcctttcttagatggagtctcgttctgtcacctaggctggagtgcagtggtacgatctcgacttactgcaacctctgcctcctgggttcaagcgattctcctgcctcagcctcctgagtagctgggactacaggcacctgccaccatgcctggctaattttttgtatttttagtagagacggggtttcaccatgttagccaggatggtctcgatctcctgacctcgttatctgccggtcacagcctcccaaagtgttaggattataggcgtgagccaccgcgcccgcctgcctggctttctttctaagaaccccatagagagcttctcttttggacagtaggggcaactgttttttactggtgtgtgtgtgtgtgtgtgtgtgtgtgtgtgtgtgtatccgcatatgtgtgtagacaaggtgagtttttttccacctctacatttttctcttccgattctctttcttgtttgtttgctcattcagtcaacaaaaatgagcccctgccatgttctgaggtcagtgatgaagactgagaggatgaatctggtatggacccttatgcaggagatataatccagccagcacagacccatgtcagccccacagcctttcagttttgtaaacctggttggaaagaacctaagaaatcatctagctcaacctttgcattgttgcagaggtgtcaagtgaaatctagagaaactaagtagtttggccaaggttatttaatggatatctgcagagccaggtcccctgcactcagcccgatgtatatatatgtacacatatatacatggtcaatataccactgttttaaaggtgattcttaagaaaacacagctggtttggtattttctctctctccctttaaacggttccaaaacaaccaaatggccactgtcttccctaactctcctggtctggatccccagcagagaggcacctgctgtgtgctcccaaaacctgcagcatggaaggtgttaactagcactcagttagttcttggttgtttttcttaatctgttgtttgaaatccttggcttttattggtatatttactttatggcatacataaagagctgtattaaaaaataaattgtgttgtaaaagcattcggtaatgtttattaatattgactagtcagggagcaacgaactctattgctagaaggataatttgtggtaatacccgctaagcattcacagcttgtcaaatgactgtctaatctcaacattaaaaaaaagtgggcaaaagggtaatttcccttatgccttgagaaaatgaaagtgacccattccccagccaacattagaatgattgcttctttttctcccctgggataccaggcctcctttgtggttccaggcagtcccatggctagattttagtggttaggtatccctttgtcttagggtggttggaaattgccttgttagcaatagcttctcatatgtctgttctggctgcctggatctgtgctgaggccataaaagacagagataaagacatagttcttgcccccacagagtgtatagtcttaaggaacttataaatggcttagtcttgaatcttgaacttaatattcctacaaaatacataaggagaatgacactgggtgtgactaatggcctacttagcctggaatgtggtacttttggtggcatgaagagacattccttgggaagacatgatgtcacccttagaaggaagggaacattccccagagtatccctgatgccctatgaataacatggtctggcttagggtagaggccgctagtagaacaggctctgtttagagtattccttttacacaaaaagacacatagaaagtacaggagagctagtctgggcgtggtggctcatgcctgtaatttcagcactttgggaggccaagatgggaggatcacttgagcctaggggttcaagaccagcccagacaacatagcaagacctcgtctctattaaaaacaattatttaaaaaagaaagtacaggagaatggactgaatatggaaacactctgcagtctccctggaagttgctttggggaggaaatactgatagcctcataactttgcattcatcccttcctcttaaaattagagcacagaatgccgttgactatttcacctttcctttgtcatttgaattaaaggtaaatggacgttgaaagtgtgtttttgacttaaaggtctaaggaggaagagtgagcccattgctaaagtacataagctttccctttactcaattctgtgtctacttggaaaggtgaatgaggctagggcaaggttctcttatcaccgagcttaagagtcggttgcttttgcggctgagagcattggcagagctccataaagggacctaccttatgctgtccccacatggggcccaaggctgcatgtcagcaccaactgcccaggtcctgctcgacaggaccaggaagtttgcatggtggctgggtaagtagatgatcttggagagtgttggttctcatgggggcggcagactttttggagaagagaggatcatttaggtcatggctgggatcttacagaatctcccgtctgcttcctatctattctgagtacccctctgaagcactgagaaggtcaaattgatggtcataggatcagaaaggggtggtcataggatcaaaaagcccaaagcatcggggtgacttttgcactgatgaggtcaaattgatggtcatagaatcagaaagcaaaaacccaaagcattggggtgacttttgcatgtggagtggcctcatacctacaatagggtgagttgggaaggattatgtactgcattgatgtggtctgagtgttggttcagaggatggctcagttaggctgaaaacaaggacaacatcgtcttataaatgcccttacaggatggatttcccactttatttttcctcattcaaaggcgggagagagcagtgggtagtccagctgtggagccctcccattcacttttcccaattacaggtcctagttccccatgctggtctttccagcaaaactcacaggtcagacaatttcaacccttggattattggaactgaggtttctttctctaaaccttccctgcctgttggtctgctccaacttgagcatttgcccctgggctcaggaacctgggaagacatgtgacattggcagtgctgggacatgaacccctctctctcagctaggtagtgctcctgggcttttccctttgacatctgctagtgcagtgagttcttcgcatagccttccccccttggtccctggctgcataggatggaagtgggccgagcttaccctgcagagagtagacatggtggatgcccccttggggctcagctgttgtggtcagctctctctggaagctgaaggtagggaggatggagtatggcttgggtctctccttgctgccctttatgctgctgttgctgttctaggtaggctaggttgataaaggcttaccctgaagatgacaggttggtctaatggcttcatgcttctatgcagtagccattagccttctttgtatggactttaggagccacaggacagggtccagttttgaattggaggctgtctatgaagctgttgtacttagaatattgttaggatgagcaaaggaatgccatagatgccactttacagagagggatttctccagcatccttgatcaatcccttttgaacgaggcctcatgaggaaaggaaatataggcacggtctctgccattatggagtttgctctctaaaccagatgaaatctttatgagtttgcagactcacaatagcacagaaatggttcaaatgatgagcttgtatcttgctagcttcgttttactagtgagagttgtttggttgaaaaccagtgagaaggaatgaattcttctcttcagtttcttgtcaaaaggttcagatttgtttagcttgaatttctcataatgattcagctttcttgagacaatagaaacttgttagaggttaatgtgttctttgtctttttggacataagtgaaaatctgttacaagcaaggtgagtttacctaatgagccactaagagttggggagaacttgagtctgttccccaggaatggagagtgaggacctgaagcatatggggcaatggaatctccactgagtataggatggagatgcgtgggctgtactagaactgggttactttcaaaatggtgttcagcaaggtagcttcttctcagagaagagtgtgtgaaaactctaccaccaactaaggcagtgtgcagaaaggtgcaaaaatgtccccagatgtcttccttcctttcctgtcacagtggaggctgataatctcagatggccacgtgcaattaaaccttatgaaaagacaggactagattgggaagatgtgagtgtgtggtaaggaagaaggaggtggatagaatttccattttgatctaaatgctttgcagttgcataatgtggtgatggtagtggtgggaggttgtggtctaaagagggaatagactgtgagttcacacaaatttgcacttttgctccaggaatcggttggaattctatttccacattggctgttctgcagactgtgccatggagagtctactggtagccaggtacctcaaatgcactgaaatcctccaccattattttctttgaattaggagaagccttcacttttccacattcttcctttggtagatgaacaagaattaaagatacgagcaaaccagtgctgggctctgttgaactcccaggcctgtgaggttgttccctttttctctaatgaactttatgtgctttgcccaggtctctctgccagtgaggaaagacctttgcccttgtacttcatgtgaaatcacatggacaccatattaatctctggtaacctgtatggggcactgagttagtgggtcagttgcagggcagtgaccttaccctgaggattagacaggataggacatccgggtctctgaaggcagcgaaatgcatgacaacagagtcattccgaggacaggctggtggtaacttctggaagtttctttcactgaaagataaatagcaagtgagtaaaggaggaaactcaggccacttggattagattttaaatgactagattgctgggattgggtctagaggtttgcttgggcaatcctagcctggctgcctcagtgtcagaggacatcacaatgcaccgtaagaagtgggacgtggctcagggagaataatagtgccccttagaggaccacctggtaggctaggtaaaaggatatgggtaagacttttgaatgataaaattttgtctctattcaaaatatttgatgtgatcttcatcactttataggtgatcaaacacagagagattgtgatagcatgacttgtccaaggttaatggccgagtcaggtgggaggatgcaggtcttctggctgctggctgggcattcttctttgtaccctgccacctctgtagtaaaagggcaagtgcctgtcatctttcacaccaagccaatccagttggccaagataagccacttccaccaactgccaagcaaatccattcatacctagagaaaaggcagtggtgttacccaaaccaagagtgtttatcatggtgagggatttgatttggaaccctcatggagaagagatgggagccccagaggggagtttagcctggtggtggctcccaaatctgaagaccggtcactctagtgtccctttggaaaataaatccaaatgggtgttcgtcctcctattcctcttgacagccacccttcagaagtgggcactccaggagctaacaaacccctggtgaagaaaaggatgaaaataaactgaaacccttatgttgccatccaccagattttgccatgactgtgtgcgagttcacctgccaaaccccttatgaatagagcctttgccactctatagaagaacatctcttagaacagcaagtatctatcatgcccgggcaagtgacaggaatactccaccatcgtgtgtgtttgcatgcactcacatacccctaggtatgtagtttaaaagatactttgtccaaaatgctattaggacatgtcccagtgcccaacattgtgaaatctatttagagttaagaatgttcagttaaaatgttctgtactgttaatatttctcaatttgggtggatcagcatggcaaggagcaagagaacatgggggggtggtacccctacagtgtcatagataagggtgtgtgtgtgtgtgtatgtttgtgattgagaaatcatttgtctttggcaagtggggaaagggaaagcatgcaaacaaaacaatgtgattgagaaagagctctgctgagagaactttgtgtgatccctatcagaaggccgtacacagtggataccatatgctggtcctcatgctgtgggagcccattgactgtggctctagggaggctcacctgggtccaccacatggtcttgacacactgctgggttctcattctgggacttggaagggtgggtggctcggttttgctaccatctagatactgccagcttgagtgtgtaatactccctctccccacctgcagttttatctgttgtcagtaccagctctccagccttttactatggtcttaacacatcaacattttgatggagatagagggccttgttttcccttctgcctgccccaccgcccacagatccggcttctggctgccacgcctgccctgtcctgagggccaaggcccctggggacgttgcagggatggcgcagagactggggcggaggtggaggccagatcctggatccggcaatagcatgtatgggcctgacaacaggagtgtgggtgggcggcagcttggagcctctccccagtgctcggctccctgctagcgcacccggttccctgcatcttaccagctcccgtgctggctcgtgactgagctaggggtctggtgggagaggccccgggttgggggttgggagttgggatgggagcactgctgtaggttgggcctgtgaccggttgttactgggaccttggtcttcccaggggtgataacatgggcctagcccacctcacagaatcacagtaatggcaaaatgagagcatgtgtatgaagagctgcagatgactatgaccaccctacatttatagaatgatgttatccagtttcttgaaactctgctttctgttggggcaagacagagggaagacacttctaaagctgggccttaggggaaaggtgtgcatgttggggtgggtcattgcagtcctaagaacatctggatgccagagaagtatcttatgtctataagggcatcaatttattcacaggcttattcagagcctcctttgtgtcagtcactgtagtggaagttggaggtaggagagagaaaagatacaggtgtagccctcctgggtcccatgggctcgttcacagtcaccacccgggaaaggcagtgctacacagaggtgagcagaggctgtgggcctcctgtgaggtctgtgctagtttgacagtgagcattatgtctgtctgactgtcctgggtgttgcatccttcctccctctggaattggatctgattttttttcttggtccatgtgtcagtggtaaagcccgtggacaagaccaggaatgggtgcttcactggctgcagtccctgggcagagggcgtgatttacgctgtctgaggatccagggatgtgtttccatcggtgccctcctgttcccttccgcctgtcacctgccagagggatggctgccaagcccccaggtaggggatggccctgcctcttgtccagccagagcagcagcaacctctcttttcctttcccttacaggaagctgcacagtgggatgaagacgtacgggtgcgagctctgcgggaagcggttcctggatagtttgcggctgagaatgcacttactggctcattcaggtaggcaagttcgccttagtggcccgttcagatacaggcaaccatctcctgcttgcctttacccctcctcagagcctgctgtggcctgcatgtccccactgcccgctggggccctggtccatcttgttccctggaccctccctccaggcttatgacacagaagatccatcctgatggcggggccacttggatgaacccaccttcaagctctcgtgggtttcccaggcatcagtggcaaccagtgccctgtgtgatctaccttccaaagtagactgcagtttcattagtggaacagttgtggaattaggttctcactgtctaatgaatctgactattgggttcacattatacaggagcctttaattaaatggatatagaaaggttggaacacaaagctggttatagcgtgctgtcttttgcaagttaattttatacaattctattgaggtcgactgtgtggctgctggtaattttgctcatgtttgggcaaagctgctctgccccacgaggcgtggaatggggagaagcacctgacatttggcaggcccgagtgttcttggtggagggaaggatctagcaggtctgatgcggtggctttgaggcttaggtcacctgactttagttgtggaggcctcaactcttctttgccaggtgcatagtctcttccctttaattcccttgccttccaaccttggagtcattttttaggggagaggagagggctgttgtttcatttggtcttgtcttctcctcatgtaggccaaggcctgcctctcctttccccatattggctccagaaactggccctccaggcagtttggcatttgggaaatgggctttggggtcaggcagagaaaggttcaaatcctgtttgtaatatgtgctgtgtgaccttagctacattcatcttgtgaacctcagtttctgcatctgtcaagtgctggtgttgttaacttacataattttttggaggattaagtgacagaatatacgttgaaggcatctgtagtaagcccctggcatacagttggcatttaataaatgttaatggtttctgcttgcaccttcctccctcatccttgtttctgagcctgttgccccggggggcgtgtccccatccgctcgttccctgcctgcctggccgtttagtactgtctttcccctgagcccatcatgggtacagtcgtggaagtgctcttcgttcgctttttctgcttcagctccccactgccttgctgcagggcccatgtggttccgcattgtgttggatgtggtctctcccccggccctcatggcccttcctaaagcgtcctaactccttctcacttcccattcttccctcttccaggcgcacggatttgtccacagcaggcagctggcagctatctctctcagcgcgtctactgtccccatgtcttcgtgcattctgttcttccttcctgtgggccctccccaccctgcccctggctccactgaatcatcctcctcctgcccatgtgtctcacctcagcccagagccctaacttccaggcatttctgcgtccggatctgcttgacactcacgtacactttttcttctgttttagggacttacaccttgtatcttcatgcttcccttcagctttgtacgctacttaaggttcagagtgtggcgggtttcatgaactatctgcctaccaggttggctacccttcccttgctttcttggtcttgattttttctgctttagcccaccactgccttactgcagagtgtggtgcgtcctgccctagacccctgtgtggtgctgggcacttctggggcagtgcacttctagcctgttggtaaagcgtctttgccctctcagccgcagtaagcgtcctttcttattgctctttccttgagtccagtgctgtagccagactcattttcttggtttgctttatgggcttgttgctttctgggctctgtggctttgtttgccccattctgtctacttggaataacccatctcccatcttcccagatcttccaaggtcccttccatgatgccatccccagctgttccccacctccagccagaagcagtcgtgccttttctgtgcccatgtttctttatttgaagctatctttgggtgcagtttttcttctgtgttacagttatttatggacttatctctcttacttgggaggcggggttacatggtggaaggaatttggacacgtacctactgctgatgtgatctggggcaagaaccataagctcttacagcctcagtatcctcatctgtaaaatgaaaatatttaacgctatctcggagaagctgtgaggctcaccttgaatacataccaccatagctaacatgtcatggggttagatcctgtccacgttatgtccagcacactgcctggcacattattggtgccaagaagtatttgttgagtgaatgatgcagcctgggatgccgatgaacagggacactcctctctccggacaagtccctcctgtggtaggaactgtttatgtcctaaggactcactggaggggacagccaggagcccctggctcgtattgtatccctcttccaggcggtgtgacccagtgtgagttagccagtgtctctgctgtgaatcacacatcagcagcattggtggggctggtggaagcggctgcagaaaagaaagggttgcttgcatactcatgtcaggtgggcccggtgtccccagttcagacaagagtgtgactgtgcaactgccctgcggagctggcggttccctggggaagctgactttggttccacctgagatgctgcttccaggtcccctgatctcatatggctgctccagaggctttgggagttgggtcctcttttcctagtttttcctttccatgcctgtcttactgggcactgaaggctgattgtgtcaaatgatttgtccctctgctagtcacttgccaatgcccttggaaaggatgatttgatgattaggcaggtgcgatgagtcatagtagtgttttaattcacccttgcagatagctcacggcctatattctgatatttctattcttttttttctttctgttgtccggcatactcctcacctccgtgctgagaggtcttgaaaataaaatagcacaaagggcttagtgaggctagaccatttcctgaattgtttggccactgttaaacaggccctgggggcctctggagtgacctggacttgttggggagttggggtcagagggctgggctggtggctctgggtcttcttacagattccagtagtggtttacatgttctgatgcctgaaaacagaactaggtgatgttttagaagagacattgaattagatgatgtgaggttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcgggggaggcgggggggaggcgagcattttttttcaaaaggcgcaggctgtggagaagtgagtccaggatctgggtaggggttgtggttgcccccctaaatgttgctgcccttgcactggcacattcctgctgttttcttctgctcagcggagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctgagccaagtttgtcatcatacaccattaattttttttttctaatctggttggggtggggtgaaggaggaggcaagaaaagagtttctccgatgcttgagaataggccgcattgaattccgcagagatgtcatttctgaaaggcagacggagctccggcttgttcttccttcgcagtttttcctcctttctctccctgtcgtcctcctctcctcttcatttccctatcacgcgaaatcagcctgcaggagatcgacaatgcaggtcttattttcagtgactagaatactaaatttacactgctaaatcagttttcattgtgttgaaattgacaatttgtttaattagaagtttgccctgtaggaggcccttctgagagacagtgccttccctttttctctctcccttactttctgttttaagggtttttaaaagagcctaaatggtagtagtgaatttcagtttaattgaagttttaatttcaattcgaatgtgtgaattaatcaagtgtttatgggctatacctgatgatcacaataagtttaaactaactatcaataaccaaactcattaactaatgagatgatctggccaggccctgcattctcagaggtggttttgggggtcagaagggtttgcgtgttggggaaagaggcttggggtgggaagagagatgacctccaaggctttgcaaagctagccctgatggagggtgaagcttgggtgtaggactgtggcccttccccttcctgtgtcccaggaagactctgaaacctccctcctcaccctctgctaccttaccccttttggggatctggcattgaagcatctgttgatccactgtctcttcgccactccttgtcgtaacacgagaagtgattcctagctctgaggtgtccatgcagagaccacagacacatgcagtgactcaaattggttctgagatgggccagtgtaaggtttcccattaggtagatttcccacagcttggcttaacgtcctggtggcttataagtgagcatgcctagaactgcttgtccctatttttgactcggctgcatacgattagggtttgagtattcatgtggcctgctcctattctgggagtgtcattcatttttggagccagaggatgtttaataagcacgaattgtgtgtcaggctctgtgcacttaacagtgaagactgctacaacatccctgccctcaaggagcttaagtctagagtgggagatgagtatgactatgcaatcatcatacaagatggtaatgtgtgcaaagtgctaagaaatctaggagaaattcagagtaggagagtgttttgtgccagagggtaacagaacagcattttgaaaggactcggtgaggggaagccgaagccacctatggaagtgggtggtgtaacctgcgagtgtaggctgggcctgcagggagagagcagagtgcagggtttagaagagatggacgagatacatctgtggaaggaatagcaaaatgatctgcattctccctgaagcactggagagccactgaaggactgagtaagagggtgacatatttttgtgtctggaatagaagggactgttgggcttttttttatgtagactaggctagaatataaggtgaataaagcctgttggagaacttgaagactggccgtctgtgttggggtgtggctggagtgttgagaggcctgtgccttctgtgctggttagggccctgtggccccattctgccaggtgggaggccccatccttccactcctctcttgcccttgtcaggcactgtaggccctggctgttgagaagcatccctgagatgaggctcttccccagagttagagccatggggaaagaatgaaggctttcgttgatagattttctgatttcagcagcagcatggagtggctggggcttatcacctgggacctgggtcatcctcctggcagggaaaagggctggaggagtccttcagattggatctcttaggctttcctctgtcgcggttggacggaagaagaaaagcattacaagatggcaaagatctgtggcttgtccttgttctgttttatttatttattcttttttggagcactgagctgtgggtttcagtttcttctcctcaaagacagagaagatgggggaagagaggtagctggaaaattccctgtgactgggaggagacagtgcgaggtggtccccacgctgatgatgggagaggtgcctttgagtccaaagatggcttcccctcatcttgtctctcctcccattcacctctctcctcccagattaggtatctgctcagagcaagagacttggggctgcccaggcttgtgagagcccatggccaatccatgcaccctctgcccactctccagtcaataccagctatcccttctggttagcttcctaccatcagggcaaacccgggagatgaccaggaagaaacttcgttcatgttccttgactccctccacattccttatgtgggggcgcctttggtttttgggtcaaggaagtggagaagatcagatgggggtggctcagaggccaggctgccctcccttcggtccgcatgggtgatgcggatgcagagagtggaaagggtgaagggagccactttcccccagctcgctcttgaacacacttctctttctctctctctccctactctgaatttggcttgcttcccgaactttttcccagagtggtgtcgtcactggcctgccggcaggtctggatgttctgccagcattccagagagtttatgatcgcttgcagatgcgcctccaagaacacactgtacccaaagcagaaattaatgcaggcttgactaccgtccaagcccgtacacgggagagaggaaaaggaaaacaaaaactgtttaatgctgtttataaattatacactggctgatgaaaaatacatttctttcctctccccttttactctccccccaacccgtcctcagtccccccccaaccccacccccaccccttctcgctttctgcctcaagagcctaaactgagaccagaagaatatggttttgctttttagctcctgttttggctgggatccgaaaccctgctgctgattcacagccagagtatttttcccctttacctgatgaaatatactgattttccagcccagatggggtgtttttggttttgttgtgtgggttgtttttgttttttttggtttttgttttttggccagggattttgtttacagcaagtatcaggttccatgatggtgctgggtgcgatgctggccccagggcagataaatcccccacgtaactgccaccttagtgctgcggttttgcgtgcctgggtcccccggtcctagtcaggccagctgaaccgagaaagttgggaaagttcattgcaggtcatggttttaaacagtgttttcaccagttctctcccaccccttcacctacagcccctgtgtgaagagggggttcacatgtccctgcccccaaatacacatgtctctgtctccatatggtgccttagcaggggttggggaagctcgttccatctacccctctggatcccagcatctcctcccaccccgcaaatcccccatcccaatttattctataaatttgtttccacattatgtctatccatttacatggcttttgtgttttttaatactgctaatgtttatcgtttgcccaacaggctcgacagattttgcttcctgtagagcatcgaggctttagagccccctcgttgctaagtagcagtctccctgtactgtaatgggctgattttgtattctgttcagcgctgtatcttatttttgtatgcaagacaaagtgttttgatggaggacgattgcggcagtgtctggaggctgtttggagttttatgggctgtacagtacactgtgtgctctctgaacagaacacaggctgttgaattttggattggatttgtcatttttcccccctcagagaggagcctgtcagatagaacattactttgagggtggagggaagaaagtggaaattatgtaataaccttcttccttctccctctctcgatgatttttctatctcagcatagggtggtttcttccacacaaaccctgtctcatgccaccacatgattttgcacagctagaggatgacggtcttattaggaaatgaatggtgccctagagggatggatgctgggacatctgtctgtctgccatttattctcctagtctccctttcctctcctttgctcctgccatccttcctacgttctgggttgccttgctggtccttgttattgtctgaggatgaatagatatggggttattggggagggatatttacgtgggatcaacctgataatggcaatgccatttctgatttccagggccttttcgtcttcccttggcttcgcagacacacaccctgccggaagcgttcttaggaggcctggccgtgctttctcttgccctcagccccattccctagccctctaaccaggctgggcctgggtatctgtatccagggctgtgcctgaggggccccaccctgctttgggcatccatcacgctactgcggcccttactttcagtgctcttgtccaggtctctgtggtggcaggtatttatttttcagctcttctcttctccttctatttctccccaatctgctttcatctcacttcatctctttgtccctgtcctttgtgtctgtgtcagcctcggccttttcttgacactcctgtgtattttctgtcttccttcttatgtcttcatctgtctttgtctccatctgtcttcgttggtcttttctctgtctctctctttctctgtctttgtctctgtctctgtctctccctgcctccctgcctccctgtcctaacccaccacctcaaagttttttttagcttggaagctgggcagtggttggaatggaaaacaaaatgtcactctggcccagaggtctccccagaggggaggactcttgagccagtgtccctagaatgctcccagcacctagaatctcatgtgctcttgtcccttgcctctcaggggccagagtggggcttctctggcttggcccctgcttttcccaggtccctggatgttccccccaaatcccagttgtgttgagaatgggcaagtagtttagcagggttaggctttacaaggcccttattggactttgctggtactgtgctctcctgggccagtactgtgcacctgagtgcaggactcagcagctgccctcacatactcatgccctagcaaagtgcctggtacataggagtgttgtgcactgatagtatctgtcaaataaatgaatatcctgttataaaagtgtttgtactactagggcagatctgggtttggtggggcctgaagcgtactcagttttgggtgctgtctctcagaaaaggattataaataccaggtgttagagcctctcccaggaaaggggtcagtgccagggagaggcctgaagcttcagctttactggcttccgggagaacaggcctgggtgaaccacttgagaggttgctgttgaggggtctcacttggaactacttagtggggtggctcagggctgaggataggagggtgtcatctgcccagctctggggaccttcagaacctgggacatctgtgctcacaggcctcaggtttatgttccatagaggtcaagcctttggcaaatggctgcaggtcgcaatgggcctggaaacatcatggtatttcacatgctcttctcagtgaggttgcttggtagggatggaccctgagttccagctcacccagagcaaccaggtaggcagccactcttggtagcatcctggcctccacactaaccctcggtgactgtcagtgaaatggcatggcattcactcctctcccaggtgttcaactgcctaggtctgtggctgtggctctcctgcgttcttggggcatagaactgcaagtatcgtggggcagaggactggtctacgtgtgtgtgtgtgtgtgtgtgtgtgtgtgtgtgtgtgtgtgtgtgtaaccatgagggagagggggcctggaggtgatggaaggtgtttgcagacatctgggcatctgttctgtggagcttgcagactcatccattaaatgaggttggtgaagattgcaggattggacagtcctttgggtagagggactcacttgttggagggtatggaaaagctgcagtgtctcctagaaatcggggacacagtcctaatcagaacaccatgtgtgcatgtgtgtgtttgtgtgtccaagcatgggaacaaaaagagattgagaagaagcatttacatgaaatactcaaatttgttcctttgctgtaatgggcccgcacagaccattaccttgaagatttaaaaactaaatgagctcatcatatcgagtgacttctaccgacattcatgcttgattgcaaagcctgctttacctttgaatttcaacttcattgtttgttattaattctcagatggtggtggtgtgtttctaccttttggattcagccatgaaaatgttgattttgtgtgatggatgtgaacatttctcaacaagaccccactgaagaaccttttcattttaaaaatagccccatgacctttggggctcagactggagtttccgaggaatccagtgggctgaggcaaggcttgggttgactttggagggggcagaagtttgcatttttttgtctaataatttgagtttcatatgaatgattctgtgctccgtgcaatactatgcattttcataactgtctctttcactttgggtaaaggaagggagggaaaaaataacagcagcagcattctgtgggcaaaggaagaaaacaagagaatggggcagagaacaggctaaatttaaaattgtaattggctgacttccactggcttgcgggtgttttaatgactcataataacttcatttaaaaccagctgagcagaaaatagattggagaggagcctcgggccattatggatttgtggtttttttttttttgttttttttttttttttttttttgacaagcttggttttcagcagccaggaaggctctcagagagggcttggctgtgttttctctctctctctctctctctgagggttggtggtctgcccaggagagattgtatagaaaccagggcgagtttttttgtttttttttttttttaaattctccctctaccccttgcttttttttttttaactgattaaaaatagatgccttgaggtattattttagcatcagtaggatttttttcacctttgatgtggtaaatggaacataaataaaattgtttttgaaattactgaattaattaggtagtaaagcaaccacaatgcataaatgtccttggccgtctggtttttctccctaaccctgatctatatttgtagggcgttcccttttctccccagccccctcctgctctcccagcgacccctccttcctctgagcctgcaccttccctttgaatggcaagattcttttatcatcccggcaacagctaaatgattttttaaaatccataggattttgacagtattggttctatctggttatctgatcagctccaggagttttgggacttgccagaaaaggctctaacctggctctagttgttttaaataggtcctgcctgtttcccatgctaggcctggtgcccgaccggcgagcgttcctttttctcttctcttttgaaaagtcagccgactcagccctaggatgtgtctgtctgggcaggacaagaggccgccctccatctgatcgctcttagccatttatctatcccctcttatggcacctgtcaccttctttgttacatagctatttatttgcttggccttttttgcctactagactgtaagcttcttgagaacatgtgatttatttgtgtcccctatactacctcgcttagtaacctgaatggtggttataactcagtcatttgaaaaataacctaatgggtgagtgagcaggcatgcggatgggcacatggtaaggaacagacctgaggtgctgcctgcttccctccagccccaggagtcagcaatctggatgagaagacaaggatggaaggcggggaccttgtcagtagtgtgctctgttgcatcctcacagcgggacacatagcaggctctcaggaaatatctgttgaagaagtgaagggctcaggatgcatggtttggctgcaggaaggagagaaagacatttattgaaacttgctgtgttccaggcacagtgctatgtgttctgcatatctgaactcagtctttcttcaactttggaagacagatatgctgattccgttttgcagatgaggacagtaaagagttaacttgcctaagatcataaagctagaaagtagcagagctggacttcaatctccctctctttctctctccttccaccctgtgtcttgcttttctattatagtatagcatgctgctatacctagccctggcctcgtgctgtttgagtgcctaaatgcctgcttctctgtttgtagagctaaccaatctcaaactggggagctgagaccaggaaggccctgtgcccaagggtcctgggggtggggagggtggcatagtaattggctgctgcctgtgtgccttgcacctgtgccaccaggagcaggtgtggcttattagcctcttcctgctctgccagaggagcatgtgttcagtggttgtgagttgtggctatgacttctgctcagtgccttgtagggttggggataggagggttctgggagccttgcaggagggtctgtgggttagtgtgtggccctcccacccagggagagcttgactgtgtcatgccccccactcctcctttgcactatcctgccaagtaggaggggtaggaggagagagctgcctgtggtccctcctgcatggcgacgcaactgggtgctctgcttctggtagatgcaccctgtgatgctggggtggggtgaaaggggcagccgacctgtgctgcagcccagaaatgtgagagctgtgaccacttgggctattactagcgccttagacttcaagcgtcttggagtatgatgcatcaggaaggttgggcctccctgacctttcagattatgtccagtgaagctggaccacttgacatgaggctggttgtgtccattctctgacagcctcatcttccccaggcacgcgctggggatgctggagctttctctggggagcgaaacatcagccaaatgggaaccagatggtgaaggttgagcagcagagaaacctcgatgactactctgggtcacacgtgtggccctcttttgcaggaaatcgtttgtgaagtcattcatcagttagcaactgaacctagggccagtggtgtgcaaagcttggcagggtggacagaggggttgaagccagtgtccttgtctgcaagaagctggtggtctggctgagagggtgacacgagccccctggcaagagaaggcgttgagcaaggctgggtgtgctcattgtgaccgcaagaggaaagactgagtgctgcaggcatttagagtggggagaagctcctaagaaccaggggaatgaggagagcttcgggaaggaggttcatgggattttgatgaggtctttgctgctggagtatccagaaggagtgctgtggtgggagtggcctacctttctggacaagaggaagcaagaacttctgtgagctagaaccatccaggcaggcatctctttcctcctcatcctcctccgcccatagccacctggcagagacttagagcccagtttcttgcacttgggagtcctccaatccctgtgatggctgtgggcctccttggcctggaggttgagaaacactgcattaaagatgaaaagctgccacttcagggggcccctccaagttgaggcatccataaaacaaacacatgtgaaagcaaggcttaaaattggatgcggacccagaagattgtaaatttctcatataggatttgatggactaaaaaatatgttacgagtacctagaaccccacaaagcctaggttgagaagacaggtcagagggctgcctctgggtgaggctgaggacagagttggccaccctggagggccaatggaggaagcatccgaggacggtctcaggacgtgccccagcccacctcctcggaccacgtgggtgaagcccctgtgtatgcctttagtgaagactgagcttgttcaccgcgtagatggaagccagtgggagagaggggcggatacctctgtagtcaggggctccttttgttggctctctccaggattcaacctgacaaagacatgtcttccagacttttccccagtagttaacgcactccctcctccttcccccaaaccagtcccgttttgattggaattctttcacttgcctgggacaaggggaaaaaaaaaaaagcaaattctaaagttttcattaggtagttgggataaaaagtcttctggggtagttggattaaacttcagcagctctcttactgactattataagctaattgagcacagggagctcattggcggctgcatttttgttggagtaattatgaaagaccacagtcattttcagtaacaaggtaactccgggtaaagacagaactctctgaaactttggatttgctggagtcttccttcctcagttgcctttgctaatatgagcccgggataaaggcccagagaccagatattttgggaggctactatcttgcctgaatatcccggatctcccagtgccttcattggggcctaatggacataatccagcacatctgagagagcactgctggggggccagttttgcattaattgagatttggggtctggagtcagaagctctggagtataggctcgagagggacaggtgcagcctttgaagctgacccgggagcaaagagaatcacagtgcactgtcttcattacttatttatgcaccaagagcagggtctgattatagataatgaggccgaatgatactctctgtctctaatgaggtcctgtctgtcctgtccgagcaaagcgtggaccagcgtatgtaggactgtgatgacaaccctggggatcttttctagcccataggattcttgatggggaaacattcctagacatacagtcctcccactgaactccacccccatccagaatctctatcaggagctaggagccggctcagtgggctgggaagggcctttcagtgccctttggacggggccctggggccttgccaagctgaacgtgtcctctgggtggcctgcctcacctctggcctgctgcccatcagcattgaatcatgcccctcagaggacagcatgtaactgtgcttcccgatatagcccccggccccccaaggtgacaggaagagtcattgtcacgggagtactccatctttctgacaccacaaggccggcgtggctttcttccctactgctcagccctgcacagcctagaattctgctttgggagcatacatagagttcacagagctatttttttttcctactctccgtctcccactttagttttcagaactttatctcagtctctggcacggactatctgcttccttcctccatctcaacattataaaagtttgtcacagtcagaggctggctgaatcgaagcagaaatgtggtgtttggttaaattgtaaaattagctaggaaagttaatgaggcgttccgcctctgcctgctgaagagcaggacgtttatgaaggtgcttcaaagcaccctgcctgagaaggaaggaaagggagacaggagcagcaggggaagctgcccaggagtgtagaagagcctggtccaggtgagtttccaggccttggacgtgcctttcactcgcttagctgaatggaacctgagaaatcatcccctcaatcctcctgctgtgggtccagctccatctacccactccgagtccataggagttccctactacatgtccaagaatgtcctgcgaccgcacacagctggccatggttagccattctagtgcccagatttcctttttgtcctgggcaaggcagaagagacaaaaactgaacactttgccttagaaggagcccatggtagaaaggaggaaaccagagataatgacagtggcagctgacatttcctggaggcctacaggtgccaggtactgtgccagattgctttacttcgtcatctcatttgagcctcacaagacccatttcaagttggtactgttaggacatccattttacagatgaggagactgagtttacttgcccaagatcacctagcaagtaagagacagagctgcgctgtgaccccagggctgcctgaccctgaagcccctggtcttaacctctgcggcaaagttgtttccatcccctttccaggctgcccatttctcccagcccacagctcacgtggtacagattgcacgtttgcagatgctcaccctgaagctttggaagtcacggtctcaaaggtgcacgtggaagagctgccaacagtctatttcctgcacacaccaaactcgcaggtcttctaattacaccaaacaaacctttctgttttcaagcagctatgggcttaatatggcaaatagtttcccacctggacctctggcatgggaggagccagaaaagacgagttttgttttgttttggtttgtttttttccggcagggaggtggttcgtacttagaataggcattaagtgtggcaggcaatatttctgttttgaaaagtgtggcatcttaaggctgctgaattttgagcctgcaaatgtcagtgccgtagttgtaatgtaacacctcaattatggtgcagggggtaaggaagccagactctgaaacctgcaaggctctttagatccacagcctgagccacaattaaggtttcagaaacaccaaaggcaagccaatgagtgtcatttttaaccagtttgaacattttactacttcctaacatcagaagcacccgggctagagagcccgcttcttgtcctcaataaagtgattaagctgaatgggtgttggggagtattattaggctgagaagggctaaaaatagacatgctctgttttctaaaagccacagcaggcctggagagactggcagcatcgaggtgccactgaggggcccaggggaggggaagggagggtggcagtctctggagctccgtgtctgagatggggatggtgggtgttgtgacgggtgggtcaggtggtggggcctctttcccagctgtcaccaagagtggaatcacagtggaagcacatccgtacccgtatatgtgtattaatgactttaaaggaactgacaactctggagtctctaggagggatgcctaggcctaaaatttacgtactcagccccaagataattgaatttacctgctgttctgggagaaggagtccaatctgggcagtgagtaaagggcagactataaggggcacaagaagagggacatggggaagagcagaggcctttacagccgagagtgaggatctgctcgacaagccttgattaactaggatgctcagagaagatgtaatcaaaggactttttggtgaactgaaggttaaccaggaaaccttgtctatatcggcctttgtcgtttgctatcattcatcaatgtgagagtccatttttctactttcagtgaatgcaactgattgtctttttatgatagaacatcttgcttgcttagaagtcaaaaggagaatgcctaagaagggagttaagcatggaggtatatgcctagagttttattataagtcactctagaagatcgtttgtacgttttccttcctacatgttttcatacctttgaactcattcctctctataatagctttaagtgctgggaggggcaaggaacatgacttccactttgtagatggagaaacaggccaagaaaagtaggatcttagaatacactgaggtctacgcagaggcaagtctagaccctgtgctgctcccagcccaggctctgtcggatagacagtgttgtttcgtgcctggaccaggaggtgagagtttttcttaataggcaaaggactcagagaagagagttaggtgggcttcccatgctgccattctgactgaggttttttttttttttcttttatgtttactagctatgagaccttgggcaagagaactaagctttttaaacttcagtttgcatatctaaggccaggcatggtgtctcctgcctgtaatcccagtactctgggaagccaaggtgggcggatcacctgagatcagaagttcgagaccagcctgcctaacatggtgaaactccatctctgctaaaaatacaacaattagccgggcgtggtggcatgagcctcctagcatctctctccaatgccacttgcaactgtctttgtagtgtgtatgtgtgtattttgtttctaagataaaacatctctaggtaatatttcaacaaatgaaagaaataaagccttttagaaggctcctgatgctgtcacaaatgtgataatcattgcactcttcaagaaaccaattggcagagctctgtatgcaagttatctgctgacaattggctgtaagctgtacaagccctgtagatgagagcttctcttttcctggaaactccaccaggaagccgtgccatagaccccaaagacatccaggtcaagctgcagggaagaggcagggttcagtaggcatagaaggctgtctaagctgggcccgtgctcccatcacaggcagtttagtggagaacctgggctggatgttgacagaactgagatgttagctcagctacccactagctaaatcaggagcgttagcagcttaactctctgagccttggtttcttcacctgttaaagagatgatgatacatccttcctatcctaaaagcaggacttcaaagttgcacaacagcagtgacaccactcactcagaaatgggactgtaaggttgttgaaggtttaaacaagatgatgcacatgaaggtgcccagcacagaaagtggagctcaacaggcacacaacaccaatactttcactccttcccttccaaggaacctacaaaggctgccctgcaataaggagtcacaatgctgctgctgccatagtgttgacagtcatcacaataaaaatactaataacatgtgttgcccattcattatgatgcaagcattgtgctaactactttacatgcaatataccagttaattctcccaacaactctaagattaccccccattttatacatgtgcaaactttttttttttttggagacagagtctctttctgttgcccaggctggagtgcagtggcgtgatttcagctcaacgcaacctcctctcccgggttcaaatgattctcctgcctcagcctcccgagtagctgggagaggacaggggattctgagacccaagcaatgaaggaattatcaatattgagatgccaaagagatctcagcattgtgagaggactcggcattctcttcagtcagtgggaaatgagagaggcagggaccagcctggagaaagtgagggaagccaagaatgccatcgagactgaggaatgctgcctcctattccctttaaaatacctccaatgaggtatgtcatttggcaggagtgtcaggagatgctgggggaccggggcagggccaggttatcagcttgaaatgggtggagtaggcacttggatcccggccaccacccttggaggggtcttagtcttcttttttccattgcccagccagtattgtgaatcctactcaggggagaggggtgtgtgtgtgtgtgtgtgtgtgcgtgcgtgtgtgtgtgtgtgtgtatgtgtgaaatcctccatgccatatttagggtgggggcctgtgacggagcattctgaagttgcttcagaagaaaggagcagaatagatgaggatgagaggagaccgaaggctcagatcacaggctgagctttgggactgctgggggccaacagaaacttctcttttcattctgaacttctctcctgagaatccccaaggggagacctgggaggagggtgattgttggtgtttaggagttgcggagatgtcccataaaatcatggcagaaacccttactcttatatccctggctttattatccagcctctcacaaatgccaaggttgcaaagctatctatctctcttaaacaaaacaaagttatgaacacttgaaagcccaggtattccctggaactcgggtcagtctttggcacagccgcactgacccagcctgactctggctaatgattctcccaatgtctggactctctgttccattctacctgcctgatagagcagaatattcaccttgagaaggattctgctggctgaaccggggaacccagccctcgcttggtctcaacagcaccttccaaacaccaagggttgtatgcatttgagctctcgtgtacggccacgtttaactttctttgccatgagcgcccagcttctcatgaacacctgttcatcctttctcccttagagatgtcccagtttaaaacttgtcatttcaagatggagagataaagggattcaccaagggttacacagctcaggcagtgacagtcaggaccgcaagtcagtttcttttggtactttggaaaatcttgggtgcgctggccagcagaaccctccttgagccagttatctaccctgtcttacctaagggtggtcctgtctcccattccagatagcataatatcatgtatacgagagccttagagaacatagtgtctcatttatgcaggccatttacttattgcgattgggcttctcccagagctgtgggactggaaatactatgggctgcataccctgtaggctgtggccaggagctgtcctcctggagctcatcagcttgatgaagtgaaattattctataatcatgataatgactgtgacttgagcacctgctatgtgccaggtacttcatatagtttcttgtttaagctatcatatgaggatgaatagctacattttcaggagggaagtgaggctgcgaagttgatgctggtaccgtaccggtagaaccttaaagccgtctctggatttgagctgttgctgttgccaggctggagtgcagtggtgcgatctcggctcaccacaacctctgcctccggggttctagcgattctcctgccccaggctcccgagtagctgggattacaggcatgtgccaccatgcccggctaattttgtatttttagtagagatggggcttcttcatgttggtcaggctggtctccaactccagacctcaggtgatccgcccgcctcggcctgccaaagtgctgggtaattacaggcatgagccaccgcacccggcccgggacttcattttgagggggcctgaccgttaacctccgagagatctctcagttggcaaagcatgtctggaaggaagtctggttcatcacagcagggactgacattcctgtagtaagagagattttgtgcccttgtgctgactaccacaataccatgattgctcagtcatagaagttgccaggagaagaaagagattagaagcaatggtaaggtgaacccctgagtcactactcttagacttcaggaatatttgtaattttttttggagacagagtatcactccgtcacccaggctggggttacaggcacaagctattgcacctggcctgtatttttaaaaaatctgcaacaaatttactatcctacttgcattttatttaaaataattcactcatgtatttttaaaaacataaatcatctcaaactggtttgcattccctggttcccttctgggtaggcagtaggagggtaataataccattaaacattggccatgagtgatgatgggagcagacggtaggggtgtcatttccttgatctcctcctggggaagaatgatctgaccccatctttactggtgtgttttggctggagaggtaagaatattttaaattgcgtgatatatctcttgcatgcatttgatgtttgtgtgtgtcttataccttgctattattttatctcctgatgacaatgatgatgttggtcttaatgacaactagcatttattgggctattattgtatgccagacagggtattaaacactttacatatattatttaaattaatcatccctcaaccaaccctgtggcataaacactctgagcccagttttctaggtaagaaacaggcccagaagagataattcacttcttcagggtggtagctagacatggtagaactgggacttgaaccagagtttgtttgattccagagagcgtgctcttcactaccttactgtgcagcttaatattgagtgcatgtgtgtgttctggctgtggacagtgtttctaagcctgttggattacccgctggtgctaaaaggggtaacaaaagagctttccaagccactctggctgagaattgagttgcagggataagggacaaggtagacctgtgtgctccctgtgggacttgagagagggactgcaggatcccagtaagagacaagggcaccatgcagcttcctagtagcatcacatttattaggtaggataagaaatgttccctcagccatagagatgtctcagcatttcctcctgacccagtccagggtttcctcttctgcagagtggatatttagccacacatgaggtgtcagtcatttgccaggtcactggtgggacactggcttttggagatctaaaaaccacctgtcctccatcccaggtgactcccgttgttctgttgctcagcccaggagaattccctggtgtctttctccatcctatatttatgtggggtcctgtatcattagttcattcaccctcccatcttgtagtgagtgaggccgaactctgaggatctttccccacagccttgtcaaccacagctacccttgaaccatatcctggacctatcaatggggctggttgttttcctttcagccaggatttgctcacctgctttcccttttccctcttccctgaatctgtgtatcttccagaaactctggttctggatcagctttttgttttgttgacaaaggagaaagagcaagagagagagctagagagagagagagagagagccttcaagctcctctctgggagtacacatctccttgagggaaagaacacacagtgccggcctttggaattggcagccagtgtgctgttctccgtctgataagaggtactgtaaataaaactgtacaccatggcctgttgtaaaatgccctgcgtctgtactcattgttctgacagcttatgctttttttgggtctgctgttttggtacactctgtacttccttatgtaagcaggcgtgcagatctcatcagaacattcaagatgtttattttaaaatctcaaggaattttgaaaaaaaggacacaccactcaacattagatgctggcaaacattaggtgttttttcagtggttcttttttttctcccttcttattattagcatgggggtgggagaggctttggagagggagggatttgaattttttttttcttccctcattggcttctgccttatttccttcagagagacaccaccccatatctgattgcattcagtgtcttctgcttccttcctggatgccgggaccccctcagcctcatttctggttagggcaggtagggagggaggttctttgacaagggggagagggcagctgcagggagcttgtcatggcttccactggatttcagctttattgtcattgggatcctgggcatttagagaaagctttatgtttttgaaagtgccctgctggctgttccctcctttgattcctgtgagttggggtgatccttggcacagagggagagctgctcccacacacggaggcctcagtcccgcctctggcatgtgcgtcctgtctttccaccgaactttaactggctttgaaccttcctccttcctttatccccaaccttctggaggtgtcgggaagtcagggaaaaaggggagaagagtaggagtctggagaacccaaaatggtcagggagctccctacagggtggtgcttagaacatcccgaagccctcatctgcagggtacctgggagactggtaggggcaaggatgtccgcctgtctctttcacaactgggtacctggaatctcagataaactcagtgcctggggtagggagtagtcactcggcagatcactgcctggggggcaggaggctcactgactgtagcggagggaagggttgtttgttggctgccacagtgagcattggactgggttgggagcagacatgctgatgagagggagatctcacaccagaagaagcagacagccccacttcctaacctttcctcccttttcctctcaactacctgagacctagccagagaccatgtccttgagttttaaatagggggtagtagagaacggagtgtgcagaataaggactctgccaccccctaggggacagacagcttggcagtgccctgagtggccattgcgcccttcccaggtgagttctgcacccaggaacctgcctgggactttctttgtttaacaagcatttagtgggcacagactgtatgccaggcatggcgcagggtatcagggatatggtaaagcccaagacaggtgggaacctgctctcacagagcttacagtccactgggaagatggaagagagctccaaatacaggacagttgaatggggctccaggggcttgtccagagaagatttcagagccaggttggtgaatagctgctgatactgacatattggttcgatggcagatttttctgctcccctcaacaaaacaatcactcatctttaaattagaggaacaaggtggggtgtgcatgtgtgcgttcatgtatgtgcacgtgtggtactgtgtgtctttatgaatgtgagactcactttacacaagataaatggcccccaaataactgtacatccaattccagtaaaatcagtcatactttaattgcatgaagggagctctttctttaaaggaaaagtgactggagaagatggtagctgcgacttactggttctgtatatctacccaccagctgtaggatggagcactttccccaccttgtcgcaactctccaagggacctccccttactgcttccattttacagctgaggcaacaggctccctgagactggcagcttgctgagggtcacagctggcgactagcttgcctgggatttgacctctgatctgtctgacccaaatgttgagttcttaaccacactgcactgcctcctgaggtataaatggcaccaaggacctctgctatccacagaatgttttgtgattgacaaggagttttgtattcacttatgtctattatcctgtttgctcctcacagcagcctcagggaggcagacagataggcttatgcccattttacagattgggaaatcagttcatcaaggtgtgatgactagtgtgatgcccacagctgtgagtggccaagttaggcgtgggatctcgtgcctgcacctctagatcctgctatttttctcggtttgcttggatctgtgattgctgtggttagcaagggtctagcgcactttatcttctgctattctccctctgctatttaatttctttcccgcaatctatcccttaacttcccccagccccgcatctcccacctccatgtcactccatcccgtgcagctggcctccttgctcctcttgccttgcctggcgagggtgttctcacgtggtggccttgctctatgcagatgtcagtgcatcagcaagggcctccctgactacgctgtgtaaaagaacagcccctggcactctctgtttatctttactcaatgctttgttgttgttattgttgttgttttgagacagggtttcactcctgtttcccaggctggagtgcaatggtgtgatctcagctcactgcaacctctgccttccgggctcaagctattctcctgcctcagcttcctgagtagctgggattttaaatcagccaccatgcctggccaatttttgtatttttagtagagatggggtttcaccatgttggccagcttagtcttgaactcctgagctcaagtgatctacccatcccggcctcccaaagtgctgggattacaggcgtgagccattgtgtccggccctcttcatttaatttatttctctttttatcacttatcaccacctggcctgttttgtatttactcgctctttaaaaatctgccctcccatcttgaacataaactccctgagggcagggatttcgtctcttttgtttatttcctgtaatccacctctcggcatatagctactggacattcaaaaaccagcccccgtgtgtaggaaggatatggcaagtcatggccatcccagagctgtgtccctggagttctccctactccaggttgagccccaggaaattttgtgggtgtaaatgctgctgctaggtccatgcgcacccgctgtgttcagctggcgtgaccttcttccctcccacttcgccccctcccattgatgctttataaatgtattagtggctgcatgatgtcaccgtaatgcattttgggaatagccatgtggtttatacacacttgagttgctttgaatgcaaacctgacatcatactgaaggcagcagtgaacaacatatgcacagtaaacaggcagagactgtcttattgattaacagatgaggcctctattatcgatcaaagcttggcgaggaaatttatcacttttaatttcagggctgccaaatatttctgcctctgagccagccattacagagaccatttaaaggcacaagcctcctcaggagagaggattttgtctgtctcgctcggctccgctcacgtgtccatggaactgcctgtctttgctctcaccctggagagctgggggggaagtcagagcctgtccgggtgggcgtgggagtactggggcttcgtgagtgggggctagcaatgggagctgacgtttgtgttatccacgtgtaaggagggacctggcccagagtcactgaggacaggggctttcacatgctcagctcagtgtcgtgacttcagcgaggtgggggtggagtggcgggactttgaaggcaagcagatgtggtcaggcttgggccgaggcagccgcctttactgatcatgtgtgcttatctgtcttcatcttcctctgcacttgtctgatggtacacatccggccctttatttcctacctggcctccttcctttctctctgcttctcagtcattaaagcgagaagctcctctagcccacagtgatggctgttttctaagaaccctccgcgccacatcccttggaagcctgtggcatggtgggcttctcgccgattggagtgccctccccttcccagctggtgcttccctcctcgggcctttgcttcccctttctcctttagggagctgtgagagcggatagaacccaaggaagaaatacaattaaaatcagattccttacagatccacagaaaatcattgatggctgatgatttgggactgggggcagtttctaattgtgagggagctgtgacttcatccagccgcagctttcccatccaggcccactctgctcttggaggtgctttctgcatttccagtgtaaatggatgaaaggtagtcttggctgctacccctgtgaacacatgtcatgactgctttgctgtcactgggggctagaagttttcttggctctttcttcaaagctctcttaagccgtgtaccaggtgcttggcctgaggatgccctgtggcgtgaagggacacccagaggtcaccatgggattctccctgcctccaggtgaaattcaaccccagccacctaaggcaaatgacaatatttatttttaaagctcttcagtaaaagtgagttcatatcttccatggggtactttatcacccacttatccagccagtcgactcacatttattgagcacctactagagtatatcctgctcatcagtagaagataggtgtcagtgagatagagaaagtcgatacccccagaggaccccacattctagacctcctctagggtcctcatattcttcactgcaagaagcattcattggtattgaagtctgtgctggaacagcttgtatttggagttacattccttcagtatgtgctgattctccaaggcagaggttttcaaatttctagaaaagtagtggagtcatttttccaaccccaaagccctgatgtgtaaaataggtaaattgaattttcattcagagatgggagctcagaccccacccatggagtcttatccacaaaacatctttgcagatggaaccccagggaggccgaagggtacggggattactctgaaatcaggctctgaaatcaggctgcctgtgtttgaattcacctttactatgtcaaccactgtgtggcattgggcaaagtgcttaacctctctgagcttgaatttactcatctgctacctggaggtaatgctagcatgtactataaatggtggttgttgggacaaaccatacatactaagcatttagtgtcatgcctggcatatagtcaagcctcaggaaatctgaggtgatttgaaacagcactgtgggctacaaatttgtgtaacaagtagttctggctcgtacgaggctccaatacaaaactaaaacacaggcatatttaaagaagagctaagatgaccagacacagtggctcacacctggaatcccccagcactttgggagaccaaggtgggaggatcgcttgagcccaggagctcaagaccaacctgggaaacacagtgagacctcatctctttaaaataaataaataaataaaataaaataaaataaacaaaaaaacagaattagtcaggcatggtggcgtgcacctgttgtcccagctactcaggaggctgaggtgggaggatcgcttgaaactaggaggttgaggctgccattaagctatgactgcaccactgtactccagccttggtgacagacagagaccctatctcaaaaacaatgacaacaacaacaaagcgctaagacgtgttgaaaggaacagagtgcagtggcagattggaaaggacagaagagtaagggacttgagtgcttgatgtccacaaactgtggccttgaaaatgaagtgggattcgaacagatggaagaatgggactgagcattgctcaggcacagagactctgggaaggtaagtggtgcccagagagggccggtgaggacagcttacctatggaggtgggtggctaactgggacaggttatggaaggccttgaagccaagtagaggaatttagaatcagtacacattgggaggcgttgtatcttcttgagtaagaacgtgtgaggaatcaggtggctgtagaggaacctgcatctgttgagtagattgcgggtggctggtggtgtggaaaccaccttgcgtcttacagtgttctgagtgtgacgcagcaagggcctgaatggggtggtgattgcagtggaatcactgcacccaacgcagtggaagaatgcatctaccagacatcttgaaggaaaaatgccaagacttgtgacagctgacccctggatcagataatatagtagagccatgaagactattagccagtgataaaaagtactgtttcatcttgacatggtggcattatcactttaagccttctaaataacagttctgagaaagtttattaaattgagttgcactgaattaattttatttattccacaaatatgtatagtaataggtttccagtgtgtgtcaggcagatgcagctgtgcacaagacgacacagtccctcctccagggagcttacggtgtggtgagagagaaagacagggccataggcatttaaaatggagcacataaagggccgagagctggaacatatcaggtgctatgggagcataaaggagcattgcctcacctacagttgggggcccgggtattgaagttgatgtatgaatgacgaacaggagctccaactgcaccatagcagccagagaagcatgggagaatgtcagaggcagaggacatgcagaagaatatgcacaggcctagcaatgggaagaacacggttcctccaggcagcccgcgtggttcagtgtagctggagaaaagagagcaagagtgaggtgtgagagacgaagcaggaaagaggagcacacccagaaatgctttgtgagtcacagtaaggagtttggaccttgttctccaggcacaggggagccattcaggggttttaaatggtcagatgcaggtggcagttgggggacagacgatgagtttagttttggacacactgagtcagaggtccccatggacatccaggttgaggtatgtcagcaattcttacattcccataaagtacagtttaggcaacagggcacatttccctgtgttggtatcatttttctcctgtcccccccatcacctggagctaggtcttcagatcctccttcttcttgaggtatctaacttggaacccatttccgtttatcttggttgttctgattttgtttctccttctctctagaagagccctagacaagggcattcagaattcagttgggtgaatgctcacctcttggaggagggtctgagccatggatgatccctcactcaggatttttgcgggtgtccagtccccttccctagtgtctacctgcacagttgtggcccaggacctccccgctcaccagtggactattgctctagtggtaactgcctctcctttctttcagcgggtgccaaagcctttgtctgtgatcagtgcggtgcacagttttcgaaggaggatgccctggagacacacaggcagacccatactggtgagttgacttggattcctgttctccaggttttccacagtgttggtagcacatggacatgaactgtctgggtggcaacctctttttagcaaatgtgacatccagtaatttcctgggcgagctgtgagtaggatgggcttctgccacgttcagctactcttgtctgtgtggctggcccagcagaagtttacaagtatgacatggccccatgagaatggctgtcctagattaggccaagatctgtctctaaccagccactgagagctcatgttcttggaggtatctagtatgctcttgttgaggccttagtctgtgttgttatcaaaacatcttcttcccttggtcaggaaatctctcacacccatctgatgaaactgaaaccctcgtgtggccacagttggctggtcctccctctgcgagagctgagacattgtctaaaatcagcgtgtacgcaggatgcatttgaacaatattaactcacgatgatagagctttatttgatttcaaagggattgatttcaccgcaccaaagtcatctgatcattgtgatcagagtcgttgtcatcacatcatcacagcagctcacacttaacactcacagtgaggcaggcactgttctcagtgctttatgtcaggggtccccaaccctgggatcatggactggtgtctgtggtggtctgttaggaaccaggctgcatggcaagaggcaagcggtgggcaggcaagtgaaacttcatctgtatttactgctgttcctcattgctcgtattaccacctgagctcctcctcatgtcagagcagcagcagcagcagcagcattagattctcataggagcacaaatcctattgtgaactgtgcatgcaagggatcaaggttgcatgctccttatgagaatctaatgcctgatgatctgtcactgtctcttgtcaaccccagatgggaccatctagttgcaggaaaacaagctcagggctcccactaattctacattatgtgagttgtataattagttcattatatattataatgtaataatagaaataaagtacacaataaatgtaatgtgcttaaatcatcccaggaccaccctcctgtactccgctgtatgtgaaaaggttgtcttccataaaactggtccctggtgcctaaaaggttggggaccactgctttacgtgatcccatctggccaatctctcagtaaccctgtaaggtaaggttggaagctactcttatgtcatagatgaggaaactgaggctgaaaggagggaaagtgacttgctggagttggtagtggggacaggcgtggtagagtcttatagttcagagctgagactgcatgggtttaatcctgactctgccacttcctatttgtggggccatggataaattatttaaactctcttaatttagatttctcatctgttagaaaagtggagtaatattagtgtctacctcatagcattagggttgttgtggggatgaaataaggtattttatttgaagtatttcatggagtgtttggctcatagtaagcactcaataaatagtagtaggtatatttaatgtaatagatatttattgagtttctacaaggtgctggcactgtttaggcatttaagatgtagtaatgcatgagacagacgacattgctgcctctcatggaactgagcttctagctgggagacagaatcagcaaataaatatacgatatcatgtctgcttatacatattaagtgctactggaaaaggataaggagtagagaataatagggagaaaagaaatattgtggatatttagggagaaatgttgtggataaaatggttagggaaggcctctccaagaaggtggtatctgggcagagtcttaaaaagtgaaggagtgagccactcaaaaatttctgggaagaatgtctaagcaaagggagtgagcatttgcagaagccctgaggctggatcaagcctgacaagtttaaggacccacacgcagagcagtggtggccagagagctgggagtgacgtgtagagagtggtgagggatgaggacaggatctgtcaagtctctcagccctggtaaaagatttgggttttactctgcatgtgctgagtcctttggagggtgacaaaatatttgcaaatcatatatttgatgaggaacttatagctagaaatagaaagaggtcttataattcaaaaaacataaacaaataatcaaattaaataatgggcaaaggttctgaacagacatgtctccaaagatagacaaatagccaatgagcacatgaaaaagatgctcaactgcattcaccatcagagagatgcaaatcaaaaccacagtgagatactgcttcacacccactacaatgtggctacaataaaaaatacagatagttacaagtgttatcaaagatgtggaaaaaccagaactctcatgggagtgtaaaatggtgtagccactttggaaaacattctggcaattcctcaagaggttagctgaggcaggcagatcatgaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctcaaaaaaaaaaaaaaaaggttaaacacagaattatcatacgatgcagcagttcttcttttaggtatacagccaagagaagtgagaatatatgttcacacaagaacctgtacgtgaatgtttatagcagcattattcataatagccaaaaaatggaaacaacccaatgtctatcaactggtgaatggataaacaaagtgtggtatattcataccatggtatactatttggccttaaaaaggaatgaagtactgatacatactacaacacagatgaacttgaacatgctccatgaaagaagccagatgcaaaatgattctgttcatgtaaaatatctagaataggcaaatctatagagacagaaagtaaattagtaggtgccaggggctggggaagttgcgaggaaattgagagcgactgccgatggagctggagtttcttcatggagtgatgaaaatgttctaaaattgattgtggtgatgactgcacagcttcgaatactgaggctcctcgacttacaatgggactgtgtcctgataaacccatcataagtagaaaagataataaactgaaaatgcatttaatccaactaacctactgaacatcatagcttagcctagcctaccttaaatgtgctcagaacacttacattagccaacagttgggtaaaatcatctaatataaaacctattttataataaaattgttgaagatctcatggaatttattatatcctgtacatgacttcaaaactgtgatggtttcccacaattataaacttgaaaaatcctaagtcggggaccattctgtgtattagttgaactgtacactttaaaagacatgaattttatattaaatggtatgtgtattaggtctctgaaaagcggcatgggtgtgtacatgtatataaatgagctctgccagtgtcaggaagagtcactggcatcactcatgccacctctctctcatacacacacacacacacacacacacacacatatatatacacacatgtgtatacatacacacacaaacagagtgacgtgccatgtattaagccgttcttgcattgctgtaaagaaatgcatgagactgggtaatttacaaagaggtttaattggctcacagttctgcaggctttccaggaagcatgatgctggcatctgctcaggctctggggaggcctcaggaagcttacaatcatggtggaaggcaaagggggtgcaggcatgtcacgtggccagagcaggagctagagagagagagttgggtgagggagaagcagctgcacacttttaaatgaccagttatctaagagaactcactcattgtcatgagaatagcaccaagaggttggtgctaaaccattcaggagaaatccacccccatgatccaatcacctcccaccaggcctcacctccagcattggggattacagttcaacatgagatttggacaggacaaatatccaaactatattacaccatataataataacattttggtcaacaatggattgcatatatgacagtggtctcataagattataataccgtatttttactgtgccttttctacatttagatgtgtttagatatgtaaatacttaccactgtgttataattgcctgcagtgtttagtacagtagcatgctgtaaaggtttgaagtctaggaacaattggctgtcccatatagcctaggtgtgtagaaggccgtaccatctaggcttatgtaagtgtgctctaggatgtagcctagaagctacccactaggaagtggagagctggaacttgacccaactcacgtgctctttccacgactccccagctgcctgcacattgactgagtgttgtccgtgggctaaaaggctcaggatcatttagctcactgccttgtcatgggcagggctcttttggctcgctgtgccctatttaagacaaaattgtctaatgaaacatttctcagaacatatccttatcactaagtgacatttgactatacacacatgcatgcacgcacatatacacacacacgcatacgtagctttactgagatataatacatatacacacacagatgtgcatttatagggaagggggaaaagtagtccattggagggttttgactgggagaatgacatgacttgatttatgtgtttaaaagattattctggctcttgtgttgcggactgaccatagagagtgttgtcatgtaacaaaccactccaatagtagcttaaaacaataaagtgttattgtctctgacagttctttggataactgggctcagctgggtggttttcacttggggtctcatgtggtttccatcaggtaatggctggagctggtgtcatctgaagactcgactgggctggatgtccaagatggctccttcactcaattatctgagtctcagtgttcctttgcatggcttctctcttcagcagagtaacctggacttgctgtgtgacagctcaggtttccaggagtcaggacacaggaactgccagccctcttaaaagctaggctggaagtacacagcattacttctaccatatttcatcaatcagatagtcacaggtcagccccagatagaaggcggtggaaggctggactctccttctcagtagggaagtgacagaaacctatagggaaggaggaattgatggcagtcatctttggaaacaagctaccacaggggactaaagtggaagaaggaagaacaccagtcagctgctgttaagattattgtcatcagtatttcagcgttcttgtccttgccttttctgagtggaaaacatgcctcctgactggcatcttgagctttggtctggaggggccttgccctgtcatgatgggaggggagctttacaggtgagctgtcattccagtcagcatctccctagctcagttatagagaaagtgacctggctaggttattttgcccagggttccagaggtggttgtcatgaaagcaaggggagaaccgggtctcccagggtcccagccattttcttattgctagaccgcatgtaactgagaatcccactctgagagttctaatctgggggaatgagctgtgagccagctttgccaagcagcttaattctgtccatccagattaaatttgcagcagcagggagccagctgccctctcagccaggggcaggggagtaagctgagtccccgagggatgagcagctgtggaggctgttcctaggcggaccccagacatatggagcaccccctgtgtgcctggcacctgctggggatatgatggtgaccaactcaggcacatgccctgttcttgaaataagctgaaggtctgaatgtggtggtctgggccttttgttttttccccagagatcttgtggatggggctcctcagctggaggagggagaggtcagctaccgagtgccccctgctgatgttgaggtaaaatgtggcttgctcaataggccacatgtggtgtgctcaataaagattgagtaaactgagctcttgaaaggatggggaatggagaaaatgaatccaaattaggggtgagagaccaaggtggatgctttgagaagggctccctgccagccttagtgtgagctgtgggcgagctcccccagcagggaagagccacttccttgtgtggggcaggtgtcgtgctcagtgccgaggggagatacaacagcagttttaccctcaggatagggctggcaaagaggggtcctgtgtgaccatggtgactctttccgacatgtggcagagctcattcatcactcacagcgctacttcctgctgaactcaggtggatttttagttcccctaataatcaatgagagaatacagtctgaaatctatttgccctctctgttccaggaaaggggtcccaggaggaagggagttgcctgatgacagggagcgctgaaaatgtcactaaagctattggagtgggaaaagccaggtgggagaccaggtaccgttgggaagccaacgggagagtaggtagggaagagctctgaaaaagagaaggaatggagaccctgggacagtaaaaatactgccagtgccacttgatatttttgctaccttagtttataaaacaatttccttgattacacccatttaacagatgagaccatggaggcctagacactacccactaggaagtagagaactggaacttgacccaactccaactcaagtgttctttctactactccctggctgcctccgcactgactgagtgttgtccagtagtctgtaggctgattggttccgggtgatcctgtttagaggtcattgagttcatggccctgcctgggaagagctcttttggaaccctgtgctccattgcactaagaagccgcaacaccctgatgtgtacatcctcctcctggagtaggatacagtttgcctgaatcagatcagtttcatatccaaggctgccatgtgggagttcatggagctcacgtgtggctttgcatagggcaggtggttatggtgttgtacaggtattcttgaaactggaaaatgaatttaatggaaactatttccaattccagcctatccaagagaatggcatgttcacatctcacccttttgaccctatttgacctggatttctgtcctggtgtgtgtgacccctccttgccccctgccctcaagatcttgacgggctcaagctggtgttctaggaggccacgcttatggttgggctgggctcaggctttgttgtcacattcagttttctgttttggtacaacgaaggctttgaggagataaacagagatcattttacaccttttatattatgacaaatacatattgcaaaacactgctgcttccaaaatgtttgggttgcagagcagtgaggaattaacagctaggcagttcccgagatgcttgtacttcatttacacatcagaattttttttacactgttcagtaaaataaaagtgagaaaacacacatacgtgcacgtgcacacccccatgcacacccagtgcaccacctggcttctatatcaggaatgtcttaaattagtaagtagttctttaagtccagataaactgataaataccattaatggcttaatttattctctgggtttgaaatttgacacacggacactatcttggctcaggaaacacaagtggttttgtgccagaggttttaatgaccgatcagtaatataaattgctgcatcactgagcagaaatagcttctccatgtcatttgatctggaaacttctctggccaggcagcagttaataaatttaaaaataattaccctctttattcaaagtcaaactaattaggagtgggttttacaaatcataatgttgttcaagccactgtacatccccatttgggacttgaacaggcctgggggcaacagacaggatccggtggtgttaattagagggcagcgagataacttggctgctgagctccagggtaggaggccgggcagtcttcagcatgccctcgggagaaaatgggaggtctgagcaaagaggccatgagggtgacctgtaggaaccttcaactctttcagtccatctgtaggggacccagagcagccacctattggtaatgtgaacatgggggagttggggccagggctggtctgtgtgggcctggccagagagactgagggagtcagggagcaggaaagggggatgggcaaatgactgcctggggacaagagacctgcctgaaggcagggaagtggatgggatgatctctagaggacattacttcctaggaaagtttgagccctaacagagtggtgcaggtttgtcatgcagattgcagggaagaggaaccccatgaagcctaaagtcagagtgtcaagtgcagggtatttggtgcacagtgacccagaacttgggatctggtgtcagactatctagattccaattccagccccatcacagattggataatctcaatataggcctcgcatggagtaagtgctcaggaaatggaggtgccagtttctctcatcgcatcatcctggtcttcctcagaggcttctgagaacatggatttcccccactggataggttgacggggccaagtcagtgaggatggtgttggaggaataggaacagtatacacctgctttgcaaggccatggtgaggtcttccaggatccctgactatgtcctccggccaagaggacatttgcaatgtgcccactgagttaacagccactggggccctctcagtgcagttgaaagaagtgagggcagattgaagctccacactttgagcaatctcagggagcagatttggtagatcttaaggccctgaggtctggaatgcccaaagcttcccaaaggaaccattccctgttggtgtctaaacaggtgatgtgtaaacccaggccagacaggccgcaaaactggaatcgagactaagcaggtgtaccagcctccaggagcaccaggcctgtgcccttccacgtcttaagaggaggcttcagtgactggtgccctcaaaggctcaggaattttgggttcctggtagggtcctgaaccatgtctgctatcaccaggaacctgggtattccctatctcttgacttcttcaaatagaaccttccacctcatcctaccttttcgccagtaagaaaaaagaggcaaggtcattcctaggtttagaagttctgaggctgggaagcttaagggcaccctctgcaggcccagggtactaggttgaactagaccctagacttaccctggaggaattcagctctctcctccagccctcaacctgccctgcaaggtctgccaggttagtgactcaagtttgctgtgagagtagcctgtgtagctggcttatcctgtagttccttcatttcctcattctctgagtttttaagtacctactgtatgctaggtgctttgtggacttaatacataatagtgaacagaaattgggccctgccttcctgaaggttacggtgttatgaaggaaatgagcatgtaggttgaacttgccttaggtacagataattcaatagctgtactcttttggatacttttgagttattatttttattaagtcttcactatagtccaaaaatatagaccttttttcctccctaatctttgccagagaaaactgagtcccagaaaggttaaggaagaccaatctggggcaggacttgaatgtgtgccttgggcttctgtaccccagagcccacattttagcattgtcttccctccctgtgggggcctgggcatcagctctcatgtgcggatcaatggatcaaagcccctatttgaaaaagggggtcagttaagaacacacaatccaaactagaattagggcccacgagttcagcccaaggttctctccactgtgactacaaaataagtactttcttttactggcctagaaaaggttgcttagtttccacattactgcgtcacaggggaagccactcaaccagatgcaaatgttgagatgctggttctcatccactgtgttgtcggctgcaagagtcttgcagtccagaaacggcatacctctggcggctgagggtccatgctgtggactctgcccttcccttctagcagggagtgggcattggagggaaccccacccaaagggtcctcttcgtttcagtgtgaaggagtctaggaggcatatactctgtcttccccccactctctgtttctctctctttgtctctctctctctctttgcactgtgtggcctccccctttggaggtgcagaactgtctctccaaccttggtgttggctgcctgcttgcactggcccctctctcctgatatgttaataatatttggaggaagcttcagggacagtccctggctctgaacttcagagtagaaaatgaagtccttgtttggagaattttctgtagtgggtgatcatggtgggggcagggggtggggtgggagtagcaggcaagacagaggatttattttattttaattattatttttgagacagagtctcgctctgtcgcccaggctggagtgcagaaggcagaggatttaaaagggtgagcagcaacgctccttccctcaggatagctgctggccttgccccctcctgccctgagcttggcacgagggacagtgctgggcaccaaggagtcctgtaatgataggaaaactggcaactgttctagttcctgctctcaagaacagcctcccagtggctggtcccagaggagctgggagggggccagatgatgacaaataacttaatctacctaaactttacatgaaaaaaaaaaaaaatccaaacgaacctcaaacctctgtccaaggtggagggtatcggggaggacaggacagtgagtcatcagagggacaggcagactccatgtggtttgctgtgacctccccattgaaaacataatagcatttgacttttataaatatcagaggtgatttgtatagcatttcacattctgtgccaaggaatttaacatgagaaagctcaggctgaagaacggccgcggaacgtcataggcactttgggaggagggtcatgtgctgctgtttgtacagtcagtgccccagcatagatttactcttgacctaatttcatgctgttactataaaggcatgtttgatgcctaatatagagttttattttccaagcacagggctctcggctgtgctggagctgcttgctgtagagtagggaggaacaacccagccgtctcctgctggcccagaccagctattctttctctccattgttcaccctagtggctcccagggcccctctggccaccttctggaggggcccccgatactcttttttaaattaataaatttcatttttttaagagcagctttaggttatagcaaaatggaatggagagtatagagttcccactgtacccccgtcctcacacgcaagtgcacagcctcccccaccatcaacatcccacgccacatgggtggtacatttgttacaattggtgagtctacgctggcacatcattgtcacccagggcccacagttcacatgagggttcactcctggtggtgtacagtctgtggatttggacagacatgtaaggacacgcattcaccatttttgtatcatacagaatagccgcttcactgccctgaaagtcctttgtgctctgccctttcatcaccccagcacattttatatgaagcatcactgccctggacagtgatttgaggggatcagtggtgtttggctcttttgggattggagaaggagaatttaagcaaggcaggtttggattagaaagggctgaagctcatttcctccacagacatcttgagtgtttctcgatgccagacatggatgctgggtcctgggatagggattttggacatgtatgctgggacctgggaccgggatgccagacacggatgctgggccccgggacggggatgccggacatggatgccgggccccgggacggggatgacggacatggatgccgctgggcccagggacggggatgccggacatggatgccgctgggcccagggacggggatgccggacatggatgccgctgggccccgggatggggatgccggacatggatgccgctgggccccgggacggggctgctggacatggatgccgctgggccccgggacggggatgctggacatggatgctgggccccgggatggggatgccggccatggatgccgctgggcagtgggcaggacacagaccttgcccttccccggcctcccaccctagtggaaatgtgattgcagattaccattggggatgtggaggcagcatggtgtttggaagcaataatgaattaggagaaggagaactaggttcttatcctggctctgctatggacttgcttcatatgggacaaatggcttcgtttccttgcttctctcaaaggtagtgtgtaggaattgggcaagaaaagtactgtttggggggttctgtggttccaaggacagcctaagattctgatcttgcattgatggtctgtatttttctcaaccttagtttttcacatttgtaaactacgattaataatcataatggttgctgtaagaactacataaaaccatacatgtggggccgggcacggtggctcacacctgtaatcccagcactttgggaggccgaggtgggcggatcatgaggtcaggagatcaagaccatcctggctaacatggtgaaaccctgtctctactaaaaatacaaaaaattagccgggcttggtggcgggcacctgtagtcccagctacttgggaggctgaggcaggagaatggtgtgaacccgggaggcggagcttgcagtgagaagagatcacgccactgcactccagcctgggggacagagcgagactccgtctcaaaaaaaaaaaaagaaaaaaagaaaaaaaaaatcatacatgtgaagccctgagccctgggaaggaggactgatgtatgcataagtggtagctgcttgctactgttatttttagaggcctgcagtttctgtccctcaccagtagacaagaattcctccactttatttagtagcttattcagtaacagtgtattaaatacctactgtgtctgaagaagggattaaagatgaagatcttttgcctcttaaaaactgttctagaaattggaggggaaggatagagtctgatctttgaggactattattcagaacgtggtctgtgcccagcactgtggctttttatgtatggtccaatatagtcatcaggacaccactaaggggggcttcactgtctgcatcactgatgaggaatcacaggcccagagaggcttaaataatacgactcatccagtggcaggactgggattccaggttggtgttttcttggggtgatctggcaggactcaccgtcctcactggtctgagttgccccttcactctcagaattgtccccacatccgagtcctgaataatcaacctcagttcttgatctcaggtttccactcgtctcccctcgtgcccatgctcagcccctcaagcttctcctttatccctctctctcccactgtccactcctgtgtttcctctctgacttctcacccttctccttagtgacgccatggctgcctgatgacagaaaggagttaataaaaaccaatgtgtaactgaaacttgaaaggccataaattgccttgttttttctaggatgttggtagcattttgatttaatagttggacaaacacaagggcctattttattcagagtttacaggcctcaaggctgttattcctccaaagttaatagcattgaaattgcagggtttgctataatttgcctatcgctttctgctccaccattgatgtttactgtcagcgggatggaatctcaatccgactcacttagataacatgtctgttaaacatttagataattgtaccatcattaacttgtcacattattttagagattcaaaacagaggcagggtaagtagaggtacccaaagggagtggaggtgggaggagggggaggaggaggaggaggaagagacaacctcttctgagttagacagccaggagaggagaaagttcattgcacaccttggcatctcattggaggtgtctaagttaaggaggtacgtgccaccaagccgggcccagggttgctccctgaggaatccggggaccagtgtctcaaccaccgaccgccgtggcagtagggcctgttatcagcaggcccctgagacagtgtggcaaatgctcagaaacccttggcgtttcatccccgactttggcctttatgtaccaaagtttctaagctttccttagggatgctgattgcaacactatttgtaattgcaaagcaatgagaatgacctaaatatccaaaagtaaggaatctgtcaatgatggtatggaaagatgtccatgatgttttgcatgataaaagctgattagagaaatcaggttatatagtgtggtcccatttcatataaaatactaaagccaccctataagactctgtaatgctctatacctgttaacaatgattatctttagaagtgggattatagggcaaaggtgttctactttctgctttatctatttttgagtaataataatgatgatttacaagcacatatcacttacataattttaaaaattaaagtcactttataaataagaaaaatatcaccttcaagtctcattctgtgtatggaaggaggacttctaaaaagaaaaggctgcaagtacaaataaatgagttttgggagcgctcatggacatcagtatctcagccacactggcaggtgcctcagtttcccactgttagaacagataaatgccagatggagaatgcagcacaggggaatgggcctgtgccagcactcagaggtcagggctgctgtcttgttcactatgggcctgacggaggaagtgagtaagaagagagctttttcttacaccgacataaggactgaggtcacacctggagggggtgacagaggccacaaataagaatgagctcagctggaagtgggagtgactccccatatgggagacttggggatcaattaaatatcaacagtagtggggcactgagcttggaatacaaaactgccctcgagaaataacggggtgtttgctccctgttcccatggtaccacgaggtcacagaggtgactacagtgctgtccatctggctttggacactgttatctcctgcattcccagggccttctgtgtgacctgggcgagagaactgtcactattgcctctctccaatctgtgtgtgccccagtgacacaggcaataggaaaaatgtttccccaactgtaccgtaaataatgcagatatttgggcgtgggagaaacaaataatatcaatattttatagactgtaggctaaataatgtatatatttagaaaagcggcttaaatatttcatatgctgcagtgaagattcctgcttagaggcataatttgggctggtgagggctgtgggttaaggatgcagtcctgcggagccccggggtgagggggcagaggggaatgcagtaaaagtgtgtgtgtgagattggagtgtggcaaggacaggcaggtatcacttatttggaacccaagtagttggaagtctcagattttttttaactgtcctgtgctctttttgtttttaatgtgggagagagacaaatgacaacctaataacaagaatttattttcaaaaagtaacttccaacccaagagaattgaaaatgtgtccacataaaaacttactcatgaacattcatagcagtgttgttcacaatagccaaaaggtggaaactacccaattgcctatcagctgatgcatggatatacaaaatgtggtatatccataccatggactataatttggccataaaaagagtaaaatattgatgcatgttacagcatggatgaactttggaaatcccgtgctaagtgaaacaagcaagacatgaaaggccatgaattagatgattccatttatgtgaaaatgttcagaacagagagctctagacagttagtagattagtggatgccacaggcttggggaaaatgagaagtgactactaatgggtatgtggttcctttttggagtgatgaagatattctggaattagatagtggtggtgatggtattcagctttatgaatacattaaaaaccaataaaagggccgggcacagtggctcatgctttgggaggttgaggcagaaggatcacttgagcccaggagcttgaggctgcagtgagctttgatggcaccactgtactccaggctgggtaacagagcaagaccctgcctgttaaaaacaacccccccgcccccctgcaaaaacaacaacaacaaaaacattaaaagggtggaattttatggtacatgaattatatttcaattaaaataaaaaacaacttccaggtatgttgttggttcttacagacttaacccaacctcctatacctgcggcatcacaggactgcaggtaacgctttgcatcatagtgaccattcagacagtgcaggagactgtggcacctttagaatcattctattcacagaaggcagcagggagtaggggtggctctgggatgcctccttgccctccccattcctccattttcagaaacaggaaggaaggatcaggtctgaactctgatctggtgaagtagtgagtccgacatctgcaaagtcaggaggagacggggtagttgcgtctgtgtagatttctagaagaaaagccagccatcatctggcctgggaggagtcactcttgtcaaaagcaagacacggatggtattgacccaggcaccccattttaagaaaaatcatacctgtaatacggcttcagtgtggggaaattagaaaatacttacaaacaaaagaaatatgttctctgtgtcccactatctttttttttttttttctgagacacagtcttgctttgttttctaggctggagtgccatggcacgatctcggctcactgccacctctaccttccgggttcaagcgattctcctgcctcagccttcacaggcatgcaccaccatgcccggctaatttttgtattttttagtagagatggggtttcaccatgttggccaggctggcctcaaactcctgacctcaggtgatccacccacctcaccctcttaaagtgctgggattacaggtgtgagccaccacacccggtctcatttttcttttattcacaaatggggctatgatattcagtgcatactgttttgtaatctgtgatttgcctaccaacagacctatgtcttgatgatcattttaatggtttcccagtgttctccctacacccattcgtttttttctccccatgatctctgatgttccttacttgtgcaccagggaccagaccctgtatccagaggaccttccaggggctccaggcaggagaagtggctaacagagatgcagctcattaccacctctcacctattgctgcttctgtcaacaagataaactgggcccgccaagcagttttgcagtagctgtttactcgaccatcccaggcaagcttgagatgctgggaacatatccagtccccacattcagtcttcttagaaactgtttcccttttggttttctctaggcttgcaagtggtcactcgccctgagctggatttgggcaggtaatttacttccgctactaatttaacgaatggcactgccctgaggtcgggcagactgaggaaaatataggcatcaattcatttgccacgttaaaacccagagttaagtaacaagttaagcatctccatacattaagtatcccaggcccaactagggaagatttcctggagctgatgagccccaaccaggcattaggaaaaaggcatttgaaaaaaaaatttcggccgggcgcggtggcttatgcctgtaatcccagcactttgggaggccgaggtgggcggatcacgaggtcaggagatcgagaccatcctggctaacgtggtgaaaccccgtctctactaaaaatacaaaaaaattagccgggcgtagtggtgggcgcctgtagtcccagctactcaggaggctgaggcaggagaatgacgtgaacccgggaggtggagcttgcagtgagccgagatcgcgccactgcactccagcctgggtgacagagtgagactccgtctcaaaaaaaaaaaaaaaaaatttcttctctgaaccttaggagaagttagctaacagagagattgtaggtttgggtcagacgcaatgttccctgcccccagtaggagaagatccattacagattggaaatgactttgtctcttaagtgtgcattgtcagatgggacgcacgttcccctcaaccaaacaaatataaaatgcttccagcctctgcctcggattttctattactgtttcacaggactccagagagttttaagatagcaatttgattaagcttatggggaagatcccatcagataacattctttttctgcaggtagagataatgtgttcaagtattaagtatgttttaaaggtaattatcttttccatattcattttagttacaggaattgacaagggggagactctgcatctgaaagctgccccttgggccctagagtcactctgactgctctcctctggggaacacacttgaggcttttgacaaatgaatgagcaccaagggtttttctattttgaaatggctcgggatcccctgtctccagacaagtggtctagagggcaaggtcttggccactgacctcatctggctccctagcttagattccttgttctgggacacccactgggccccaaatcttaagctcctggatgtcaagagggagcctggctgctactcagaaagaggacttgtctcatctagtaccaagtcatggtgccatatcgccaacctttcaaaagtagagtctggaattgccatttacatatactgagcccagtgttggggtgttttcacatcgggagacactaattaggggtcctagaattctaaaatctgtagactcctagactgcagaactgttgcaaggggctttagggagcatgatgctgagcttcagaggggttctgggatttgtctgggatcacacagcaggctagagagacacactgtgggctagaacccaggaatccctggtcttagaccactgcttctgtccctctacccacaactctgtgccatctccagaaaagctcctctttccctttcctggaaatccccagagtaggagattctgcccccaggcagccctccttggccgtctgtgagtcagggtctgcaccagggctctgtatgggcctgaggagcccccatagcaagcctgatgctgatggcctggagttcctcaaacctcactttgcctgctagctgtgctgttctaagcattctgtacatttttacaaaatagaaaaattagggctcagcccgctttcagaaagctaactattgctagggaggaaaacatacatatctaaaaagataagtaataaaacaaggcaattggatgtgatatacctgcactaagaattgaggagtgatgtttttaggttccccatccctttgtctgcccaaaatccagtctgctgtggctagacacctatggcttctgcacacagcatttcccccatgttacttctctgtctgatctctcaggtgcccttggtttgacagctgcagcttgttggtctgaaggcaagtgacactgggaaaggaccctagtgagaggtttatcacataagaccccaggatggcggcatgctctgtttttgaacgactgcctcattcctgtaagacaaaggtggcaatggagggtggatgcagagttgatggctgcagcccaggttttggtgcttggcctcatgtgttacatcctaggtaaggatgtctctgccatcttaacacccatacctgctcttgcgtctctctctcttatccttcaaagcatcatcattgtcttaccccagctatacagtgaaatcatttagaggaactttatgaaaaaaatgtattaatagcaagcaaaggttcccacctcaacccggatgagtcagaacctcctgcatggggctcagacatggatgtattttcaagctccccaggagattcctatggataaccagggttttgaatttccagatgggataagattagactctgctgcatggcccagaaggttcctcacaatcagagtcacaggcctcatcttttgtcaccccctatgatgcgtgtacactgagccacttagaatttcccagactctcctggctgtttttctcctccatgcatcttccactaacccccacactctcatgtgtcttgtttgcctgatacacacacacaagacacacacacacacacacacacacacacacacacatattgaggcagagtttcactttgtcacccaggctgtagtgcagtggcaagatctcagctcactgcaacctccgcctcctgggttcaagcgattctcctgcctcggcctcctgagtagctgggattacaggcatgcgacaccacacccagataatttttgtatttttagtagagacagggtttcactatgttgaccaggctggtctcgaactcctgacctcaagtgatcctcctgccttggcctcccaaagtgctgggattacaggcgtgtgccaccatgcccagctaatttttgtatttttattagagatggagtttcactctgttggcccggcttgtcccgaactcctgacctcaggtgatccgcccacttcggcctcccaaagtgttgggattacgggtgtgaaccaccacgcctggccttgcctgcctggtattaatagagtcttctcagctcatttgtcttctctatgacacccttttcacagttgaccctccttctggtctccagcaccatagatgtacaccacttgcccttagctatcttgccactgcacgagttagggtgaagattgaaccaccttggggacttgggcctttctactgtgttagttcaaataatcattcaataaatgcttattgcatgattaatcaaaaacagaaaagggagcttcctgattagaagcaggaatgaagaatctgttcttgtctggcttcagatttttgctcttcacttgccaggtgaaggaccttggaagagtcactcatcctttgcaagtctcagattccttgtctgaaaaattaggacaccatacctgccctttatacctcaaaaagggatgtgaggaccaaaatggtgttagaacagggtagggtctttgcaagcagtaaagcatgattcagatgtaaggtgatgtcattgtgatgtttcctcttgctgtggtttcctgtcatgggctctggcttcagggtgccctgcaatgccaatgcaccccagtctgtgccctctgcacagcctcccatcccagcttttctgggcccttttcttccgttggcttcttttatcttgcacctaccttgctttctccctgcacgtaccaccaccacaaatgctgtacaagagcaagttaaccactattgttttgaatgatagagaaaataatgagggaaacagactggtccattcagtgattaagtattcagtaattaagtattcagtgttaggtggtgggcagaagttaggaagaaaggtatcttaaggtttttgattcggcgtcatccgaatgggtcaatgagacagattccacaggcaaaccattccagatccataacctctagagtagaaagtttcagaaggaagagatcccccaaactgtgtaattcccttgtaaatctcattcattcaatgggatttgagaaccaaccacttgtgcaggtgcccgcatccgaagataacttgcccccaggagacagcagataagaagagggcagagacaaaggaggtctttttgtgacttgcatcatggatgcagaaaaggtggataacccaactctggtggggtgagtgggcagggaaggtttggaagcaggaggaggagacactcaaagctgctttggggtgcacttattttgtgtgctggagaaggatttgctggccatttcttgtgaaataaacttttttgtgtatgcatgtgtatgtaggctgttactaatcccgttcctttcttgatctactgtttttcaggttaatggtgtctgggatttgtggagggaggaaggatataaaagggcaaaaacaggagaccccggtgcctggattcagagccttcacattccggagatccccagaggcccctctccccagacccttcagctccagaaagccattgtgctccctcctggcctctgaccctgaggctctgggaagcagcaggttgttgacacttggacaatcatttcttgcaaggcaactgcctccctggggggctctcctctgccttagggtggtgactattcccccaaccagggttaaggaagagaaaaattaactgttggtcagagcaggaggcaaggatagagaatcctcaatttcaggcccccaggcatgttcacccctctctcacttgccacttcaggagtacaccacagcccagggataagctttaggaaaatgggttcgagagaggcatttctgatcagagttccttctggcatcctgctgtgggtctcatgtttgttgaggggaccccatatttcttcatgaaggatatctgtatgtctgctacagtctcaggaatgcagccacaggaacaaagaaatttctagccctggtgctgctacttattaggagcaagacttcagacaagttgcttttcctttcagaagcttggtttcctcattggtagaagagggtcaaaaagtcacttgcccggtgagcctgctgagaagagcagatgaaggaggtgtactctgcactctgtgaaacattgcaaatgtgcgggttgatcattaatgttttctcttacagccaaagctagtgtgtgtgtgtgtgtgtgtgtgtgtgtgtgtgcgcgcgcgcgcgtgcacagtttgtgagtgtcgggttcccaagcatttactctcctctctcctttctaggacatttcaggaagcattattcaaaagccggtggggtgggacagagggactattaaaatttttaagaatcaccttgcatttctttcactttggtcttaataataaataactctaaccctgcagccaggagctgggatgttctgtccaaattagcacaaatctctgtctgcaacagccgagcatccccgttcagtgggcgggatcagtaccatttccccagcaatgagaaaaagccctcttgctaagctacagaaaaatctcccttgtgctttaattttggaagaagcggattagtgtggccatatttaacctttgaccctgaaacaaaagcattatcaaaattatttaccaagagcgtctgtcttcttctcctcacccccacttccctgtttgccggggctagtttagaatcttggtaaacttcttcagagcaagagcaaaattttggaaggccatcattaccttagagacatcccaggcctggtgttcactgccagggctcttggggtctaaggtgggttaaaggacagagatgagaatcttataccacagtggggttcaaaatttgtgagttggatgtaaaaactctttctcctctgaaactagcctagtttctggctgtcttggagatttaactattcagatgatatgttgattttttttttgttttgttttaaagatggagtctcactctgtcgccaggctggagtgcagtgtcttgatctcggctcactgcaacctccgcctcctgggttcaagcgattctcctgcctcagcctcccgagtagctgggattattacaggtgtgcaccaccacccctagctaatttttctatttttagtagagacagtggtttcaccattttggccaggctggtctcaaactcctgacctcagttcatccaccctccttggcctcccagagtgctgggattacaggcatgagccaagtgagtgacctaaaggtgcagattgatttctaccttcttctccttccaggcagaaatccatagacttggtggtgtggggtggaggtatatctagacctgagccatttctgtgggtttaaatctcatcttccctgtcattaactgtcactgtggccttggacaaattatttgaactctgagccccccacctaccttccttatctgtaaaatgggcatagcaataatagtgcccgcctcctagagttatttttgaggatagataacaggatacacatgaagtgcttactgtggggtttggtgcttactaagtgttgagccagtactaactactgttaccacagttgttaccattgtcatcagtatcatccttattgattcttcgtcacttccccaggtcctggttggctcccttccccctcccccgcattggggtgttattggcgacccgccccatttcctgcttgtcctctgccctcaccttctttgcagtgattttcagagtccccgtttgcgttcgcagtggggagtttgacttcatttcataccaggaaggccagcttgcagtgggggattgggagggcagagcgctttataagctcgcgatgaaagctgtaaaacgagatggtcaaggatctggccaggcctggttcgggattatggccggcccctggaatgctgaggggggcctcttttaagaagccagtgtctatttacagtgtatctctcataaaccccaacgctggggcgagggcagggggactcgccctcctggcatgtgattgattatctggtatttatgccattgaggacttgtcagcggtctggggtcaaagggtcatctcatgtgtcttgccgccagcccacctccttttgtacagtgtggaccgggcgagctgtgcacaaaacagctttttcttttccttgggaaaggggggatggggaggggggagtgtcaatgaaatttttttttcagccttttctgaatagtgttctttaaattctaaagaacttttaattaaaagtagcaggaaaattcatcttgagaaggtttaacttaccttaacagatacttttgtgtcccaagaagctgggagtgactttgaaagaaagaaagaaagaaagtaaggggctttgttgtgcctctccccctcccccaggcattttcaaagtttcctggagttcttgtccactcctgtctggtgtggaccctgcttgggaaagcaggaagggaagaggtcattcttctcctttaacatagccacacaaatttagaaagggacttggggattctctgctccaattttctcctgttatagatgaagaaactgagccttgacaggtgaaaagacttcgctatagagtcacacagctacacagttgcggagtcaggcactgggctctgattctctgtatttcctagtgctcctttgagcatgccaggttgcttcccgaagctgctttggatgccaagtgaagataaatgtaatgatacctttgctgtcgttcagtcctggatgtttgagacttgggaaccactcttaaattccttgggctggaagcatccctgagggaccacctggcttatccccccatcccccatcgcctgcctcggagcaggcagtccgtgctcacgtgtgccggaggaattgctgtgggtcccttttctaaaaatctgcagaggaagtctctatgttttctgcttggtagaaaatgccggcacccctccctcaaccttcatcactggatggtctggacatccttctgaacagctgactttgtttcttccttctgtggctcaggagtggcccacccatggaagcttgtctgtctgttcccccatccccccgaccccctgtgtgcccacagggggccatccagagctgtgactggccaggacacctcagtccactgtgctgctccaccatggcctggctgctgtagggaaacattgtccctcttaactctcacccaggcttttggtgacgtgaggccttgatgaaatgctttgtccatcgcttccaactcattgaaccaaggtggacactgggcagagaaatcatttgccaagagataggtatttgtaggactcgcataaattcacgtgtcctgtatcctgttgtttgtcttctccatcccaccacctcctcatttaaaaaatgcaatacaaagaattgtcttctaaagaatagctttagaaatcctcattcctttccattccctccattcccattcacattaaattagcgaatgctaatttggactgatagggcaccactgtgaaaaaggtgtgaagaaagatctgcttcttgctcatgggaggagaccccagcagtaattagattctcactgaagtcactgggtgccacaaactgtgccagtgcttacctcagactgtgttatttggtcctcatattaactttccaagatgaacattcctgtgtccagatgaggaacatcagggctagacataggtagccttctctggggtataatttgctttaagctaagtagtattaaacatgttaaacacgtcatctctttgaatccacataaaatccctaaatccctgtgagacagggattgttgttatcctggttttagatgaaacaggcacagaggagttaagtaacttacctgaggtcacacagcagtagtaagtggtgaagtggggtttgatccaccatgaatgactgcagagttcacacttgaactacttgctgctccacctcttttaagttgtagagcttcctgatgctggcgctcatgttttgttttgtcttttcctactattctgacataaatctgctggggagacactatatatagacatatataaatcagccagagaccagcaaaaggtcactgtgtaatcagatgccagcctgggtggtgcgtggagaggaatttagagaaggaatatgttaacgaggacacagtatttagtctcatgtctggacccccatagtaaggggacagtgccttactcatctttccatctctgggacctaactcagggcctggtacacattatatgttcaataagtactgattagattactgggaaagagttagtaggggagatgggacttgaagttttttgaaaatgatattaataactgtgacagttatttgtgaagttttttgaaaatgatattaataactgtgatagttatttgtgaagttttttgaaaatgatattaatggcattaccttttatggcatactggccaggtactcagctaagtttattatttagttgtattaactctcacagcagccctatggctattatgatccctggagtaaacttaggctgaagagagattctatatcttgctggaggatttaaagtctcagggtggttggtgttatttgggggcttttttttggcttttttgttgttgttgttttgagacagggtcttgctctgtcgcccatcctggagtgcagtggcgcaattttggctcactgcaatctccgcctcccgggttcaagcgattctcatactttagcctcgtgagtagctgggactacaggcatgcgccaccacatccggctaatttttatatttttagtagagacggagtttcgccatgttggccagcctgtggtggtttgtttgtttgtttgttttttcttgattttgaaattattttttttcctaaagcagagaagaaggcacaagtgaaggagaaaaggcagacgtgagtgatgatggcagaaagtctgctcaattggggtggagggatttggaagccagagagaggagcttatcttttttttttttttcctgcttataggtggaagttgcttctttaatataaagatttctggatctatgaggttaactgtgtccagttaattgaatttataattcagcaccaaaacgctgaaaagaattgtcttttatgtcccttaatgagtgctataaaaacaagtggtgaatctaattttacgaatgttcctttatgacttacctgataactagtagttgttcaacacaaaggacacataactcagtctggacctacactggctgcctgccgtaaaataacttgttttagaagttggccttcttgcttctcttgagtggcccagggattcacttgttcccttctctgctccctcttctcattgaggatcaggctcgggttcttcattctggaggattgagatgggttaccttccctgccagtccaggatgaccaagacctcacatctcattggctctttccaaaaaggggaagggaaagatatggcagctcattcagatgtctctctggtgcagcatattgcttctacctagaagttgcctggtgtgctaggaagaaaagagaaattaagagaaagactccttttgtctttaccctacaacgagaggtaaagagctttacagccgcagcagccgcattaggttagacattggtgagaacttcctgagttgcaaagatgttcctaagagagactgataactgtccatctctggagctgcttcagttgtgagtgggcacatatatagatgcccttatctttttatagcttttgtctttttttatgttttgaaagtttaatttgaattattttgtgattacagatcttacaggtagatgttgggtacaaaattcaggcattctctgatggctatttgagaaaggttggctgttcccatctgcaatagtcaggggcaggagcctggactcacaggccagtacagcactcagggagacagcctagaaatggaagggcttttggaggagggaagctcttgaacagagcagacagggtaggggtgtgggagcgttgatgaaggaaggccaagataaggctgtggtttccatttgttaccacctctcccgcttatcttgagtgagaacaggccctacagctctgagcgaacctttccatggggctgttgagctgtgaagaggacatatacgagctctcctatcctctcttcccagtgcaccctttcccttgcacacacaggcacctgtaaaggctgcagctttggtctattggatgggtggggacaaatgcagaagtgtccctgttctgggtgctgattacttcctagcagagctggggggtggactggcacatttgtccttcatgatctgagtcttacctctgctggccttgtgctcagactggctggtgggccatcttctgccttgtcccacccttactaggctgataaattgctgttccagtcaacagggctctgacccagcccttatctttggtcagaaggaggctgggtgacaaggacagggggaggggctgctgcacaagcccagcctttggacactggtaaccttttgtgggggaatgtacacccagctgctttggggcccagaggaacattctggcaagacagtgctatcagcctaaactcatcacaccggaggcagcctgcagcacatacacatttctcttgacttacaggagactggagatggagggaaataagaagtcacctccccttaccccctattctcactgagttggcatgacactaaaagatcccctattccctatcattttcagaagaaccaagacggcttgccactcattcattcaacatttattgcatatctactatgtgcttaaatgctgggaatagaaagatgactagacccagtctgttgattcaaggaattcagagttgagaggaagacagacacataaacaggcaattataatgcagaatgctgagtgcagcgatagagatatttatacacaggatactgtggtagcccagaggaagggtgctcagcagatacccaggggacagataaggcttctagaaaggaagacaccacaaggttttcaagaagtagaaagtagccaggatgaagggagagaaggacagaagaaatggaactgtatgtgtttagaaacagtgacactgtggcctgagtagctcagctgagatagaacgtggtggatacagttggaggcataggcaagcccaggccacagaaacttgttaggctgtgtttaggagcctagattttatccacagatgacaaggagttcttggaagcctttaaaaaggaagttatgagatcagatacattttggataggtcgcactggtggtgctgtgcaggtgagatcagagggaggtaagctgtgtttaggagacttttgtggctatcctgatgagggatgcttacatgatagaaaatgagctggattggggtatctcaatcctaatgtcaggcaagaggacctagaggccttcggggtgacgtccaggcatctagctcgagtgaccaagaggatgttagtgctgacagctgagatggagatccaggccaagcaggtttgagaggcgaagatgtgggtttcaggtttggatattcaggttgaatataagatgtctgcggaacatctagggagcagctaggtgtatggattttgtgcccagaagagaagtccaggctggaggcctcctggcttcctggtggtcactgagaccgtgagagtagagttcacctggacagatggcggggcatgaagcgtcatgagttaagggcagaacaccatggtggggatgagagttggggcaaagggcactgctcagcagagaagggcctcctgcagccagctccttaggctccctggaaggtgaggaaggcaggaagcatgggacctcaggtgcagagggcttctcagaggcggattctcaaggtatggcctggtgtggggatccctgcagatagatgggtctctccagggtgaggagcgctctcctggcccagctcctggcattctcaaatcccagggatctcttgtgaacagggccctggccctggggtaggagagaagaggctgacaggctgaagaataatctcagaactggtggggacttaggggattgcagatccaccctcttgcttccagggggattggatgggcagtcctccaggctgctgttggaaatttctcagagaaggacctgctgtgctgcacggaccttcctggaagtccaacccaggtgaacccttcttgctggttccattgctgcacgtaccatccctttgcacatgtgtctctcttttctgaggttcatcatgcttggttctgtcgcattgtctggagggaatacaagcaccctgattccttccaaagaagaggagctcagggccctgggtcctgccccactggggctttacatttcctgaaacccctcttccactttccctgtcccacactgatcctagaatgagcactccatttgggatgggtggccgctctccctctacaccctcctccagtggcttggcacttcgggaccagctgctggagtgattgacataaagccaatctataaataaagtctttttcttttctcataaagactttgtggttgagtttgccttcaaggtcaagatcagacctttctaaataaacacatatcaaaggatcattagcaaagcagcactgttaaattgagatattaacttctgtcaactgcttgtttcttttttgttctgtaactcatgactgcagtaggtttttattattttgtcctcaggcagtagcatctggcttctgtagagactgtaaaaattaaaaagcaacacaaatcattgcgagagaaaagcagtaaattcaatgataagaatttaaaattaaaatgtttcggtgcttttatattctgcaaaacatgaaatgagtgagtttgttgcctgttgccataaacctcacccagctaatcgtccgcttgagttttttcctgtctcttttgctcatcaccatcaattctgtcttggcacaaggcgtaaagtgagagccgtgtgtgtgtgtgtgcatgtgcgtgtgcacgcccatgtgctggcatgtgtatgcatgtacgtgcgtgtatatgtatagcggggctggggcagagtggtggatgcactcactgacctccacctcattagaatgggggagacaacagtagggaggcatcatgtgggaaccagggtagggaaggaagagttgaagattattacatccccatgggtcagagttcccttttttcatcaccctttctagttaaatacaaaaacaaaacaaaaagccccaaccaaccaaccaacaaacagaacactccaggtcacagacatgagcataaacagcaacctgtagcatccaagttaaaatgtaaaaaagaattccctgagcaagtgtgtgatgctggattaggggtctgagtgggtggctgggtctttcccattccagagatgcccagcctttggatggggtgctggggagtgggatgggaagcatcttaggctccttattccaatcagaagatttagggtttctgtgttgaggtcactcattcttactgcaaaatcgagttgtgtctctgggcctagctatgtcctgggctgtgagggagataaaagttgattggttttttttcttgctctggaggaactttaaaaaaagcttaaaaaaaaaaagtcttttaaacagtcagaggacaatttaagacaaatgtgagtaaggatgtgatggcattgtataagctgtttgcagacattctgggaagcgtgcagagtggtgtggggtgagttcaaggggagctattaggcctgagttgccttgaactaattctccagtctgttgggcttggggtctggaagccttggaaagcctggggtgaacactgtcagggtgagctcacccccatgtctaaaccaggccacaggactgggacagtgagggggaatgctgtgggtcccttttcacatagtctgtcccagtttgactgctggacccacaggcatgaggccagagctctttgtcccagacgaacttctccagcctagagagaggtgaggaaagagagccagtctttggcctccgtcaaagggaatgaaggaaagtgtgaagattagtggacggaggggtcgagttaagagggtatgactaataggctggtcattcagataggagagcacattgttctctgggcccagatggtccttggaataaatcagctcaggcagaagcagacttccagtacaaggaagtaggagcaactgcttgcctgctattctctaatgacatagcccaggcccctggccctgaatagcagccattcaggcctccactgtggtgttggagtgggggatgtgtgtgtgcaatgcatgcatgtgagtgtgtgagcaatgcatgcatgtgagtgtgtgtaaatatgtcatgttctagcctccgatgcttacagaagagtggatgagtgtttgtgttgtaaggagctggtacagggagatttttaccttggagcccttctcaactttaaattccaaccctgaaagccgtggaagtactggagtcatttgattaatgtctccttcagtagatgggaagctctaccagggcagggactgtgtcagtctgattcatcagtgtctccccagaccaggtgctggtggatgcttgatagacatagatggaagaaagttgtagcaacattcttatttttctccattgccttgcagtcacggcccccgttaattaagtagtatataagtaaatgaatgtatcagctactcctcccatgacttccctctagggacggtcatgaggacagagtgagctggggtagggatgcacaccacagcagttacatagagttttgggtggtgcaggtcctttatttctgtacttgggacactccacagataatgtggctttgaagcaggactttctgtcataaaagttttccaggtagacagcttccctagtttccctggttgaagacatgcaggcatgtgcaggtcgtagaatacgtgtaagcatcacggtgatccgtggtggtttttctggcatgatggccaacatttcagtggaagagcctacccactcccccctcatgccctacagtctccattcaaaggctgtgctagttccttttcccttcagaacccattcagcttcttaggaaggagggtagggaagagccaagcagcaatatcactgagtaaataggaataatcaaacagatactccctggagagagttttctttctatgaagatcttaattaatatgaacgctttgtcctggtgttctgaggcagactctctgtaccaaccgtgtgtgactgctgatccagctctgcctaaatcagatcactggggtctttcatcctttggggaataagctcctttggagaatcaagccagatcttgcctgttgggagattaaataagttgccctgtcttaaagtttaaaattaagtgcatattaagcaaatgacagtggaggccactgaagacaccttaggcctggaagcatttcagttagagaatgtttcagggactccacacacattcattccccttctccactccaccccactgtcatgccatcctgactttccactcactgtaaggtgcttcagaagacccaagactcaggctgccagagtggctgagttgggtgacttgggggttgtttctctcccattcatgtctgagatcatgaatggtcctctgggccatttcttgagtgtttcatttccaaggcctgtcagagggaggcagtctttagcattctctgactgtgctggtattactgggaaacaacagtcttctcttaaaaggcaatttcagaaaacaactgcaactgaatgactcaggaagaggaaggaaaggggaataggatgagtgaaatgtatggcccaagagcttttggagtctggaagaacaaaggaggaataaaggatgggtacgtggcaagaggagacccatgttacagagtgtccatgatcatgcagtgaccatccagcttggctctgctgtcgcctgcagagaatacactaatgaaacaagtgagtcttgggtgaggggtggtgtggaatcgtgcttggtggaagcatcttttgaatcacagggtctttcatgctgatccttgaggcgctgaaaacttcacagaacttccatctgggttcaaatggggacatttagaaagttcttcaaattcactcctctcaatgacttttgcccgaagactccaagcccacaattactttaacctgaatgaacagaaagtatcatccatgctgtttaattctcagtggcctcttggactagcctgaaagtcacagctcccccaacccccaaaatataagttaagaaagaagcctgaaggtgatggaataaacactacggcttgtctttcttatttttaggggctctttgagagagggggaatcaggaagtgtaggagtgagcaaagtgattctgggcagaaacctgaatggatatgacaaggacgagggatcctttgtccgggagctggtaaatccctgggggctgcctgtattgtcacatttgcttgcgaggacacctggcattgtatccaccactgccagatcatctctagatccacaagaaccaggatctttggccaggactgagagcaactcacatctgacaaaagcctgttcacctcttaaaagaagcccctttttattttcctagcaggagggtgttggaggtcatgatttctgagcatgctagtgacatggcttttggcatttccattagcatccctgttctagagaatccccatatgctgcgaaaattgatctcaaaacagtatatcatatatatcaccgtctgaggagggacgaaaacccaccaagagtgtgatttgtgggggcccattgcttgagtgtagagggctcagactctgaggtcagcttatgtgcctgagggcagctcacagcaggccctgcagggatagctgagagcctgccctggtcttggaggagaaagagatagggagtgtgcaccaggagacatctacatgttccaccagtgcccagaagttgttgtcaggtttgacttcagatcccaaactgtaggtgctcgttggctgcaatctcacagctttggccacagagtgatagccgttctgcaggcctctctagagatctgtgtcttcaattgtgaatgactcctcatcaggaagggacatctgggtagcactgcactgagtcccacatgaatgaatacttccaggttgagaggagaaaccaaacccacaaaagcctatgccctgctcctaacacatgtggatatgagtgtacacctaacaatcgcacgtattaaaagatatgggaatatacggactcagaagcctgcaactcatagggaattggggatggtgagtgggtgggtggcttgagagaggagagtaagccagcatgtttacttgagttgaagttggtcagagtcagatattaatggtgtaggctctgaaaattatgacttgcctggagctctggctcaagcccacagaagtattaatagattatttttaatgtatttatttgtttattaattcattcggtaaatatttattgaacacccattcttacttagtagtatattaggctctgggaatacagtggtgagcaaatcagaacccatgtcttcatgggtttcatgccttctagggaggcacacaagaaaataagcaagtcatatacaggataaatattgttatattggaggtataaggatgttattagagcacacgtgagcaacctccaacttggatggaggcttcctggaggtggtgtcatctaagctgtcatctgaaggatgagaagaagttaagacaatgaaggaatgggggagaaagggaagaatgccaggctgagagtcaaggtaggtaaatgtccagagtagggagagagtaagacaagttcatggaactgaaaatgggagtggggaggagggctaagatctgaacttggagaagtaaatgggcattaaatggtgaaaggcccttgaaaaccattttaagtagtttttgcctttttctggggacaatagggaagtaatgaaaggatcttaatcaggggagggacatcaggtgatgtcatggaaaagttactttgactacttggttttgactcaactggtgggtttaagctgaaggcagggagattgggataatattgccatcatttaggcaaagaatatggtagtctgaaccagtgttgctgtatgagggggtggataaataaatgcacaaaaagatactagaaatccgaaaacatttggtaattgatctctttcgagaggtgagagaggaatctaggataatgcccacttttcttgcttgggcaactgagtgatagtggagttctttactgaaatgaagaatacaagaaaaaagagctttttttattgttatcgttaggatactgaacagttttcatatacagtagcagggtgtgcatgacatccaaaggtagggtgtgcctaggaggcatgtgggtatacagacgtatctggaattcagaagagagagacccactggatatgtccattttggagttgtcatcaacatataaatgatcattgaagcccttggaactgggtgagtttatataacaagagagtatagaaagagaagagagcttggaatagaatccagaggaaccccaacatattccacccctccagaacaatcccaatccacgatggagattgaggagttgctggaagaaataggagggacaccagaagagtgtggtgtcatggaagctaaaggaagaggtttcaaaaagaaaaaagcagtcagttttagatggtgctgagaagtcccctaagaggcagactaaaaaatgtctgttgctcttagtgacatgggagtcgctgggtatcaaaggcaaacagttttggtgtcagtggaatgatagaagcaggagtgggattacagtgggttgaggagttagtgagcaattgggaggtagaggcaacgtgggtaggcagctctaggagtggaggaggtggttagttagaccgatccaagcttagggtacagcaggctggtgaaattgaaggatcccaggcaggggagttcaggaattggccagaagtcagtggggagttggacgacgggccttgaagtgtgggccgaatatgaaagaagtaaggaaaggaaaggcattctagggagatttttgaagatcaaataatgggtttggtgggagtaactggatgggagaatttaaaaggtgggaatgaggtttgaatataacactgtagagatagagctcttcttggtgatgaaagacatagagtgttctctataagcacctcctagagggggcctaagtgcagctcatggtacctgtcttagtctgttttgtgctgctgtagcagaatgcctgagagtgggtaatgtatacagaacaaaaatgtatttggttcacagttttgaaggctaagtccaagatcagggtgccagcgtcttacaagggccttcttgctgcaccactccatggtggaaggcgagagggcaagagagagcagagcacaagaggggactagattcattttttcctaaggaacccactcccttgagaacgacattaatccacgcgtgagggcacagcccccatgacccaaacacctcccaagaggccccacctcccaacactgctgcattaagatcaagtttccaacacaggaactttgggggacacatttaaaccatagaagtacctaagttaaaacaccacagcccactgatttaaatatctgtaccccacacccttcttcacccagccactggatcagtgttctaagcagctactgtttctccatcccctaatcatgtgacactgtgatagacattgttcatatattatctctaatctgcccagcaaccttgcatggtgggtactataactctaatacagaaaggaaactaagacccagagatactaagtgatttgcatatgattatgtagttagtaaataaatggaagagtcagaatttgaacccaggtgtggtctgacttcaacaccgaggctctttgctttgtacttctcagactgtaagcttcttggggccaagaagtattttcttatcattgtgtagcctcagggtttgattcctatacagaattgggactcaagaaatttgaggtgcatgagtgagtcagtaagtgagtaactgagtgaggggtacataaagtaactctctaatgctgttccccaggggaaataaagcaccaccacccaaagagagaaatgaagagcactggacagaagaaaggaagagcagaaagatttggccatcaagcgatgctggtgttgggtagctagaacagaggtgtctctcttcactactgtttctaaccagggtgctggacagcctgtggttggcctgagagagtcagccctaaggcctccatctgccccagcatcaaccccaggctccagagctgtcaggcagtggcccaaaaactccagaggaggagctgaaaggggaggtacctaagaaacaaaacccacatgggaggagagaaccccaaaccacgaagtgacattctacttcacgtttccttttagtgtcggcatctgaggctggggtttctctccagaccctccttcagagtgcccagggttggcgtgtctgaatgtgtgagagtgttgggagggaccacgctgcccatgaggagcatgcacaccacctgacatgaccttgaactccagccagatgcctaccagacactcgtcttccttccctgaaactgatttatagaatcaggagagcaacctacttgaaaggagggtagttccagatgtgggggtaatgggaaatgctagtgggcaatgtgctcttttattttactatttttctttatcatatcatattcctctctctccctccccaaatagcaagaaggacagtatcttccttccaggctttaaaatcccttgcatgcagcctgacgttgcctaaaagcctctccctcaggcctacggactccctctcattgcttgcctattcagtaagcctataaatttactgtcccctgtccaccaccatcaccaccagcctgttgtggcagggaaggtggcctggtgagcccagtggactccagcaggactgcagcaaggggatactgctttgtgcagcagccggagcagcgctgtccctgaggtctgcaggaaagtcctggggcccaggaagacagtggcccatcacccccagtattgcacatcaggtatcccccacctgtgtgcaccatgcacacccccaccatccacctcctgggccccatgtgctgggggaaggtgtggtcagcagacaggggaggatgtcatgctgacggagccccttagaacaataggagcttcacaggatcacaaagcctatcccccctcaggttacagaagagttgaagtccagagaaatcaaattcatttgtgcaatcctttatccatctattcgtccttctctccatccaataaatattcattgaacacctgtcagaaccaagagatagagtgctgtataagagaagtgaggtcgcagctctcatgcagctttcattctgacaggtggggaagacagtaaaccttgaacttaaagcaagtctctaagtcttgtgggtgtcacagctgaagactaaggctgggcctcctgtagtgtcctttgcaaggccccatactccctgcttcctgggaggccaagcatttagtttggctctccattgcagatggagaagtttgagggaataaataccagtttggactagatacttctgggcggcagaagggtacaggtagtttcagaccaggattggtttttaattttttaattttggtaaattatatgtaatgcaaaatttgcatttttaaccattttaagaggacaattcagtggcattaaatacattagcattgtcatgcaaccatcaacacacactgtatctccagaactcttatcatcccgtaaaacagaaactccgtacccattaaacaccaactccccattccttccctgactcctagacagggattcttaacttttttgtgccattggctccctggtcagtctggcgaaacccctgaactcttcctcagaatcaggtctctaaatgcagaaagtaaaatacataggattgtcatggaaacttgaaatacaaatatcaaaatattttttaaaaaccatttgtaatatagtaatatgtgtgattctttgttatcccattaaccaataacatcaggctgtaattgaataactaccatatttttgcgggagtggcttgcatagatgatattttgagatgactgcaacatttctagtgcagtgtgaaaatacctgtaatgtctaccggtgaccaagtagttaccagtactgcccatatgacttgctggttgcttatattcctaatggaaggagctactgaatttcagttggaggttggtgaaaataaagatgtcacttttttcccctctctgagttcaccaatctcctgaattctgtccctggacagcttaggggttccgtggactccaggttaagaagccgtgcctagacctgagctcactccccttttctgcctagaggggcagtgcacagtgcacggggctgggagcgtgttgatacgtaggatgtcgtgagtgaagcagtccctttgcagggcatcacaggagcccagccaaggggaaaaggtgcccccactctccccaggccgccagcctgctgtctgaggtgggcggggccggtgccccctagaagtgtgccttctggcagcttcccccgcccccttccaccctcttgtccaagggctcaatgcagaagggagccatatggtcctttgtggacacattttccctagtacagtatcttcctggtgtgaatgcaggcctggcgggcgccctggtgtcagctgtccctccccttccctggcgccccatcccccatagccagcccagagagtagcaggttgtggggagtcggggagccctgcagagtcggggtgagtaaggagtctttcagtaacacccacacacacactcacacagaaaactgtggaagtgaagtcaaacgtctcaaagtcagatccctttttggtatgaatttgctgtgtctcattctgggcactaattccaatttaattgcgagtggcctgaagcctcttcaataggagtaacaaatggtttgattttgtaaacttcatcagactgcattttaaatgcgacacagtagcccaactcgaatgccaatgaagcactggagtagctctctgtttactaattatccgtttttactccaagccacgctggctggcttgtctgattaaatcggatttgtgggatagagaacagctagcagagttttctctatagtaaacgagattgaaactatgggccgcctggctgcacactgtaaattatatttccttttaaaggggacgtgtctcttttatttctctgtcatccctcctgcatattaaactttacggtacagaagtatacccggctgcttctaaatccagcctctcaccctccacctggtagcccactctcactttctgtgatttccgtctccttctctgaaggactggaaaggaaattcgtagctacgttctctgctcctttatctttttaacccttttcttttcttcctctttattctggaattggcttttcattattccattattttcaaagatacctgtgatgacatggatgcttagaaactatattgagttagctaaaagagagttctggcaacagaatttaccaggacctaacacagactgggttttagctttttagaaggatgtgaagatgggtggtattgggccggggcaggcaggggttgggcatgaattggtaatgatagtttgaattgtgaaaaaagagtcaatttctgaaaaatcaaatgtgttcctttggttcacctggaatgatgaaatcccttcctctgaacgcagtgaaatcagaatcacctgatttctacctgtggcccagcggagaaggccgtggggcaggtgttggaagggtgaacgttggtggtcccgccctctcggttgaagcccaggttggggcagtgggtgtgtcctctttctactccctggctggttctgggtctgacgtagagctcctgggctcgatttattgtttattcctctgaccctaggaaggcaaaacaacctctgtccttggtccttcctgtaatgtgcacgtgcatgtgcaacacacacatgcacacacatgcaggtacatgaaacaaacgcaaggagccctgaatcaggtgtaatcagactgtgcgtacattctgccgttgctaagaccaactccatgagctcgacctgccctgccctcattcttggtatctatgtatgctctgggagcttttttatattttaatttgcttctgaatgtcctgcagaattaacagtatctgtctgcacttttccctttttggctattgtgtgccgtacagtacgggaaggccgcatggtgtctctgatattgatagcctggttaccgtgggaatgaatggccaccacactctcaggcccacagccctccttttaattgttgacagtaaaaagcatttaaatgctgcttaatttgtaatcatcttctgtggggggggggggcggaaaggagaggagccattaaaatgtcagtaaaatgaatacatcctctccttttttgttattttgttttgcttatttatatggggtagtttttcttttcattgcccagtgtttgggagatatttaaatggcgctgaaacaatcagtatttcgttttattttgaatttctgtctcgcccaacccctgctcccctccccactccattctgtctccctgggcctttgtcttgcctctgtctctctctcttttctgtctgggtctcctcctgcctcctgcctctgcctccacctccctatctctggaatacattggggtttactggaaattttacatgagagcctagccgaggtttttgggtttttttcccccagagaacctactcctgggctgcagtttctctgcaggggcctcaggatgactttgggaatgtctgaaactagagagagtgaccatctatagaaagcatcttttacacgtgaagtatactggagatgaaagagtcctggggataacttattgttcagacaaggaaattgggtcttaccttcacgtggaaactccgtgcctcccgtgaagctctggacacacagccagaatgtaaatgcctactatgtgttggacactgtgctcttgtaatgaaactgctagattcagagggtctggttctctgacttgctctctatatgggctttcttgggggtcttctctatcattctgctgctgggggcttgggagagaaagctccccctccatattccccaccccaactgctcagccctcacctggcacagagaggcttcaggtactctcagacccagctactcaataattgcctctgtgagtgttcagccagttctaggaggtcttaagctgctaactggtagtcccctagaaaagggacctagaggttctctcaagtcctgtgaaattttcccatcttcctaaaaatccccatctcacagtgctgcttgagaaaggttgaacctagattggcacccagcaggtgcccagtcaatgttggatcctttctttgccttgtctgtgactgtccctctgtcagcctaagaatgtggttccttttagttaaagagattctctttagctaaaagaaggctgtgaagtctgactttgaaagagaaaatgctgacgtccatctcagtgggagaaaggaccattcaacctgccagcaccctcttcaatagaattgttgaatattagagtggagaaaaaccctttaaggatcacttatatccctcttcattttactgttgaggaaactgaggcccagaaaggtctagtaacccacccaggagtgcacagcgagttagtcactgagccaggacttgaggccaggttttgtactcttgttcctgttcagttgggagtctgcagtaaaaagccacgtgagggcaagaggatggctgggatgtgaagatcctggcctgccctttcatgctccgtcccgatgttcccccacccgctttggggcttcttttcctggaagcctctaagatcagctgaattcgagaccaagggacccatatttcttgcagtgctcatgcaaccttgcagagggttacaggcagaatacatgccagggaatggacttaggaagaaactgattgtagcttttggtttatttgctacccatctacccccaaatgcaggaagtagggagccctttggctttaggaaccctgagagtaaacaggtgcctgtctctctcctttgaacttcatttctacagaacaagcagtgtagagaaaccgaggaaaacagttctctgcatcttgggagaagttgttgagcacggggccctcaagtcggcaccctgcctacttgctccatcccacagtccatcattctcccagcctgatcccatctcagaggcacctctctgccagaacgggcagtccctgagagaggcttccacatcagatgccccacccagggttgggctgggttgggttgggctgggctaggctaggcttgctctgcagagctgggctaggttaggctactgcaagctgcccttctcctctctgggttgttgaagttggtccgatttttcaatcgtgggccaattagtttcacaaatgggggcccccgtggtgccagggcacatttgttccgggcctgcgcactggccaggccccattgttctgcctcccacccccgtgtgggcccattgtcctcgcccccagcgggtgctgcttactgctgatttatacgggcaggcgtcctgcgggctccaggcttctctgccacagctggcggaggtgcttaaggccttggaccccgtgacctttgccctagtcctgctgtcattttgaaagttacagaccagagggctgcatacctctccggatttactttccaccccaactcatcccccccgccccacccactctattgcacatacgcatgcgcgcgcacgcgcgcgcgcacacacacacacacacacacacacacacacacacactctctcacactccctttccttcttcctctgcttgctcttggagaagttttaattcattttggaatgtctggaagggtccagccactggactggaaaccaagaagaaggagctgctggggcaggtgggaggtaccagccgaggatattagtctctgctgatgtgcttggaagcagctacttcccggaatgtggtttttaatcctcggattcattagttccatatctgatgctgggaggaagggaggaggatgttgctgtcggtgtggcactgccagggaatcaggacttgatttggcttcttgcaacttaacatgcccccttcctgccagaggcccctgcaccctagaaagggcaacgcagcgtaggaggtagattgaatgtgaaggtggttttgtagcccagtacgaaaatgcagatcttgtcccctcttaacccgtttattctctctctccttgcaaaccaaacttctctcctcctttttttttaaaacctccttccctttttttatccaccccttttcttgtccccctccctcattttctccccctcttgggctggtttgttggagtgattgacaaaattagtaaatccattcatgttacttttattgtgcaggtctcaataaatcccccatgtccagggcgcaccttaatgagctagtgagctgacaaatttgtttactgtagctggaggtgccgagtaatgaaatgcacttgtgtctgcagctcactgctaaacaaatacacggttttccgggagccagctctgctagctgctgctgcctgaggacacagccacattccccaagagactgaaagttgtatgtgtgcatatgttttgaaaaatgtaatcactctctcatccattgcttagttttaaaacaaatctgaatcagctgctcaaactcctccccttttttgttatgcaatgaagatgcttttgctcccttgactgacggtattgaaaccgtaacattccccttttctcttgtggaaatggaatgtcatacagatgtatagatgccttccatgattctacgcagataagaaaggaaggaaaaaggggcagagagggctggataaagagacctaaaattgacaaggacgaaattgacaagtgatgctaaggtttttggctcttagcttggtttgggaagatgtaactgaacgcctcagcagtgggtgactctatatgcaggagacaaacacccatgcatgagctcaaagctaattgagtttgagacaagtcttcgaagatggtatctttgtgtattctaccccagtaaaaggaactggggaacttgtctcccactcaccagcagctgattggagtttccagggttcggtgggctgatttggccttcattgcccacatagctagccttctgaggaacgccaggagtacagtagtgcatctctaatgatcctgaaactcatgcccaagaggaaaaccagagaactaaagagagggctcttggccatttgtccagtagattccttgaaaaggaggtgagccctaaatgatagcacagtggaagtcaaaatggaggagccactcagattcaagggctggactttgttcctttctgtctattcctcaccccaccccagccttctccatccttttaagatgcagacagagccttccttccttgggtgggagtcagcctgatgctgcttgcctctgcctctctttctctcttgccgagtggatggtacagccctgctacctttttcagcagcaacctgggggcaaagggaggagaagatgggtgaaaggaaaaggcgtcagtttatatgatggtttgaatgtgtggtcacgaaggttgcccatgctggagatggtgtcttaggaaagagtaatcccccaggatgtcagagggagcagaaagacatatctgaaggatttgggggctgggggtggagggagggggaagtttctagtttaaatcaaggttttcacaccctcctaaatttgatattttctttctgtggggagaagaagctttcggggtggcaggggaggcagtccttcctttgttgggtgaggttgggtaggattggacgtgagaagcccctccggggtacatgtgcatgcacgagcacacacgggcatgcacacaccccagcacatgcacacacagcagtcccagcctgcttaccaaaaaaagctggagtatatttagatccctctgctcctttgattaagaaactgcttatagcaggagataataagagctttgctccaagaaggtgtagcacctgaacatcttctccagctgtgtacccctctgatcctcttccttcccatctattaaagagataattggtatggaaatggcacaggtgtaaacatgaggggttttgtgtttcataatttcagaccccgtcatcacctgggtgaaataccctaggtctgtgtcaccccttctgcctactattccaccctggcctggctttctccctttctctctctttctttctttccctctccctttctttctttctttctttctttctttctttctttctttctttctttctttctttctttctttctatctttctttcttttctttctttctttttctttctttctttcttttcttttctttccttccttccttccttccttcgttccttccttccttccttctccttttttttttttttgctaaaattaagcttgttttaaattggaagactttgagtcatacatgccctgtagtcaaaactggcagtgttgccactggggggtctggtgtgggtcaccttctctggagatagaattgatgcaaatgtggtcccagatatttgcatggatcctgcccatattactaagagtcatgttccttgagtcttgatagcatcatcctttctacatgcatccccttttcctacttcagattccctttgagcagataccctgggagtccaggctaagactgagtcccattcattcttcagaacagcagaggtgctaattccttgacctgaaaaattattttcttgggtcaaagctgacttatatatctgatttacattgaaatgtacagattgatagaaaacaatacatttttaggatttacataatcaaaaacatttgtcagttgcatcataacagggctatgaagttagggttggaaagggcaggttagttatgaattctcttatcctagatgaagaaaccaaggttaaggacaaccactgcctggactaggatcacaaatccaagaagggctgtacctctgggccagaattgggatctttggactgtttcactgtataatatggcaaaactgatccttctatggtctgggtttttgcttccgagcaacagagctcagacatggagtgacaacgaaggagtcctgtccagcccaccagacagacacggggggcctcagtgagatccgctgcctgtgggtcacttgtcattactgatttccaaggagagtcttgttggatgctcttagtagtggtttcatttgtggactgtagtctgaactttcctcatccctagccctctgtctgtaccatgactctcctcatacctcctcctctaccctttgtgattgtcttacaaccccttatttattttctaattcaacatgcagttattaagtgcctactccatatcaggctgtgtactgtgtgttggggaatataaagatgaatacaatagttcctactttggaggcttataatctattaggcagagctgaaagtccaaaataaatgcaatacagggctttacgtgatacaacagagctcagaggaagatggtgttgttggcactgaatcctaagtggtgtaactcctcaaagatgccttctctagggtcagcttcccagaaagtagcagcccaaagacaacaaaacagcttaggcatgtgtattgtgcagggctgccatgactcatgatccaggtcgttcactgcacaagggtgcccagctgaggagggaagatcccaaaaccctgccctctctgtactcaccataaatatgcagccaggtctgtggggctggccagaggaggagacgtgattttctaattcagatgaaggtgttgtttggccatcattggctctgtgaccacattataaagttttttcgtgtggatatctcattcgatgttcttgataaccacagtggcagataaggagcaaatggatctggtgaaaagaatgacttgctcggggccacaaggcaagtatgtgggagagctgggacccctgtgctgcttttccttcccctgtgtcatgtggaccatctgacttctgagggtctcgtttatccagtcagagcacctcccctctccccagtggtaccaggcctgacgtctctccatagcagaggacggaacccaggcgttgaagggagcagagcgttccagtgctgccgggcccccctgccccgccgcacatctcactgcagctaatgaattgctaatacaattttctagataattttatttccatagtcccacattttaatgtgtttccaaaagctagcatttatttgcttaatctcccagtgtaatagaatctgccctgactcatcatacatgcgaacaatcagctaggctgaaacgccagcaaattgtttaataactcacatctagtctctagatttttaactcgcatgcaccaatagcttttcttgtgtctcatccacatctcccccccttttccatttttttaaaaatacttttctatcatcatagctgttagtttctaagcagaaaaatggggaaagtggatgctgagtctcagaggctcccctttcttcccctgggagccttggttggtggatacgtgaccaaggagcacccctgcaccttgtggaatgtcccaggaaggggagagagaccactgtagggacatcatagtgtttcctttccagctggtgaccatatgacttccagcctgttggccagttgtggaactggccatctgggattttttgcgtgccactcctcccttgctgtcccacctttctaggattttctctctccctttgccctggcagcctctgccctggtctggtccctaccctcctccagtggcccatcagccctctcgctgcttctaaccgcttgctgctgctgttggtccccatgtgtgcccagagtcactggcttcaaacacaggtcagatcgtgctagcaccactcgtcttagtcaagtcaggctgctataacaaactgccacggactgggtggcttatacacagcagacatgcatttctcacagctctggaggctgggaagtctgtgattggggtgccagcatgttcaggttctggtgagggtcctcctcctggttgcagactgctgatttctcggtgtcctcacgtggtggaaggggctagctagctctctgggccctcttttacaaggacactcattccattttaattacctaattatctctcccaggccccacttcctaataccatcaccttaggggttaggatttcaaaaaaggaatcagagggggacccagacattaggatcatagcaaccctcggtcctttcatggcactgcattgcctgtagaataaagtccaacctgtcctgcctggcatatgcagccctctgatctgactcccatcaccctcccagcttgtctccatccccagggcctgaccttggccccatctgctctgacatttgccagtggtgtctctctccttagcctggcacatgtgtcccaacttcttgtcctttgcttctcagatactcaacttttaaaagcctaactcaaaatctcaggagctcttggagtcgccctgccttaccctctgggtggttgttaactcagcatctcccactagtctgggacccagtttctctgctcagccttagcctgcccctggtcacctagcacagtgcctgtacttggtagtggctcagtgagttggctgaatggacatgaagtgggttcaggccaccctgagaagtagggacagcatagtggggcagtatcgaggggccttggaaagaccaagggggcagagtgctgcagtctgccttgctgggtgtattgacactcagagcacctgtgggtctggctgtataggctgagatgtcctattgggaatgccattcatgttccctctgcccaggttccttccatgccggggatctcagaggatgcataaggagaagccttggctcttaaagggcatggctggcctccaaagcctactcaaccctactgatttaaggtagctgtttgaacacctggcttaatttgggctctctgtggggtgggggttaagggcagagagggagtagatgctgggggctctcaagttgaaggagtgggggccaccgggcacagaacgcattgcagatgcactgtcctcctgtgtacgtcggccaagcagggagggacattgaagactcactgtcaactcttggcattgcttctgtccagaaagatacatctctcattatgtctccctccagcaagtgaagctgagtagactactcagcatttctgagagaccttggtggctcccagtgggattggaaggcctcagagagctatgccttgtgacccagccccagctactgcccactcctggccaggggttctctagccattgctggagctgtactagaggcaggagtcctctgtaccgtccttactgggcctcttccagggtaagcccagacaggcgggcagtcagctccagaggtagcattgagtccagccccgtggtttctgaaagacaaaccgagatattttcagatcccaactctgcctctttctgtgtgatcttaggcaagttatttaatctctcttttacactggtaaaaagggggataagaatgcctgccttgtaggattgcaagttttaaatgaactgacaacatagataaggtacctagcataacgcctagattcgctccccttccttcctgctttttgttggccaggagcaaaatccagtgctggctgtttttctccttccctgctcagccttcctgactgctggtgagatggggcgtggctccaggtgcttagacttcagtgtctgcaaagggaagggatatcagggtgggtgtgaggggcacagaagtgtgggggacagtgagaggtgggccttgcctgcctactagtccatcctaacccagccatgagtgggacggaggtggtgaggaccagacctctcacttgctatctccattgatggccaggaaggcagggaggttcttcgtgccatcccttctcttccccctaccttccaccagacacttcccgattccatgctgagcagcccatggcttccagcagccaaagctttaccccctccccccacccactctggactggactgacagatgctaggcctacttacgtttcctgcttgtgccttcccacacaggggacagcggtgtggggccaagtgcaggtgatattgcccaggcaccagcacagagacacacagatgggcctgccggggagctcctgtgctcaggaaaacagagcccaaaagggtgggcactgagctgccagttaggactcagacacaaggtcagatacttcctcctgtggtgctgcagctggaaatttcggccatggctccagagcagtgtcagaaagggattggtaacaaacagaaaatggcagcctgtatgtgtggggtactttggggatgaacagccagttagaattaaatgaaaatctcacatcactcgctagctttcaatcctttgacagttgcccatcgggtttaggatggaactaaatctcttgacgtggtttgcaagaccctgcatggcctggcccttgcctttccctttagcctcctcttcttccccagctgcactgcaccattcctctgtctgatcctcccaccggccatgtttcctcctggcccagagtgttcacagacactattccatcttccggattccgccattcacctggtgttctgggtaacgtcggtcatgagagcagggactttgcatgctcttccttggttatatccccagtgccaaaaagacagccttgcttgtagaaggcatcaaataatacttgttgagtgaatggacctaagattcatgctttagtgagtggagaagtagttaaaaaaaaaaaacaaaacaggatctgtagctagtcttgggaaagcattaaaatctagggtgtgtgagtgtgaaccccagccctgccacttacgaactctatggcaggagtccccaacccccgggccatggtctgtgaggagctgggctgcacagcaggaggcgagcgagtgaaactgagctccgcctcctgtcatattagtggcgacattagattctcacaggagcatgaaccctattgggaactgtgcattcaagggatccaggctgcacactccttatgagagtctaatgataaatgtaatgtgcttgaatcatcccaaagccatcccccaaccatacgtggaaaaattgccttccatgaaaccagtcccttgtgccaaaaatgttggggaccactgctctgtgggattttggccaaagtacttaatctctctgtgcctcagtctccttgtctaagggatgaggataacagaggctagctttttgagttttggatttatattagttatgttagaacaatggctggcccatagtatctttgttattgttttttctcgcagggtctaccttgcctcccccactttttgccctgtactctgtgaagtccatctggtatatgctgtcttagtaccttgccgccttttacataccacccgacacagttgcccattacccttgctgctgcgatgtatttgatcaatgtctatcctttagctttagcttccagagctcgggaacgacgtcgattttgcccatcactggggccacatactgggtgctcagtgttgcatagcctgggcccactctggatttgcccctgagcatggggatttggaggtgtgagtcccgacactggctctcactccagatgggtaaagaatgcaccttgtattcccacctttctgaggcaccccctctcctgtctcccacaggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggtaggtcagtccagctgatgggtggatctgggtctctgggagccagcgtctatatttacctccaaggacgtaaagtggaggtggtgggctgagtcagccttcagtccttctgctcaaggcttggacgtgcagaggctgcccgtcgtgcaggtaaatgtggacagttctcccagtcccctcctgtggaccgtcggttcaaagtctttccgtgttcaacacaggatgctcattaaaaaggcaggctcttgggtcccactctcagaaccttttattccatgggtccagggtggggtcccagattcagcattattaatatgtattcccaagggattctcatgtaggtagacccaaaatgaattttgagaaaaactgacctgctgggtctcttaacattgtctgccctgcctcccaccactcttgatgccccgccgctctatccatacacatttctgaagtcagcttcgggcttctgagggcaagttgaagcagtgatcctactttccccacagtaacaaaggcctgtacttggaccttaaccctgtttagggaagacaaggagggcatttaaacgatgagcaatgaaatatcactgctcagccagttccaggtgatgggacaagggagggggtacgaggtaaggaggctgggccaggtgctgaggggctggccattccctgccaccagcctctagggcttcagggatggggacacttggtccctgatggccaagaggcatttgctttcctgcagcagctcccagttttccctaacaggggagtggatggcttaaattccttattttctctatgacaaaactggggctctgctgaaactacctggttaaaggaatgcccatttctgagtctgcctttgtgtgctgtgtttgtagggagggttggggtcaggtctctatctgggtatataacagagcgtatacttgtaaaaacctctgcatgccacgtaaaggaacagtaggccctctcctcattttgagagtcttgtcacagctcagagattgagtatgcagaccaggtcttgcatgggtggcaggctctgctaaataagggaagagctttacttctcatggactgagctggcctggccagccagcagcaggtatcctcattaaggagccttcctggctgtcacttctggatgccattttgttcaggggagcacattgtcttagcatcaccagatttgcacagaactacttaaaatttctgggacaggacggaggtagggcccagaggggtgggctcaataaaaagggcccaggagagtgggatgttgacaaggactttctctacagcgattgcgtaagcatttcccctgcagctatatgcaccttcctatgaacgcctccctcaacagttccccaggttcattcggtcttatgaaagatggctagatacctttcagccacttctgagcatgccactgggtccaatcagttggcttcatgtgacttgaatgatctcagtcctgctaaatccacccaggatgtgccctgctctgaccatgccaccttctcagagctcagatatgaaaatgtcacatgctcttgtgtcagtcatggctcagatccacggggaggggctgtttccagagttagggagaagcccttgcttattctaggaaacacggagcatgtgtgctgcctatgcacacacagagaaacacccatcaattttcacaccagcgaggcactgcgcacacaagccatatacaggctgtgcacaccccacacacaatgcctcattaatattccgttgttcttggcccatttgctgctggggccgggtgtttagcatcagcagctgtgtttggtaggttagtccagccgtgctcttggcattgatggatccctgattcacacggctcatcatataataaactctcagctgtgctgaagggaggggctggaagggaggggcctgaggagccagcaggatggggctggggtggggaggacgacagacactgggcttggccagtgccagagaaagcaccaagtaaggacagattggggggggcggggtcacaggtgcactgggcaggctggagggggctctaattagtctcgtttgtcctgcacttaatgtcaagctcattaaagaggctacagagttaatcaacataccacaaattggattttgagttctgcagccagttttgtgtacattatggccacactgacacaatcagctctcagggtgaagatttcacgccaggtgcacaccgtgcttccaaatcgggatggggatacgtgtgtgttggtgactttttctttcttttttttttgttgttgtttgtttttccttctaagttctttttattcttttccctgggcagactcaagaatttcctatttaaactcatttaacatgtgctccacttcataattaaattcctaaaaatcggatcaaacaaactcctctgtcttaaccctttgttttttaaattgttagggacccctctggaggggaaaggcacaggcagccgcccccttcccccccaccgccgccttcacccccacccggctgggtggctgccgatgtacgttttaattaccggctccggctgaagtctcacgtggccttggctttatttatttatttataccttaatgaggatactgaatctttgattaaagtcgtaatcgttgccgattcagtaaggagggggagttggatgtcagaccagacagggctgtgagtgcagacacacggagagagtgggttcgggtgcacacacagactggcccttactgtgttagacacacaactaattagtaccagggtctgcacaggcctccactcccttgagtttgatggggctgggggccaggcagtccgcatggctctggcagtgaggatgggcaggtagcaatttccccaactgagaaccctgggccttggcccatccccagatctgcaggtgagggactcgctggccgagcctctgagccagtgcaacaccccatagattggggtgaactggtgtcaaggcacgatgccactctttgagcttctctcatctgattccctgatggaagtgcccctctcatggcatgggtgcttcttgcaaatcttccacccatgagaaagtcactgatcagaccccagcatccgctcccctcagagccctaaaaacccctcagagccatcagaacagatgagaatttatgtgggtacaggggcctaactttgggaggggggagctttggttagtggcccgaggaggggagagacaggagagagtaaaatatcattttaaaaaggaagtgaaggcacaggcatgcgagtctataacgagaaggacaatttatgcccaggcacgagcgcagtttgacatggggataatgcaaaaacgtaggtcattgtggatgacttaaaccttcagcagctgaagaaaatgtatgaaatgcagaggacattacacggttggcagccccgcacatctgcagagggacaagtgaaatacagtgggccattctttaccataaactgtggttgttggagatgcagcccagagaaattgtaattacagtgacaagacgaatcagcgatatttaaatattcatgaacaaagtctggggtgatcaatctatctttattgtctgcgccttcactcctgtaataaataagtagctggagtcctcacctttcatcccccaagccccccactttggatatgaaaggcaagatggttattctccacaccccaacctctcatgctctggagatttaagagtgggatcctcaaaaaagaaaaggcagttctctccaagtttcatagacccaccatttcctgggtctgttctggatcctccctgtgcgatacactgaggctacaaggatgggtgaggcttgcttcttatcctggtggtgcttccatgctggaggtatggtgggcaagccagtagatacagcatagtgtgtcagcaagctgacaagtatatggtaccctgactctagagccagacccaaacctgaatcccaactcagctccttacttgccgtttcaccttagggatgatgtggaagcatctcatttttttctcaactgtaaaatgagactaatatctttctttaagtttgttgccatgatcatctgatgcgatcacatcacacatctgagtgctcaggaaatgtagcccattttaatgcgaaagtggcataaaaatgataccacactaataacagaacaaaattctgggcatttcttctctttggggacacagaagaaagtgtgattcattctgcctggggaactaaagggaagcgtccacgcgggggtatcatatgagctgggctttgaaggatgattaggagttcaccagggagaaaagaagaaatcgagcagaggaaacagctatgtaagactgtggaggaaggaaattggggactgtagaaggtgtttgggggacaatgtgaagttcctcaaattggagagatttctttgaaggttggggagtcaggctggagtgactttcacccttaacctaaaggaaggggagaagaggtcatctgagaagcaagatggtgaggtctcatgtatccacaagggggcttgctttctggggactgctgtccatccctgaaccaaatgggctctctttcccaggactggcccttgccccacagatgatcatggggccacagtaaagtatggtcatgtgtgaagacaggtattgcttgtttattcaatggaggtgtggccgtggatccttaagttgtctttggaggtggtgaatacaggccgtcgcatccttctcatgcacagaatgtgccctactgtcccctgaagagggggcagggagaggcaaaggcctgatccagccccttgtctccacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtaccgaaggccagggaggggcctgagctggctctgggacctgggcggaggtgggaagcagatagtctcctagagaagcctaagtgaggatgatcccaggctgaatcaaagagtagaagaggttctattaagagctggtatggtggcctgaggaccaccacaccccagtcaaggtggcctgagggccatcagtcaaggccaaggcagacattactaatcaatcccagcacactttccagtgagcccccatcagccctccaggcagctataccagtagttcagaggtgacatgcaaaatgatgtctgtatatgagtcctgaattaggggtaagttggtccaattagctgaaagtgaaggttagggtaatttcatgttactcaagggttagagtaagaattaggatacattgaattaggttgttatgaaggttgggaagttgtaaagttagattgtgtttggttctgagattagaagagcagatatatttaataatccctatatgcatatgatgttttaccacttcagagtgccttcacatttttttttttttagacggagtttcgctcttattggccaggccggagtgcagtggcacgatctcagttcactgcaatctctgcctcctgggttcaagcgattctcctgcctcagcctcccaattacctgggattacaggtgtgtgccaccacgcccagctaattttgtattttttttagtagagacagggttttgccatgttggtcaggctggtctcgaactcctgacctcaagtgattcacccgcctcggcctccaaagtgctgggattacaggcgtgagccaccgtgcccatccacattattttttgtattggaaaaagaaatgtgggccactgttttccctgaggtcaaaagacaaaacaagtgaagggtcttccacagtttcccaagttgggggcagtgaagtcctggagcttgcttgtgaaagctaatttttcacatttcttcacaacttcaagttcagtgacaccaccttagttgcttaaaattggccactgtaggagtattcacatcatagcaatcagcagatgctacaaaccagggctttttggaaagccagtcatgaaacatttaccaccagcacactgctggttgtggggaaggttgatttacagaagggtgagaggtggtggaagctggaaaacaaagacgccccctctgatcaggggagacagctgtcctgtccagaggaagggggagaggtggcttcaggcaggtcctgctggcttagaggagagtacgttgcccttggaggggaagggtggacagaaggagcagtaagcagagctatgtgttgtcagagctcgtttttcgtgtcccagtttgagcccacaaggagagggttgggtgtccgttgatgacaactatagtggcccagaggatttcccagagccctggggtttccttagccccttgtcagggatgtgacctggcaggtggatcattaactgtattggcagtgactattgtaaatagctggtcgatagttagatcactttggctgttcattacttcattatttgctggggcctgtgcgcgggggagtattgatagcgagatggctggccagttaattactgtattgaaacaaggttcccttacatcctctgctcagctctaggggactctatggaaggaaagttggggtatagaacgctagggtgtggctgtgcactcccaggttctttatccctcccatcccaccccacccccaattccagcctcaggagggaggcagggtccagggcaaggtcttagcggttttagcaggataggccgggtgggggagctcatgcctataatcccaggactttgggaggccgaggcaggcagatcacttgaagtcaggagttcaagtccagcccggccaacatggtgaaaccctgtctgtactaaaaatacaaaaattagccgggcatggtggcggcacctgtgatcccagctacttgggaggctgaggcaggacaatcacttgaacccgggaggcagaggttgcagtgagctgagattgcaccactgcattccagcctgggtaacagagtgagactccatctcaaaaaaaaaaaaaaaaaaaaaaaaaaggccgggcgcggtggctcacgcctgtaatcccagcactttgggaggccgaggcgggtggatcttgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacacagcgagactccgtctcaaaaaaaaaaaaaaaaaaaaaaaaaagagagctttagcaggataggtgtccccaggtgcagcatatttgaaggactgggttccctcaatttccccccacccctgctccccaccatctgtagccctgaaaggtctcgatccacctgctctctggacggaactgtggcttgaagagccattcctgaggactttggggcctttctctttctagacacccattttcttaattagaaagggaaaagactgtggccttgggagagttaagaatagtaagacaaggagctgggcaatccagtagtcaactagctacatgtagctatttaaattagttacaatgaaataaaattagaaaactgtagagctgcagtcgcaccagcctcattcatagccatgtgtgactggtggctgccgtcttgggtggtgccttcattgtcccagaaagttctgttggagcaagcccagctggaggaacccagcttccctggcacgcctgagggtgacatggtgccctcaccgccttctgtctgtcctcactttctcctgccctgtccctccgccctcaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaacctggtagctttttggccttggattctctctgggctccagatgacctggatgccaagccactgcccctcctctgggggcctccaccctcctctcccggctggaggtttgcctgattttctgggatggggttgggtattttgttcactcaaatggtggcacatttttctccttccttcacccagaccttcttttatgtgtccagaaatggaggctagaaagcaggtgagaggtcctctggtcagagccacacggtctgtgccggccttcctccaccaagacccccaggagatgaagggagggaggaggtgagccagaagggcgctcccctgctgatgggtctgggctgggtcactagctgctcaaaatggcagctctagtttgctggcggctgactggggaggagaagggctctgtttctcttcccaccactcagcccacctgctgctttcctctgctttgccacatctgggtgtcccccggtggtctctgagagcctcaggacccctgcccctcctccagctctttgttcccagcctccccttgactcctgtcctccaagtcccaggggagtcccagcccctcagggacctggcggtgtctccatccttctccggttccctagtgggatagctgcctctgacttcagggtccctcctaccctcagccttctgagaacacaaaacaaatccaataccccaccctagtccagcaccatcgtgagcaagattcctgctgcgctgcttccaaaatggaaaagcatcacaactaaatacctaatatcctaccaaacaaaccacagtccctacgtagccctacttcagtcccaggagaaggaatccatgaatgggctgaggttccgagggtaggttgtggatgtctttctctagaggggtcccacacctggaaaagaggacacccagcccgtgggatgagggaagctgggcaagggagaaagttgttgagtcacactggggaccccagatgtagtgagctcagcaagaaaagccaggtccagagagagtcgcacagaattcctgactcacagcgcccctcggtccacagtggagaggaggaggaggaggagcagaaggagggggaggagctgcaggaggaggaggatttgaaagcgctttggccttgtgttatgttttgcttcttttctgtgtcccctgttagcacattgtacttgaattacctcagttttttgtgacctcatgagctttcttaacctctgtatctctttttcggttggggcttggaggaatggggagggtgttcttttctgtttcttgtgtaaattaatagttgtttttatagacttcagctggtcaagaccctccccgtgcccctggagaccagcctcccagctggcaggaactgtgcaggaggagttgatactcaggatctgaatgtgagggccgaggagggcgaagagcgtgggtggggaggggatgttgctttggggtctcatggtccccagagggcactagggagtcacttttggctccgctggtgcatgaagtcacctgtggccaccatccgttccgcctaaaacactctggagagaatcccacctttcttacaatttgctgggccattgaggtttgagggcctgtgtttggatccttgcaactgtgtggtctcacctctgtgcgtgcattctcattgccagaattggtctattttcacggctggtctttggggaggggggcgggatccagcctttgttttgttgtgttggggtgggggtgttgtttttctaaaagctacctcttatgtttgtccagttgttcttttgttcctttcccgcctcccattctgctgctcttcctccctcttttccccaacctcccccgaccctcctgaattttggaaagcacatttgcaatattcgtgtttgctttgggacggaccctccgtttcatctcatgctttatgtgtaagagttttttattattatttttt

SEQ ID NO: 16145 - DNA, 22980 bp, Human
cagctcctctcccctcgccacgggccttgtcaggaagcgaatggctcaaatggtactgacagagcgcagctcggtccgccgccgccttctcctcctcctccccgccatattacggatctcaggctgcaacgcgggctcctggcaaccgccgccgctgccaccccgactccacctctcagggccggcacttccggtggttgattcccgggctgttaaaaccgttgggccaccagaacactaccatccccgaggtgcattgcgcgcccgcgatggaggacgtaatgcttacggccagcacgctgcacgccgggaaacgtagtcttccttgcaagctagagactagaatttattaataaatttacttatttagtagaataggaacacccctcagggtctgaagccccctgaagtgttccttgaagttgccatttttttcttatctgtataaagataacccctttctatgcagccgttagaaaacatgtaacattcaccaaaatattttcttgtaggtaaaaacttgctgaacccaccgggcgtgatggcttacgcctataattccaacattttggaagccgaggcggaaggatcgcttgagcccaggagttcgagatcagcctgggcaacaaagggagacggcatctctacaaaaattttaaacgttagccgggtggggtggcgcgagcctgtggtcccagctactcgggaggctgaggtcggaagatcgcttgagcccaggaggtcgacgttgcagtgagccatgattgcaccactgcattccaacctgggcgatagagtgagactgtctgaaagaaaaaaaaaaaaaggctgaatcctagatgccaactggaaggcttaagacatctatccccttttgcaaatcagtgggaaaatgcactaaaggaaaaaaaggtaacagaaaaatccctgaatatttttgcaaagttctctacataaaaatgttaccagccctccaaaatatgtccaggggccccttttcactccctaactcggcttcatggtctatctctcttaccctccttccagtgcctgtttttgcatatgtaaaatgggggttttaaaagtgcctatcacaagggtggttgtgaggcacagttgaggtaactcctgtacagtgcctggtacaaaagcccttagcagaagtaagattagggggaggaggagtgaaaatgtcacaaatcactggggaggcctttatgtcagtccccaccctgccattaactgcttaattcacctatcctcagtttccgcatctatgaaataagggaatccttaaaaccccttccagttttataatccgattgtgccttctttgctaggctcttccagtcccccagaatctggaaaataaagtcgattgaaatcagtctcctgatagtaactgttaggctgtattgagaatgagataagcatataaagtgtttgctcgtcaagtacctgggacatggtaagtgctctgtaaacgttaggtgtacttgctaacttttatttcctcccacaagaatgtgaatcccataagagcaaaaaccctgtaggtcctgttcaactgtgtccggagcacctggaccggtatttggcacatcttgaattgaactgaactgaactgaattgaattgaattgatagtctaagcatcctgcctctccaggttccctggaattcagtttcctcaagggcagataaaggagtcactaaaatcccttccagtcctacagctttaggatggttcttatccctccttttctcgcctaggagtctgaacgcccaggttgaagttcagacctcggaaaaccctaacccaccttagatttggaacgtgagcctggggcctggggcctgggccctcccccgttgccatggagcggctccgcccactggcgctgcgaatcccgatccctgattggctgggcggccgactccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggtgagacccccacgttcgcgcccctcggtcctcccgagagctcggacttctacttttccttcccagggttccccgatcttctcaggacggccttcccacttcctcattcgtccacaaggcacactcccggcccttgatcgctcccagtgtctagggatctccggacttgaggttttatatttacagaagacagcagatatgtatatagtttctgtgcgcctgacgctaaggttacatacagccaggaacaaggtcaaaagtgtccctggtttacagagtgtacatcggaatgggggaggcaagccttaaacaagtaaacacataaatgagataactttaagagagtgaaaggtgcaatgaagaaatcgggggaactcgaaggaaagagttacgctattttatttagatggaatagtcaagagaaatcgtctccgaagaagcaacatttgaacagaaaccggaattataaggagccaggcaggtgcagaaggtcctgagatgggaataatataggggtgttcaggtaacagaagaggcagtgtgtggcctgacttcaaggaagagaacaaagactggtgtgtgaatgaagtagaaaatgggtcaggtcaaataggttcttggtcagtaattgaggttagtctaaatagatcacccttcacaagacatacgtttgcttgtcttgtaaatcacttgagtcatttccttatcaccttttccccagacacacacattcgcactcgcacaaccctggcagctggactcacatcagtttctgccccctccttttcacaaggcactcctgaaacttttgatacctcccagctcttggcattctcctagcttcataataatgacagcttacagagagggcttttcagtggattaggcacttttgcatctgtgtaaatatatctgattctcttcttttttatttttctctctcttcttccttccttcttcttcttttttttttttttactttacagagtctcactcttttacccaggctggagggcagtggtgcaatctccacgcactgcaacccctgcctcccgtgttcaagcgattctcgtgcctcagcctccggagtagctgggattacaggcgtgtgccaccacgcccagctaatttttgtatttttagtagagatggggttctgctatgttggccagactggtctcaaactcctggcctcaaagtgatccacccgcctcggcctcccaaggtactaggattacaggcatgagccatcatgcctggcctccctcatttcctttttttttctttttttttttctttttttttaaacgaagtctcactgtctcccaggctacagtgcatcggcgcaaccccagctcactgcaacctctgtatcccaggttcaagtgattctactgcctcaacctcccgagtagctgcgattacaggcatgagccaccgtgcccggccaagatttatacttttaaagctgcactctggcccatgtggagaatgtactgtgggtgtaatttcattcctttgccactgtttatagtagtgtatctgtttttggaatacactcaactcacatttatcaagtttttccttctatatctcatttataatctaccagaaattctagcactgtcagaaatgtatatatgtatgtatacattcgactttaccaataattttgtttatttatttatttatttttgagacagggtctctctctgtcacccaggtttgagtgcagtggggcgatctcaactcactgcaacttccacctcccaggttgaagcgattcttgtgcctcaggctcccaagtagctaagattacagatgtgctcctccactcccagctaatttttgttttttgtttttagtagagatggtgttttgccatgttggcaaggctggtctcaaactcctgacctcaagtgatccacctgcctcagtggattacagagtgctgggattacaggcaaagtgctgggatcacaggcatgagccactgcctggccagctttaccagtacttctatgttattccagtaattgagataaaaagatgaatccctggttctaattcacatattagtatatataggagatattgcaagttcagttccagacctgagtaaatagtcaataaagcaaatatagtaataaagggagtcacaaattttttggtttcccagtgcatataaaagttatgtttacactatattgtaatctattaagtattgtgtatgtatatatatatatatatatatatatgcacatacacacacatatataggttttcatccatggttcctggctcataactctcagcccttgctacagtattttgttaggcatcctaggccttaggagcaggccttgggaaacagaatctctcctgccctcctttcacctaccccaaggcaggactggaatctttccctgtctttcaaattgtgagtcttaagaccctcctcagagagggaccccaccctataccctgggggaaggaatgctgacatcatgaagcttccataaaaacctaagaggaattaaaaaaataaaaactaaaataaacctaagaggacttgaagccaattggtcagaagttccataggccccagcttgctatttgtgtctggaggagggtggggtgcagtcttggggaccaagccctcaacctatgatctgacactatctccaggtagatagtgtcaaaattgagttggaggatacccagctggtgtccactacttattggtggggaaaaacccccacatttttggtcacagacgtcggggttgattgttgtgagagcagagggaaaatgtgatgtgtttttccaaaatagtcgtacatctgtatcacatgggaaaaggaaaagatttaaataaagcagaaaaatctccacccataaaggacgttattgataaatttgactatattacctttaaagatgtgtttaaaaggacataataaataacaatggctaacatttattgaaatcttaactattcactagcacagtgctctgtgttgtttatgggtacttaaataaaaaccggtaagggagtgacatgagaatgatatacaccaactttaagatggtaattacctctggagaggaaaggaggagaatgaaagggagaatttcagctgtatctgtagtgttgatagtaaaactgaagcggataagagtgcaacttctactgcatcctagcttgtgcagccctgggcaagtttcctactctttctttgtctcagttttcttatctgttaaatgagaatattaatagtacctgcttcagggttgtgaggatcaaataagttaatacatttaaagcacttagaagagtgcctggcaagtagaaaaggctcaataaataatagtttttgtttttgtttttgttttagtacagaaagagactgaggaaattaggtcaaaatattcacatatgttaaatcttttttactgtagatgtttgcaatagaccatgacttaaaatattttttaaaaaattaaaaatcttgatcatagctgggcacagtggctcacacctgtaatcccagcactttgggagactgaggcaggaggattgcttgatctcaggagttcgagaccagcctggacaacatggtgaaaccccatctctacaaaaaatacaaaaattagctgggcatggtggcacgtgccggtagtcccggctacttgggagactgaggtgggaggatggcttgaacccaggaggcggaggttttagtgagccgagatcatgccactgcactctagcctgaacaacagagccagatcctgtctccaaaaaaaaaaaaaaagaaagaaaacttcatcgtaatgagcatttcacatctttattgtgatgaggaagccaaggaagcaaacattaaatagtgtgtctccagaggagcatggctcgtgtaatttaaggttcaaattctctttttagataaattctaatctacctcatcaagcttaacaacttattggccaacagccagtgctgcttacataaacaaaatgtgatatgtcctagaagcaggcgtggtgtctttgtggtagagggtggaattaaaccaacaaaaacctgactcatttatgccaaagtagtgaaatatctgactaatcaacaaccgtagggtgatcatcagaactgctgtaccaacaaatagtgtaggtaaacagtggaattgtctaagtattcataagccattgatgacccatatagttaaacatccagagaaaacataagttcctgaagtctcctagtcttccactgtgaaagtaagaagagtgggaaaattaaagtttttaaggaatccatcagttaggaattgaagtaaggttatatacacagaaaacagaaacagatcaggattgctgtttggtgggggaagtggaaggaaaatgaatcaaaaaggacagctgtcttaggagccctgctggtcttttgggtggttagatgcaaaataatgtttgtggccatttgacagtaatattcttgatgtttttgttaaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggtaagtagtttattgtcacttaaacagatcttttagcttttattggaaatgacagacactggtgccttctaattacatctgccccaggagagttgtcttgttttgttttgaactgtacgtaggtcttgtaagtaatgagcaagtgccaggaacaacagaaatttggcattatgtttttaatctttcccactgaggctaaatttggcttcagaattattctcaagataatactgtctagtcatagaatcatgaggctgaaagtcattgcttggcaatcttcttgccttcaggtgtaccaagaagcaaattatacattcattaaaagcttcaagtaacattataatatcacattttaacttaacccatttaattcttctgatcctcataacaaacttctgaggaatcacagaattgtaggaatagagagtatcctagaaatcatctagaatagcactttgcagtagaactttctgcaatgatggaaatattttatatctgcactgtgtaatatggtaggtacttgtggctattgagcacttgatatgtggctagtgacacgaggaagtgaatttttaatttaaatgtaaatttaaactgaaatagccatgtgtggctaccatataggatactacagatctagatcaatcttgcctttagatataatcccagaaaagttaaattatttactcaagggcaaataactagttcataaagaagccaaaactagaatctatcccaagttttagtccaaatcatgctgtttttagctgcccccaatgtctttcaaccctgtaagagcaaaagttctttcagtgtctaatttaattccttcctggtagagtgtaaacgtagcttccaaagtatatacactagagctaatcttacaagatgttctgcaaaaacagggttcaagtaagatcaaacagtgtattctgaatacttctgttgtggataaacagtccacatcagctgattcttacttgtaacttagcttttctcaaacttacatgatcacagaacctacatcctcttccccacttacagcggtaaacacccttggaattggtatgctgagtaatatactgtactttggaatgtggttatttaaatccctctctgcttgtcatctttgcagtactgaaaagggtgtgctcactggttattcatgtaatatcaattatccagacaatgatcgattctcttggaaaattaagtatttgacccaacagttaagttatactttttcctaaaagatgatccagacctgttttcctaggatctgaaaaacattagtctgccgaaggaagtcatactgtaggcaggaaagaatattggtaacacttgagaattatgagtccaagttgctagaattgttcttgagtgtcatcagatattgtattgctctgcttatgcaagggaaaggctggtttgaatattataatgacattgcagctaataaaatgtcaggttcaaagttaatacttaaagcaaaaatgtttagggtcatcattacccttaaaaatcctttaagggagcactgagtccatttctctggaatttgtgcatcctaggaaaaaaaattgtgattttcaaaaaatcccttaagaagacagcaaaggcaacatattatctcagtgtctttaacacaaccagtctttgctccactattggaacagagtgtgttctatgattgaaaactaaatgaagtaattggcttgtgtttacggattatgttgtgggaaaaaatagatattttctctagaattatgctcagtgtgatgagatgcttgtcctgagaggaggataaggaggaaactaagatcagccaaaggaataacaaattcaggtctcccatcttttactctcagggaatagaaattgattagaatggctgggataattgcctgtaatgtttaaattatccttatcttttttttttttttttttttgagttggagtttcactcttgttgcccagtttggagtgcaatggcatgatcttggctcactgcaacctccacctcccgggttcaagtgattctcctgcctcagcctccagaatgctgggattacaggcacatgccaccacacccagctaatttttgcatttttagtagaaacgaggtttcgccatgttggccaggctggtctcgaactcctgacctcaggtgatctgcctgcctcagcttcccaaagtgctgaatttacaggcatgagcccactgtacctggcctatccttacccttttttaaaagcatgatcttacagttgaaataatgcagttgaattagcattaagttaaataataattttattatgagagaaaagctaatttcttttgtatcaagcacttagttttcattttctttatcagaaaattatgtcttagaacattatttattttaaacagttgcacttaaataaatacacaatacagttaacagatttatgtattcctaagaattcctcctgcatagcattctattagggaaattacaatctgaaaattaagtctttgagttttccaaaggtggcatatactctgccctttgggaagtagggttattaataatgttattaattcaatagaaattcagtgatttcttaaaaattaaatgatttttgttgttgttgctggtctttggtcaagaatatctgtatttgaacacatggaggttcctgaatgatggagcactcagaaagggcatggaagctctatgcccctttccccatacctcaccctacgcatgtcttcatctgtatgctgtgtaacatattttataataaacctgtaaacatgtttgagttccgcaagccactctaacaaattaattgaacccaaggaggaggaggtgggaaccccaatttatagctagtgtcagaagcacagaattaccagaaaacaaatcaaaacaaaacaaaacaaaaaacagaaaaataacatccattatacaatataagaaaccaaagaccatcaatctctaatctctgtgctcaggtgtctgtgtgcttcaattcttctcatctacgagtcttgggttttcaatgctcacttgtcaccaggatatgaattaaaaatgtcttgggcaccaccatgtggtccagttgtcttaacctttctaaaagtgcttgtgcaaaccatttacttgttgcttcttacacaattacagcccaacctacttgtgtttaaaagcaaccacagcatgtttgaaagtcttatgcaataaaagggaagtttatgattacatttagtctgtacttactggatactttcagttttatcagttccaagtacagcaaactctggataatatggttaattacttcctccatgattctttcgaccttcatatcaattttgctaaatatggaatgattgactagccagagcaatcaggaaagagaaagaaataaaaggcatccaaattggaaaaagaggaagtcagattgtacctctttgccgacaacatgattttgtatgtagaaaaacctaaagacttcaccaaaaaactgttaaaactgataaacaaatttagtaaaattgcaggatataaaatcaacgtacagaaatcagtagcatgtctatacgtaaataatgaactagctgtaaaagaaatcaagaaagtaatcccatttacatagctaccaaaaaaaaaaataacaaaatacctaggaataaatataaccaaagaggtgaaagagctcttacaaggaaaactacaaaacactgatgagaaaacttaagaggacacaaatggaaagacatcccatgctcatggatcagaagaattaatattcctaaagtgaccattctactcaaaataatttacaattcagtgcaatccctatcaaaatatcaaagacattcttcagagaaatagaaaagcaacaatcctaaaattcatatggaaccgtaaagaagcccaaatagctaaagcaatactgaacaaaaaggacaaagctggacatatcacactacctcatttcaagatatactacaaagccacagtaaccaaaacagcatggtattggtataaatactgacacacacacacacacacacacacacacacacacacacacaaaacagatacatagaccagtggaatacaatagagaaccaagaaataaatccatatatttacagccaactgattttccatgaaggcaccaagaacattacagtgggggaaaggaactctcttcaataactggtactgggtaaactggatatccatatgcaggataatgaaactagacccctatctctcactatatttaaaaaatcaacacaaaatggattaaaagtttaaatttaagaccagaaactataaaactactagaagaaaacacaggggaaaagctctgggacattgatctaggcaaagattttatggctaagacctcaaaagcacaggcaacaaaaacaggcaaatgtgactatattaaactaaaaagcttctgcacagcaaaggaaataatcaacagagtaaaaagaaaacctgttgaataggagaaaatatttgcaaactattcaacagacaagtaactaatatccagaatatacaaggaacttaacagcaaaaacaataataatcccattaaaaacatctattcaaatcctaatttgaataaacatttttcaaaagaggacacacaaatggccaacaggcatatgaaaaaacaccacaaattattagggaaatgcaaatcaaaaccccaatgaagtaccatcttatctagttagaatggccattatttaaaagatttttaaaataacagatgctggcgaggatacagagcaaaaggaactcttatattctgttggtgggaatgtaaattagtacagccattatggaaaacagtatggaggtttctcaaaaaactaaaaatatagaactaccatacaatccagtaatcccactagttggtatctatccaaaagaaaggaaactagtgtatcaaaggcatacttgcacccccatgtttattgcaacactattcacaatagccaagatacagaatcaacctaagtgttcatcagtggatgaatggataaactgtggtaaatatactcaatggaatactatgtagttagccataaaaaaggatgatatcctgtcatttacagcaacatggatggaactgaaggtattatgttaaatgaaataagataagccaggcacagaaaggcaaatattacatgttgtcactcatatatgggagctaaaaaagttgatctcatggaggtagagaggagaatgatagttaccagaggctgggaagggtttggggttgggggaagaggagaataaggagaatttggttaatgagtacaaacatacagttcgatagaaggtataaattctagtgttcaataacatagtaaagtgattatagttaacaatctgttgtatatttcaaaatagctaggagatttagatgttcctaacacaaagaaatgataaatatttggggtgatggacatcctaaataccctgattttatcattatacattatgcgcatatcacaaaaatatgtctaagtgtatagcaataaaaatgtggaaaaaagaatatctataatttggttcaaattattacagtaggacaggcgcagtggctcacacctgtaatcctagcactttgggaggccaaggcaggtagatcacttgaggtcaggagttcaagaccagcctggccaccatggtgaaaccccgcctctactaaaaacacaaaaaattagccaggcgtggtgtcacacgcctgtagtcctagctacttgggaggctggggcgggagaattgcttgaacctgggagttggtagttccagtgagctgagattgcaccactgcactccaggctgggcaacagagcaagactccgtctcaaaaaaaaaaaaaaaaatcttaaagtaaagtatctttggactttgctacggtcgaaaaaaggaagttggagaaaacactctttccttttgattgagagacatatgcaaaatgtttgttgcaatacagtttatctgtttctcttttttcctacaacgtattttctcttctcttacaggaatgatttccctgatgaaaagatccctaccctaagggaagctgttgcagagtgcctaaaccataacctcacaatcttctttgatgtcaaaggccatgcacacaaggtacagtttaaattgtggacttcactttgttaaaaagacatcttatttcattgacggtcatttccgaagttacatatattttgttatttattctttttaaaacttatttttataaattgtatttgtttaatggaagtgtacaatgcaggaatctatatcatttaaggaaacagtgcattatggaactttttaaccttttatggaaactttacaaaaccagcacaaaatggaagagtcaagtttctattatttacataaagcatttacaaaagatattaagtaaacagtaaaaaaggcatttctagaaaaaaaccactgtagtaaccttgagttacttgaaaaaaaggaattccgaagttgtacacaagaccagttttatctagcttaaaagttaagggccttatatggacaactatggactgcatttaaagagaattcctatattaaaagcttctaatagttaacagaacatataccttttacatagatgtatccctttgtataatttatatcccttatgtatagttttttattcattgattttagcagttatacttttatcagaaaatcatttattttcttcaaatgtatttgacattcctagataaaattttgcttaaattttagggcctgcacttacactcataagaacatattattacagtgaaaatcagtgggaagatatgattctgattacatttgttctcttataaccagcttttcaagtgcaagtacttttttccccatttgggcaacttgagtatttttcccctagcaatattaataatcggtaagggccatctactggttgagaattctgatgatgccaatttttttttttaattaatcccatgatatcattgaaaccagttgttaaaacccaaaatgggccgggtgcggtggctcacacctgtaatcccagcactttgggagtggatcacctgaggtcaggagttcgagaccagcgtggccaacatggcgaaacccctgtctccactaaaaatacaaaaattagctggacttggtggcgggcacctgtaatcccagctactcgggaggctgaggcaggagaatcgcttgaaccggggagacagaggttgcactgagccgagattgcgccagtagtactccagcctgggtgacagagcgagactccgtctcaaaaaaaaaaaaaaaacctgaaatgtggagcctaagtatacactctaattttattaacagttaattcctatttttgaagaaggaagataatggtaactaatttattattctagtaaaccgatagttgtatacgtctaggttttccaattggtctgcgttagaatcacctgtacctattttaaaatataaattcctgggccattctccctagggaagagattctgaaaatgtctagggtgggctcaaggaacatgtatttttaatgagcacctcaggtgctcattgttgatgttgcagcccacatttgggaaccctgataggtcctacatttcacccatggtatactgacttttatgcttattctcttagattttttgagacagagtctcactctgtcacctaggctggagtgcattggcgcgatctcggctcaatgcaacctctgcctccggggttcaagcaattctcctgcctcagcctcccaagcagctgagattagaggcatgtgccatcacacccggctaatttttgtatatttagtagagatggggttttgccatgttggccaggctggtctcaaactcctggcctcgagtgatccgcccaccttggcctcccaaagtgctgggattacaggtgtgagccaccacgcctggcttctcttagaatactttttaaaaagaagtagacatttaaaaaagaaaatctagctatttgagtcttctgaatgggtgctcatgggtgttcagccaagactgggtagaacatagtgacctaattcaccaagatggtagtagaaaggcacaagtgtaggcaacaaagtggagctagtagagcacagtggccaaaatcatgggcttgggactccaacagtccttgactgagctcttactacagggtaaccttaactttgatgagcttcagtttcttcatgggtaaaatggggatactaaaagcagttaccacataaggttgttgtgagaattaaataatgtaaatgctaagagtttacagtgcatgtctttgttcaaacagaaaaaaaaatgctttctatagcttgccttcagttgcattagcgaagaggaggcatgacatggataatttgtgtccttttttattttggtgggggaatgcattttgctcatcatatttggttaggggtatgtgtaacattccaaaaattagcagtgtttcacaaattatgcagcagcagcattgcgtcccacatggctggtgactttcttgttgttagctgctattgatgtcacttcactaggggttaccaaataatacttaaattctatcatgtcttcttcatttcgtagctagactactataaaaagaaacttctgttcaccttgggaagaattgggagccccttaactcttcccagtccctcctacccttgccccattacttctccctccatattggtgatgggtaatgcgtcctctcagtcccctggactgagaaatctaccctctgtagttcccagactggctggctcatgtttcatttagaaaaggcacagagtgatagagctgtgggtatgaaaggacttttcatagtggctaaactagggtataaggcaaggaaaattttgcctctggcctcatctgacctacggcttaccacacttttcaaaagtattccaaaaggggtgaggccctcagagggagtaaagcagcagtactccaccttcttccttgtttgctgctggtgtgagtttaaaatgcatcccagtggataatagactctaccaatactttcagtacctccatttctagtaaacttctgttttattccatagggttgtacttaatatgtgatagttattggctggggctatctatcacattttaatcaattttaaatatatgaatctctttattttacaggctactgaggctctaaagaaaatgtatatggaatttcctcaactgtataataatagtgtggtctgttctttcttgccagaagttatctacaaggtaacattcgggatttttcttgtacatattaggtgagctggtgtagataattgcaatgggctgcgtaagcacaggatagatgcctattaaattgaactgcatcagggtcacagttgagaagctcctcttttaaattaaccagagaaattccagaaggggaatgtactcataccccttacagaatgccattattcctcttttgccccttcttttatgttgtttataggctcactcagattactgtagtaaaattctcacaacagaaaagaattatgtagcccctacttctcaccaactaacagcagaacataccttcataaaataaattcttaattatggagaatctaaaacatgcataaaataaagtagtagtgtaccccccctttaactgtgatccagctcatttcacccataaccccattgatcctccccagtgttattttgaagcaaatcttattccatccataaaattgcattaagaatctttaaaaagtgatgccattttatttatttatttatttatttatttatttattttaaaagacgggttctccctcagtttcccaggctggagtgcagtggtgtgatcacagctcactgcactcttgaccttccaggctcaaatgatcctcctgcctcagccttccaagtagctgggaccacaggcgcacgtcaccacgcccagctaattttttatttttattttttgtagagacagggtctccctgtattacccaggcagttctccaactcctaagctcaagcaatccttccacctcagcctctcaaagtgctgggattacaggcatgagccacagtaaccagcctagtgatgcctttttaaaaacatagccacaatgccattgtcccatctaaaaattattaacaataaattattcatatcatcaaatatccagtgtataaattttgacttgtctcggaaatgtcataaatggttgtttttcataaattgctcattcgaataggacccaagtaagatcggcgtgttacaatcgtaaatctttttttgtttgtttttgagacggagtcttgctctgtcgcccagtggtatgatctcggctcatcgcaacctctgcctcccgggttcaagcaattctcttgcctcagcctcctgagtagctgggattacaagcacacaccaccatgcctggctaattttttttgtattttagtagagacggggttttgccatgttggccaggctggtctcgagctcctgacctcaggtgatctgcctgcctcggcctcccaaaatgattacaggtgtgagccactatgccctgccggcaactgtaaatcttaaaacttgcaggttctgtctctctctctctctgttttttttgtttgtttgttttggggggggtccttgttttgtatttactgaagaaaccggattattgttttgtagagtttacccaagtccaaattttgctgattatgccatgatatggcttaatatttttttctctttattttctataaactggtagcgagagctggaagcttgccttgatgaggttagggttggttattcttggcaagataactctagagatgagggtgtttttccgtcaggaggcacttgacatctggttgactcctgttgtttttggctgctattgatgctcattggccagatctgtccattttctagggagctacaaaatgctgatattttaattctattacttcttgcattagctgaaatagatctttaaaaagaaacttttcctcctctactatttagttaccaaataggcagaataaatgctttatctttccttttatttaccagtttccagaataacaagctggttccgtagcattctttaccagtgaccaacagagcatacattgaaaatttttacagtgaggatagagcctatcaatagaagctgtcatggagttgaatagggtcatggggcttgcagacatttggaacagtgtttcccaaacttccttgaccacagagtcctttaaaacgtataagacattcccccagaggagcacaagagcagagactaaaggaactccatccacatctctccatttctctgttgtcctctcccattctctcgtcacaatcccttctctcccttcccacctcacttccccatccccctcctcacccctacaactcttcagccatttgctctggaaagggtcaaaactaaacagcccatcttgaactgaccttggttccctcctcattgagttctaattaattatctctggccaggatttaagtcaatagccaattaaaagtttattctcgtgacattattaaaatttgatcctgaagttttaatttttccattttaaagataggattgcagtttttaaggactgggaaaaaaaagttctcatatgtgctgcatattagtgctttacattcttcacattattttctcaaagggtttatgattgagaacttatttagtagataccggggcagggtaccaaccatgaccacctcatctgattgagcacattggctaaatctaaactaataagtattcaactttacatatgatcattattttacttccccaaattcctttgcagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccgtaagttggaaggttttttattttacccagacagacatcctgaatgctcttatttgaaaggaaggattaacagagtagacaacctgaattggttctgacctgcaaagcttaccatacctctaaattggattaccaatttcgcttcttaggtgggaagagttcaggcatatttcactgttttcagaccgagtcgatcacatattttcggttttttagtgtattttgaagaaaaaaaatgaacctgtgacactatgctgagcaagggattttatttctgtgactggtttttttgaaagccaacacaggatcctgggcagaaccacagtgaagacatcctgtgggcaccagcctccccactaccgtcttatgttataggcactcccccacctctccccataaaatttccatttcctaacctgctagcgatctcggaatcatttctttggcaattctgtatctgtatatttcagctaattagagttgtaggtctagtattatttcagacatacatgattcagttcaataaatatttggtaagtgcctatactattgcaaggttccatgttgagaagctgaagatgcagtgggtaaagaatcaaagccatgatctctgccctcgtgacgtttatagccaagtgggagagtgagagatgctaatcaaataaaaatccaatcaatataaagttaaaactaagatacaggctatgtcagagaaaactgtgcatgggctataatctaatctggtctgggttgtcagaaacagcatccccaaggaagtgacagttaagctaagatctgaagggtgagtgggaattgggaggaatccagatcagagagaaaaatacatgtaatgtgctctggcaggaaggaacatggttctttccaggaagtgaaagaaaattaatattctttcaattaatttaaaattaatcagcacagaaaagaaagggggaatgtggtgtgagatgaagccaaggagacaggtcggggccaggtcaggcacaccttcagtggctgtgccaaggacatttgggggtggcgatcattagtgagctactgaaatgttttaagctgggacagtgtagaggaggttcatggcatcctgggttttggaacagtccctctgatcacagtgcagaggccagttaggaggcattctctgggcaccattggtatgcagtgaacaccatacttagtggccattatggattcctgagacagctgcttattattctaacaggattggctttcctctttccccagggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcatttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaacaaatgtctaaactgcatgtacttccgtgccatgttatgactagagtgaaagaaggaggaaaaagtgaccaaagaagatacatcaggccaggcgtgatggctcatacctgtaatcccagcactttgggagctgaggtgggtggatcacttgaggccaggagtttgagaccagcctggccatgatggggaaaccccatctctactaaaaatacaaacattagttgggcatggtggcacatgcctgtaatcccagctattcaggaggctgaagcaaggagaattgcttgaacccaggagtcagaggttgcagtgagccaagattgtaccactgcactccagcctaggccagagagcaagactctgtctcaaaaaaaaaaaaaaaaaaaaaaagatacctctgttcaacactagctgttcaacaggctgttcaacactagcctgggcaacatagtgagaccccatctctacaaaaaatttacaaataggggctgagatgggaggatcactggagcctagcaggttgaggctgcagtgagctaggatcgtgccactgcactacagcctaggggacagagtttgactccaatctttaaaaatttcataataataataatat

SEQ ID NO: 16146 - DNA, 5621 bp, Human
gcaggtagtgatatatggctaattaaatgtgccatgtaaacaatatctgaccactaattttaaaaaacagtttgtaaaacattcctggcatcatttaatcttttggggttttcacttgttgtattcagaaggtattttaggaccaaccttaattgtcatgcattcattcaacgaatatttattaacctacctactgtgttgtatccagcactgttttgttttgttgttgtttgtttttttggggacagaatctcactctgttgcctagggtggagtgcaggggcacaatatctgctcactgcaacctccgcctcctgggttcaagcgattcccgtgcctcatactcccaagtagctgggattacagttgtgcgcagcaactctcagctaattttcgtatttttcatagagacagggtttcaccttgttggccaggctggtcttgaactcctgacctcaggtgatcctcccgccttggcctcccaaattactgggattacaggtgtgacccactgcacccagccataaaactctttaacacaaactcttcaaagtgacatcttttgtaaccttcataggttacaaaaggtattgatatattaatagattgagatttgattgcgggggggcggggcagggggagaatgctaaaaaaataagtcagctttcttttctgtaactatttaaaagaatgcaaagtaattctacaggcaattccttggtgggcttatttggtaattttttttttcttttccattttcctcttgctctttggtttgtaggagaaccgctttattcccaggaggcaattttgagtcccaacatgtcctgcatcatctcctgtgcccattgccaaaggaaggcgaccagagcgtgggtttcagcacagctctgattggatgataagcaaggagagtaatgtgctgctaggaggttagagaaaagaaaatactagaatataccagaatgtagtgtttccacttccctccctccaaatcaaaagcctcatgaatgaaattatgaccattattcaagtgcaattatactgagtatgtaaaatggaaacactgaaagtaaatcatacatttggatattacatttcatatttgagaacatgccagaaacattgtattattgttgagtgtaatgtcaggagacaaacttctacgcattttatacataaatttttccattttctctgtttcccatttatgtcaagttgaacacatggtatgacttttaatattctctcttccttctccttccccacattgaatgtcaagtgatcacactcaatcttgattatcctaaatttacccttaggacctgtcaccccattgggtgttgccgccagaacaagagggttttttaattggtataaaaaggagaggccaggcttggtagctcatgcctgtaattctagcactttgggaggctggggcgggaaatcccttgatcccaggagtttcagaccagcctgggcaacatggtgagactctgtctctataaaaaaaaaaatttttttttttaatttagctgggtgtggtggcatgccctgtagtctcagctactatggaggctgaggtgggaggatcacttgatcctggaaggtggaggctgcagtaagctgagtggcaccagtgcactcctgtcaaaagagagagaggagagagagagagagaaagaggaagagtccctaaagaaacctataaaactggggtcttatggatgctagcacatatcttggaaagaactgccagcgccagtggattacagaagacaactgtggctacaggctgttcttgccagctcaggcgtcaactcgtggaaaccggttaatgacccgaggggacagcggattctcgcctaagcaagatcccgcagatgggagggcgtaggaagaggttccccgggccggctccaggccccagcgggcgtgggcgttggcagtgagcgaggggtggtcccgcgccgcgccggcggggggcgcccgaatgagagcgcggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagtcaacctggagcacatgaggttaaacaaagggccctgaagtttgagtgcgccctccatttgccctgtgctgaacttgcagagacatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagataatcttataaagaatagacttgcttgggtggtagtacgttgtgcaattttgactattcactggctttatacctgcaaatgattcttcgttcatgtgtaaattgtccaccatgggtttatctagggctagtatgtatacctgggctacagaataaaaataaaatctaatactggcccaagcaaagtataatttgcttaagaggttacgctaacaaacgattttgagtaaatatttacaaatgtaggatcttagtttaggaaattataacaaataccttaatataacattttaagctacttatagtccttggaaatagcaacaaatatcttagttattggactattataaccttagtcatcttattactgcttgattatgagacactctccctgctaatccttagaacatcttggttcttggtacttgacttttagcccctctgacatatagttgatgtcagagtgtctggcatttcagtagtgctctattttacaaatcccagtaaactgctccactgtggcttgtttatgtgttaatactgcttgttttctgttataaattattttttgctttggagtaagatatcatcattttgcatagctacaaatctgaagttaaagaaaattttaaaaatgtaattgtgggaaaataacaaatagatctgctgagatggaggctttgactaatgttttaataacaggcaacaaaacaaagaggcaggatattttggtcacaactaaacctaaattaaatcctcatacaaagccccattaagataaatgctcaaattctgggaacatttcacttgctttgccagcaattttacccttcagagggtgtggatctaatcaggggaacaaactaccctgggcttaattctcattaacagggactaatttgtcaaagcggcagtactagctgaagtgatgggtatggaagcattcactgtgaggattttgctgaggtgcctggcacagggtaggggaactcacccaggctgcaagatgctaacagttcaggttcaaggtcttagtgtggactaaggtgcagtcaggatgggaacaggtgcaacttgggccaacatcagtatgaagggcctgatctgagggcaggggaaggagggggcattctgggaagcaagagttcctggtatcctgttgaccagagtcttggcccaaggatcaacgtatgaattaaagtagaaataccagaaacaaagaaagttggcagaaactaggagaagcagagtctcagccaactggactgggctcagccttggctactggcccggcagatgatagaagagaaaaccaggaacccaggctgaagcccagtggttgggctggccacacaccatgcatagccttaaaggggtggcctaagggcatggtccgctccaaaaaaggaaagggggccccagaatatttctgaatcccactcactgccagggaagaacctctcaattcactcaatagtgcattctcctgcttctcaataggctaatactctagagaatatggggacaaggggaggagggtctagtggaacaggtctaaactggcgtttgaattttaagataagttaatcatacattggctgggtcagccatgtctcttagtctttacaaaagtagaacacaaaaaaattcaatggaaatctacagacacctatttgcagatgaggaaacacggctatgaagattgggaagattgggaagaactggccaggtgtggtggctcacgcctgtaatcccagcactttgggaggccgaggctggtggatcacttgaggtcaggagttggagaccagcctgggcaacatagtaaaaccctgtctctactcaaattacaaaaatcagcagggcgttgtggtgcccacctgtaatcccagctatgcaggaggctgaggcaggacaatcacttgaacctggtaggcggaggttgcagtgagccaaaatcacgccactgtactccagcctgggtgacagagcaagactttgtttaaaaaaaaaaaaaaaaagggaagaactaaaaatgtaattttcaaggggctatcacaaatggtcccaataaagagaaagcaggactcatgtttaagaaacccatgagatgtgtatggacctcatggaagagctcttgctttctaatgatctacgtaacagatgaaaagcagagcatagggctaaggatgaaaatacaacagtaataaggtattaatatattattaagaaagctaatgctccacataagcagaggacattaaagggacttttttttcttaaggatatcttaatgttttaaatgagaagacatagaaagggataggtccaactcttgggattgttgcaggttggtttccatcggaagcactctgagtctgagatttgtatgcagaaaattaatttgaatgtgcttttcagatcacccaggtgggggagggaggaaaccaggactgggcagagagaggctgggctgtaaccaagtcacaacaaaggtgtcagctggtcccatggtgaattctggacctaggatggctgatccc

SEQ ID NO: 16147 - DNA, 39937 bp, Human
ttgtggtgtgatggccccaaagctgaccataaacttgcctcagccactctgtttttctggtaagagtgagtgctatttctactgcctctgcatggaactgggatgtgtggtttagattctgttttctaagcaaatgtatttgttccctgaaccattatttttctcactggtccagatggaaggcataaggagaacacctaagttcataaaataagtaagggtgaagtacatactttttgtcttcaaagttacttttgtggggacttggcagtttacaaaaagagctgatgatgattagtttctaattctaaagcaaacagcagggaattggattttctttaaattttccaatagcaaacaagctaggagtagcctttatcctaacatcttggcaacatcacttatttttgaatatagctttctgaatgttacaatgaccataccaaaggagatataaatacccccaaagtgatgggatcattttttagtggtttcgctgaaatttgctctaagtgctactgagtagaggtatgcgggaataagaataatcagttttattgatttcttctgtgactctgggccaggaccaagtctattttgaacatctttatatcctagcacattgtaggtgctttaaaaataactcttaaatattgactgagtaaaagcgtctatctctaagatggtcaatccaatccccctaagcactgttgtggagatgagtgaagactaactaggagtcttgctctgtcgcccaggctggagtgcagtgccatgatcacggctcactacaacctctgcctcccaggttcaagcgattctcctgcctcagcctcccgagtagctgagactacaggtgcgtgccaccacgcctgtctaatttttgtagttttagtggagacggggtttcaccatgttggccaggctagtcttgaactcctgaccttgtgatccgcccacctcggcctcccaaagtgttgggattacaggcgtgagccaacagagcttttaaaaacaaatacacgtgagaggccgggtgcatggtggctcacgcctgtaattccagcactttgggaagctgaagcagcaggatcccttgaagccaggagttcaagaccagtttggacaacataatgagatcccatctctatgaaaaaaattttaaaaaattagccagatgtggtggtgattgcctgtagtcccagccacttggagactgaggagagagaagctgttgagtccaggagtctgaggctgcagtgagctaggatggtgacaatgcactccagcctgggcaacacagtgagcccctgtttggaaaataataataataattaataacatatgtgaaagagagttcacaattagtccaatatctttagaaagattcaaaaacacctaaatgcgaaaaatgcctttattcatttgtcagctggattacagaaagtaggaagaaaagagcctgtgcctctgtaggaaagtaacaacgacttaacttctggaaatgacttcgcagcttagagcccagcagtgcctattttggattaaactgtgtattaattaagctcaaacgatttcaacattcatcaccttgcattgcacttcacagaaagcaaaaccaaaacaatcctggagttttgagtgaggaaaacagacgccccgcactcgcacacgcgcgcactcgcagcctgtctgaagtgcagaggttcaggcggccaagggacccgcgccggtttccgcgggcgacctgcaaatcctgcccggggcccggcaggcgctgcgtcccggcgcgttggcagttggcgacccccctcgaatcccccctctgctgcgggctccccgtggcctttggaggctcggtgagtcggctccaaatgttttccatatttgttcagcctccataattcgaataccagggcaggccgagccagccgtgcgccgcgctccagggcccagggcgccgcacacgcacccacccacccacccagcctcgcagcgccatgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtaagcatcaagtctgttttgcctaagcgcgtttgccaaacaggaatgcgaagtcgcatggtcgagttgagactaacccagctgcatgtgcccttccccgggttcactcttctaactcgcgctctgctcggtgactgatgcgtggggcactgggttttcccgggcggggcagggctggacgcgatagggctcctgcccctctcctgctcgcggctcccagcgcctccacggggcctgactctgacgctctggagctggggagttcatttcaaaagctgcttattttggtcagactgaacagcctcaataacaacagcggattcattcgggctttttccttatcctgttacccagaccccacccctgtccttaaacaagtggcaaaaagtgaattaagttcatctagtgaaagcaggagaggagaaagcctgtacttggagttgccacattgagtagcattcattttatgttttaaactgaggctccattagtaagtttcctgaaatgatgggctaaggcaggaaatgcgaatacagcaagcacagccttaatccactggagtctaaagtgggataaacccagggcgctggccatggcagaagtatatttgggactccaccgatggatgtactgttctaagtagaacagtactcagctgttgtgagtgttgaaacatgtagcatacttggcttgattaaatgaattctttaatgtaaaacgggtgccacttactgaatacctactgtgtgctcgccctgctagaggcctgacacatattatttctaatccccacatcgtcctgatgggatcgttttaatcattctcacttctcaaatgagggaacccaggccagactcacccagggtcatgagtgggtaaagcattcagccatgctgattcctctttatgctagactatatctgcgttttcctcattgaaccacactgccaccacatttggtttgtaactttaatattatgttatattacagtgtcttgtagcatattaaactctttcacatgcattatttcatttgagccacgaaacaacactttgaagtgggaactgttattccttttggatgtgaggaaataggctaagagaagttagatgacattctcaagcccagagattgaatgtggtcgaatcaagagagactagaaatgacatttttgactccttgtctcatattgcatccttactgctattactgaccacaggaactgtaactcacaaaacgtccctcaaaataattttgtatcagggacagacattagagagacctgatatatatgcatcgatggaggtatttcctaattaagattatttgaatacacaatttttgcatagtaatttaaaactttaatttttgtactaagaattcccatgaaattaccatgattggagttttctaaatcaagtgattttaaaaatagcttttcagtaagatatactgggtatttcaggcacctcaatgacgatccacatacccagggggaaaatatgtctgtcctttaatgccaggggaattaaaacaaacaaagaatgaagctctttcattcagtgtttttaaatatcatttgcaaatgtgttccccatccttcctttattgcagcttcaaaagctcagcaccaaagaggcaaattagatggagaaaaaacttattttagggtttaaggcatgaacataaaaaccatgcaactcagaaattttatgaactaaagctcctgtgggagatgatgttcctaattgccctggaagctccctgggtgttgcacaaagggcattatatacagccaggtctctgctctttctggttttcttttttatcatctaggattcatttgaagtttgctctcagtacatagccctgatgaaatctgtcatcttagattttctttcaactgagaatctatgtagaggagagcagctagtagagatgtcctgagactagtgaggagggtctctgaggagccaggccaggaacaactctcatcctagcagggccagaatttgggcatgtgtcactgtctcacacagacaccatgctctgcttgtcctcactactctgtctgtggttggtcacagggcactcttccaagctttcagggaagggaaaagataacgaggcagatggcaaagtgcagatgtgtacacaccacacctggtgttgagcaccagctcagccactgtgtgctgaataactttgagttttggggggggggttttggagacagagacttgctctgtcgcccaggctagaatgcagtggcacgattttggttcactgcaacctccccctcccaggttcaagacgttctcgtgcctcagcctcctaagtagctggaattacaggcgtgcaccgccacacctaacttgtgtgccaaataacttgtatgctaacttgtgtgccgaataactttggacaagttacttaacttctctaggtttccatttctttactaacaaaatcagaatgataataattcctaccttttcgggttgccctgaggatgaaataaattaatacatgtaaagcacttaaaatagtgccaacgaatggcatgattcaatgagttagctttacttattagctgcttgggaagcagtcacaggcagtgtcactcttcagaggaaaggtggctttatttcatctctagacttgcaaaactatcatttttgactcgctacatttccaagactagtttgaaccctgaagaaaatatcagttttgccgtctcacctttctctgttctcagccaagttactctttagcaatcacagtggtatttgattggtccagtactttctgaatctttctggaggtttataaaaatgaacttggaggagagtggcctccccaaggtcatttttcctttgggatatgcagtgattcagggctggtatatcctgccgggttatatcagttttccctgttcaggagccccaccaaaccgaagcaatccaggcccatccctggggctgaggctgagtcacactggctccgggatataggctgaagccaagctgagtgaggcacccacgctgtctacaactttccatgcttcattcttctgtttccctttattctggttgcctcttctcatgtggtcatcacttcattttacaggggccactatcccattaacttggaatttggggattgccatttccttaacagaacctggatatatgggtaaatccacttaggtgacttctctttgaccaatgcctgggtgacttgatgaatattcaaggtgtggttacagactaaagaggcccttggtgatctatgatcagaaatttatgtccagtgggattttaggaaaacaaataggtcattttttatctatccataaatgtgactccaatccccaatcaaaagatgattgaagtctttttacttcgattacaaaagattcctgtaaggggggaaaaaaacccagaatggagtcactgtggagactacgtaacctgtaaaagtgctgttcatgtattataattctttatagatggtttgagggttgtaagtcataccgcaatgacaaaacaaagtgaaatagcaacttttgaggatgcacttggctgggtacagaggatcctaggacagagaagtgtgttctgcattttattctgttaatggctttagtagctaagtcagatgggaattcaagcttgctcatttttctggaattcttattgatgaaaaatgtgtaaggattgaagtaatctaaggactttggggattttacttctcactcaaatgaatacaggtttagtttaggtaaagcattgcatgcttaacgtttggttttcccttcctcattcagtaacatctgtggagggtgtctgctgtgctacgcattggcctaaaaacaatgaatcaactacctggaggagatctccagatcctgatggacatgtgcccttattatatctgacagtaatgaatacttccgattagaaaatttaacgtacacaaatatttttaagatccatttacctttcaaagtattccacttgcagtgatttatttgctttggcatctctactctgaagtcaatttaagtgcaaactcttgcttctcatccccagtgaatatgtttagtattcgatattctcctggcccttgtagggaatattcccatggaaagtgagaatttctttgccttattatgctttttagcttcccccactctccctccattgctcccataccccactcagtggagtaaaaaccctgagataaatactgcattaatcacattggaaagtttaaggcaagggcttaaaagaaagggaagaatatttcctttatttaatgtcatttgtaaaactcatcacatgaatctgtaatgattaaaagtcatgtcaaaaatttcagtaacagttttcgtatgttaacttatcctaagaaattcaagttgcaggtttattcaggttttaaaaaccgattttaagtcttgccttaatggaagggaaaattgggtggttatttattttaaagcagaatataccatgaaactcacaagcagacatatcacatatagcaaataaggaacaaatatagttgttattcagaatttataagtagggaaagtaagataataatttagctaaatggtttgatcatggttatgaaaagtaactggaagagagaaaggtttggcattagggtataggataaaccctcaagtcaagaagctaaatgtggtgttaactttctatagagttgtattgacatttgaaaattttaatctggaattatacttttaggagtatactgcatagtaacacattattcgtcatattgggactttaatatgcttccaaaatataatgtcgcatccctggtatccctgggaaataatttttattatggcaactgccacaggattgttaggaactgaggagagataattacatggcccaactcaatctccactgaatacatagaacaataatgacaggaaaattattgtataggcataggaagttctcatagtaagtataaaaatggaatgcaattgaattattctggcaaaagaagttaatttgtgtatatatatatatatatatatatatatatatatattatatatatatatttggaaataaaatggaatattcaagaatttggtgaggccgggcatggtgtcttacacctgtaatcctggcactttgggaggccaaggcaggcaaattgcatgagctcaggattttgagaccagcctggtcaacatggcaatatcccatctctaccaaaaatacaaaaatttagctgggtgtggtggcacccacctgtagtcccagctactcgggaggctgaggtgggaggatcacttcagcctgggaggcagaggttgcagtgagctgagattgcaccactgcactccagcctgggcaacagagtgagaccccataacagaaaaaaaaaaaaagaatttggcgaatttggcgaaatgtttcctgaaataatttcagtaatagaataaagaataagataggttaagattgaacaaaatcattagatgttcagaatcagcaggagaaatgtgttttcgcctctacttacagccttctactaagcctgatgtgcaaaggccaagagagtgtttatataatgaggaaattgtccctaaatcttcttttttaaaaaaaaaaatgaggagaagcagcaggttctaatattttttttaatcctgtattgtggatatattcaactcagaaagttagtctctggaagcttttgagatgtcagtcatcattttggatttaattttttgatagaaatactggtacatagaattttgggataatcaaatgaaaaataaaataatttattctcttactttaagtaatattctcagggccactatatatcccctgacacataatggataattaataaatgttgaactgaaatctatttattccatacttgccattatcagagcttctgtttgaacatgcatatgcccatttttaagctatattcagtcatcccttagtatctgcaggggattggtactgggactcctgataccaaaattcacagatactcaagtccctgctataaaatggtgtagtatttgcatataatttatgcacatcctacatatgctttaaatcatttctagattacttataatacctaatacaatataaatactatgtaaacagttgacacactatattattgagggaataatgacatgaaaaggtctgtacatgttcagtacagacacaaccatcctttttttatccaaatgtttttgatccgtggttgattatattcatggatatggaacccattgatacagagggctgactgtagttgtatattcaaacacagacaaatttatttatgacatttaagacaactatgaggtaatagtaaggaatgtgttattactccattttggcttctggattctagaagaattcagaacatattaacttaacattacttagattttttatttcatgttataaaatggcaggactcaggaaggtcatttgacttatatgcactctcctaactagaataggacatattaggattgatgtggctgaatgctagatgttgatattaccactcttaaccttttacgaagaaaacaatggcataggtttctctaatgtttggtctaacagttgaatagatagattgccaatatgatgccctctttcagtgtggtctgagaaaatgggtgttttctagatttgctcttgcctttagctgtatctgagacatttctattaaggatggtctttcactggatccacttggttgtattgtggcctgaagggttaatgataacattaaaaggaaacacataaggttatgttgaagagttcagcatatatgtttctatgttactgtaggatagtgtattagtctgttctcacgctgctataaagatactacgtgagactaatttataaagaaaggaggtttaattgactgacaattccacatggctgaggaggcctcaggaaacttacaatcatggcagaaggcaaaggagaagcaaatcatatcttacagggctgcaggagagagagcactggggaaactgccacttataagccatcagatctcatgagaactcactatctcatcttctcatgagaagagcatagggggaaccacccccatgatcaaaccaccttccaccaggtttccccctcaacacatggggattacaattcaagagagatttgggtggggacacagaatcaaaccatatcagacaggaatgtaatctagtcattaaactttaattaggtataattcactgcaaaatgcagttcatttttaggtcttccatcctggcaaactaaggaagtactggtcaaaaaatgtccatcaaaatccagagctggatgggacctcatgatgtcatagtttaaccttccagttattatttgctgtaaatgttcaagtctaggtttatcacgatgagttcataagcttacagtgaacttcttttaaaaaaatagatgctaggaacaggctttacagcataagctatataaaaacctattccataggcacaccctctttcagatgctttggatgcagtctcagatctctgtgtattgagataaaacttggcaagagtaactgtcagatgcctgagtgaagcagctcactccatcaccctggttaattttaaaattcatatgtgtacacctacacatatggcattaactaaaatacatttttctttctgtcttagtcggctcaggctgctataacaaaataccgtagactgggtgacttaaacagcaaacattcattttctcacagttctggagacgggaagtccaagatcagggtgtcaacatggtcaggggctagggagggttctcttcctggcttgcaggcggctgccttcttgctgtgtgctcacatggtcttttctcagttcatgcatgtgaagagaagaagagatctctttctcttcctcttctcatgaatcctccagtcctgttggattaggaccccatgcttaggatcttatttaaccttaattacctcctaaaagccctatctccaaatatagttacttttgaggttacagcttcaacatatgacttacggggacacaattcagtccatagcatttccggtgagggttatacatttgcacagcaacctcagtgactcttaagctcgttttacagcttattattgaaagccctacggctttcttggaacagctagaagtctgagtgtttccgaggggtattctgagcccgtaatctgacacacggaggtacgatggggtggcgcggctccgtgctcatgccagtagtgagacatatggaggaagctgttttcattgcatttacagattgcttcttttgtcaaatttctgtaaaaataaaatcaagtaaatctagctagtgaatacaattctaaggttaacttaggcatttcctttgctgcattaactctttaaggcttaggaacctccacgctgtaaattcctgcatttctttatgctccagggagtatcctgatgtcaagatgtagctcaaggatactttggcttctgatgcaaagtatctgatgcaaagatggctggctgagtggtaccattggggaatgcttatatgttcagccattgaccaagcctgctgtcctgtggggggtggtgattgcatactgtgggcaccccccacccgccctttgagccttatgaggtaatagcctttagtaggtgccttcactctttggtagatcttcattttgacacacatttaagggcttctcattggattctgttccctcacttaagaagtcctgagctgggctctgcttttccttcactaagtactgtattgcacaaacccaagccacccaagagggaaagaccagggaagactaaaacatgcagcctttcataacaattggtccaatctcagttccaaaacgaaaagggatggccacgatgggatactgtaagctctccagtttgatttttgagcatatttaaagttgatgctctctgagctaatgttgctagagccacggtccctaattgtgaatttcataaatgtgagtgtttcattatggtgtttcctggggctggcaaaagtccagtaagtgacgggacgttggaaagcagacagtttgttcacaaatgagcattctcagattctgctgaagaagttctgttggacctgcttctaatctttgcagaaatgagcaactctcccctggctgggagtgccgtggtactgagagaggtggtgagaaacctggaggaagcgcttttaagtggcattctactcagttgtttttaaagcgttagattcagcattcactgtaaggagcaattaaaaacccctttaagatatgttattatcaagccctctctcttgtatggaagataatgacaggagaccagaaaagggggagggggctgctaatgtgttaactagactttgacgagcgagagaattttagctttattactaagtgggggaaaaaacacttccttggctggcttccttctaaagtatcaggtgtggcatgcatatcaggccattagcctgatctcacaggcttagccctatctcacatttagctatgccaggaaagctatgaaggaggcattttctaagacaagggcaacagcatttcagtcctcatcaattctgttggaggttggaggtgctcttctctcagggagaaacttgcaggaggactgtgcctacctcaggaagatagtggggcacccaaggcagtgaagagggcaaactcggactccctaaggcaaatgtatgatcataaatgagaagggatttcttcatgaccgcatacagaattctgtgtacagagtttgaatcttttagtttatgagttacatgttcaataagtttatgtacttctcccaggctctttggtagtcaggttctgaaacagaaggaccaaacccacacaggttggctttgtctcataatctttccatgaacaagtagtttgagaagcctcttaaagggcttcggtgtgcattaagggcttgagaccaactaggaatttttaaatgcacatagggtgaccgtaactattgtgttatagaaccctcaagaaagaattcttcttcagtcaccaaatcgtgtgcgtcacaaatttttccacctcaagacctccctgaagctttgctccccttctctctgtcctcacacacacatcacaaaaagctcagtgtctggctaacccgtgttgccatgggaggcgagggggaaatgtaggagaggctgcaggctgcttggggacactgacctcctcatgttgaaaaggacaaaacactttcaaaggagaagtaatattataatatatattactttatgttccctcatactgtttttcataaagtactctcaattagaaaagccacttgataatatttttaaaggttgaacaagatggttctctcatttacaatcccattccaatgttacataattcaatttatattgatttactgtataatttctatgcactgtgctatttaatatgtttatatttattgtactattcaacatatatgaacccaggagtttaatgtagaattatctctgcagtcatttctagaatgggacctaatttgagaactgacttaattatggctaagtaatgaaatccagcccatgactataccaccggagtaggctcaatccacatcagcaagattcctttccctcttctgagggcttgaaaatccccaagtgaaacaaataaactataggttgtttatttcttcccacaaatactgtttgtaacaattctgcccctcctgttgattcatgagaaaggctggaacacaatctttgattctcttacattctttggaaattgattattttgcaagaataagtatttatagaacttggtgattagtttttggtaagtcatcacaagagttagttaggagtagaagccacaccctagccactctccctctgtattttcatataccaggtatggtgcccccaagagcttagtctctgggtgaggaaacacaggtacaactaactgcaatttagttttaaaaacaaaatgccaaggtggtgccttaaacaatgtaccgtgctagcgcagagaagaacatgatgaaccctcagggtaagatcagaaaaagaaaggagagggggtctgaaatttgaggaatgactccagctttggagtaagggtagaattctggctctactaatgtagaatcattttccaaaaaatatttggtaatgatttttaaattttcatttctatgtgaatttgaacaaatgtcagtaattctgtgcaattctatgctttttaaaattataaacatttcaattgcataataacatagaaaataatgcataataacatagaaaaaaatgcccacttatccattcctagctttgctaaattttagtattttgtaataattgcttttttattattttttaagaaaggaaacattacattgtattgaagtctcccatgtttcatttcttaatcaaattcccctacccctcccatcttccccagagatatgtactatcctgaatttggtattttttatgcataagcctgttttcatactttgaaaatttgtatatatccataaccaacatgtcatattttaatttttatacagatggtatcatatcatttctgctcaacatcgtttttgagatttatttataatagtacacagatatcattcattcatgtttgctatactgaatttcactgttaggaatatacaacattggccaggtacagtggctcacacctgtaatcccagcactttgggaggccaaggcgggaggattgcttgagcctaggagttcaagcctgggcaacatggcaaaaccccgtctctacaaaaaatactttttgtagagaaattagctgggtgtggtggcagatgcctgttgttccagctactcaggaggctgaggtgggaggatcatttgaacctgggaggttgagacagtggtgagccatgatcgcaccaccgcacttcagcctgggcaacagagcaagaccctgtctcaaaagaaagtggtggtggtgggggggggggatatataacagttaattcattctcttgttgaagaaaatttgttttcaaaaatgattttttattttgcatttacggtgttacagtggatattcttgtctataactccctgtgcacataaagtcttgttaaggcatattcctagaagtcaaattgttgggtcataagatatagacatcgtcaaattactagctattgccaagtcactaccacaaatccaaattggactaacttacacctcacctccaccagtggtaaatcagagttctttacctatcttatttgtgtgcaatggtatcttgttttaatttgcattttggtgttgctactggaattgaacatattttatgttgattggccattttattttgtgttctatcatttatttattcaaaaaatattttctatgggttgttcgtttcttatttatttataggatttgttacttttgttacttaatctttatggttttaggtactacaaatatctttttctggttggtatcatatcttttatttatggtgttttgttatgaaaaaagatttaatcttcatatatttatatttatcagttcttttttttatggatttgatatagtttaaagaaatttttccctactccaaggccataaaaatatttttctataccattttctaaaaatgttaaaggtttgcttttgggtattcatatctttattataagtggtttctttttgcaatgatgtgaagggtccatacattttttctcacatggattgataattgttttagcaccgtttaataaataatcggtccctttcatagtgatctgttacacccatttatcatctgtcaagtttccatattagatttgctttgtgattttccttagttctattgttttatttggctatcactatgccaataccattgtctaaattaaaatgatgctataatgcatcttgttataaagatgatggataagcagcccacccccaacccaccctccttcattttattcttcttcaaaattttctcagtgaatcttagccattttctcttgcatatacactttagaataggcttttcaagttccaagaaaaatacttttggtaatttcctgggatttgtactttctatacatgaccaaagatgatctcaccatttatttgagtcttctctaatgtcttttatctggtcttttgattattgagttcactttagttgctttgtgctcagttcatgtgtttttcatatcaattatttgatatttgattagacttattttgtgaccaatcttcataaacagttcttgaatgcttgggaaaaatgtggattctctcattttggggtttagggttctatactcaattttaaaattaagtttgttccctttgcctggaattgctgtcagatgtatatttagaatcttcttattctccctccatatttcttatcctgtctagtatgtttcatctctctttatctctctgtgctgtatcttgggttattttctcagattttctggttcacttttcccttcttcatttaggtttaatctgccttttacttgtcctttgagtttttactgccagcaattttaatttttcattctagaactcactgatgttgttactgatgttattttcacatatccctggtgctttaaaaactgtcctgttctttatgttttcagttccttccttcatgtgtttgttttgaatgtactttttataggctctgctcattacttccattatttggaattcttatagctctgattcttagagcgtgtgtgtgtgtgtgtgtgtgtgtgtgtgtgtgtgtacatgcatgtaagagctagccttcactaataattaattcttcaagtgtttgctaattttggtttgtgagttcatcttccaagaggctttatgtatgataacttgatatagcctatttgagagtacaacccttccagatgggtttgtcttgccatatgtcccagtgatgttacaggcctagaaccactttgtttccttaacttacttattatgaaaaatttcaagcatacacaagagtagatacaattgtataatgaacctctatattctcatcaccgagccttgataactatcaactcatgctcaatcttgtcttatctgtatgctcctatatttcctccacacccacacactacacacactacacagtggattattttgcactaaatcccagactttatatcattttatttataaatattttgctatgtaagtcgaaagatgaagactaaaaaataatcaatatactaataatacacctaacaagttaatttcttaatagaatcaaaccactgtttaaatatccatgattaactcattaatagttcctcctagatttgtcaaaatcaggatctcaataagatctatacactgcagttgactcatatatttctaacatttcctttactcaaaaatttaccctttgtctctcctttctattctctctctctgtgtctctctctctctgtctctgtctctctcccccttacaatttatttattgaaatagccaggttttggtttattttttcaggatcactttcatgttactttctcatcttaataggttccaggactaggaaagtagtagaaaaacctcaaactgcccccctgcatctgttgagacagaacaattttcttgatgacttccagtgctagtgggctaattgttttttcattttataagggatgctacgttttatccagcattttacagtgttttatagggagagagttttcctataatttagtccttaatattatgcagaaatgaaaccttttgatgctttttagaaatttattttggatcaacttgcaagtttcttatcctttctgagctgcaagtttctataaaatagagtaatattttttactttattgcattgtttgggggaaaatgagctaatgtataaaaagtaaggaatacgaaaaaggtacactttgtgggtagtgggaatagctgagcaggatttgacgaataagtgtgagtgaattcaagatggttgaaagagtagtaccattacactgggtagataaggaaagaaaagcacattttaggtcaaaggaacaagtcatgtcctatgactgttcagcccagttttcatccataatcaactttattgcttcacaattctgttggttatgcttattttgtcttttgaggatataactgcaagaattcccagcagttcctatcaaatatgaatcttaacccacatacacaaatttgtgttataatatgaaaatgagacccaaaccaaagtgattctatttgaagatctccatggtaagtcatacactgggatagctgtcagatttctcttcttggttttctgtaaattgatgaaacactcagccttgggttcactggtttaaaatgatgagctatttgcaattgtttcaagcaaggtttttggaacttttgaattgtagtcactttgtgctggcacacgtcttacagatcttcctagctttccagcctcactttggcaggaacatcaaagaaagcacactatatccataagatttgggggattcacactcctctcatccagctgctggtcacaagttccaactcatttttatcagttccattgggtggttttctaatatcctataaagcaacataggagatacaagtgaacatctgcaaagcacagtgtgtgctgagaaacagggcagtcacttaacaagcacatttttcttcccactctttctgtgcttggacaacagatctggctaaactacacagcaatgcaaattacaatgtaactttggtgggaaaaattatataaaattctagttatcaagtagtttcaaacaatgacaaaacctaccactttgaattagaaagcatgtatctagccatacaaagcgctttggcttggcacataagtattccatacttctttaccaaccaatcagaacttttatcacaaagtactggtgaatccattctcatttctggcaaatgcatgagcaaaattttcttaagaaaattgcccataaattcttagatattttgtttttacaatgtgttttccaaagagatctaaatttaacaaagttgtaggtgaggaagccctgcttttgcattataatttaattaattagcatttatttttgtttactttgaatgtctttgcatgctcatatgaaaatacatacatttacaataattcagatgtagacctgtcagatatcaactcctcaggtagaatgacagttaaaataataaaggggtggatgttaaacatgagctagacttaggtgtgattgagcaagtgtcttttctctttagatcctgaaaggaaatacttttctgtgatagaatttcttgtctagaattgacttttccctgagaaattttgacctggatttttaccatcttcttttaaaaataatctcgcatgtcatctttgcaaagtcagtattacaaattgtttcccccaactccctggaaagatgtggaaatgaccagatgaggctctgtgtcgaaacccaaacccctcgtgggcaggcagaacttagttcttccataaataggatttctacactagagcttttcatcggcaacttttactctaatgaaaaaaaaaaagtaaaatcagtgaagctctggggttggcaatacctaagacaaatgaaaaggcattgaaaatcttccagatatatcataggccaaataaagtagtcattcgcaaagcttcctagacataaaaagttgttgctagctacgattttgttcacagtgaaaaagaagcttctattttgagcttggttagataaaatgaagaaaaaacttttttttcaaggttataattagtgctctgagttttaacgctggtccactaatgttagtgtttagagacagattgttacaatgcttccctcctcttggtggtcagttctgccgtaaactcttcgctttatatttgcgcccctatcacttctggaattcgccatggatatctgcacactaagtttggctgaaacaattgtgttttttaaaaaagtaatattaacttgaggatctcatatggccagaaaaatagttttaattgaaaagcatttttttttccagaaattaaatgattgtcattgtaaaaccacagtagtgtaatcagagaaacatgcagctgggcatgggacatagttcctaagattggcatttcctgggtagtagattatatataggtttgtaacagaaataaaaagagtcaggaaaagaagttttataactcttaggtatttgcaaactatgttaacattgttggaaagatttttgaaaagtgggtccttgctatgaaagcaaaatatcatcctagagatgatgaaaccgaggctccaagggttaacttcatcagtcagctagaaagtggtggaggtgggttttgaaccatttcactagacccagagctaacatgcatgcaccaccttgttctctgtctttaggtatgtggcccattttgctgtaatacttcacagttcccttttgttgtcctttctcgggggcattcataggttgtctatgaatcctgtgaattcttagatacttatagtggatgcatgttgttgaaataacagagccagcaaggctctcaaacatctacttttttttaaagggttgctgggcattaccaattcattttttaagggagaacatatcactttaaggatttattatttgtattttactaatcactgtatgtcatgtttgttgggaaaagaagctatgatgataattgctacattctccatagctcttctcaacagctgacaggttatctatctacttatttgtttatggtctgcctctccactttagccccatcaaggtagggatttttctctcttcttttcactgtagtatctccaagcctcaaagagtacctggcacatggtagttacacaaggaatatttgttaaatgagcagaatgagacgatttctaagttgtgactgagtgcttatatttacatctgttattcattttcagcttgaatttgagcacagtttgagttcctgtgagatgggggaaaacacctactacaattccaggcacgttatttatgatatttaaaagccaattattaactgtcattttctccattttgtatgtgataagactgagtctcaatgactaagtcacggtcccccagcctgcatggtcatttggacctcaaagactttctttttcacactgccttaggattggtgcttcagcaattcaggagaggagcagatggtagaatgttcttcagatctctgcagttcttgcttatagtgctgtcaggattccttcaggcaggtggctgtaccatgcagtggctaagagccaggctctgcactctgacagcacagccatcaattctgtgatatacagtatatttgctatgtgaccatgacattattgtctccattttataggtagggaaactgaggctaaaaacaattaaacagctttgtccaagatcatttagctagcaaagtaatttgagtcaagatgcaaactttaatgcccatgttcttaccactgtgtaaccctgtctccttaattatgtgtatagttctatacttgattttacagaatcaaataagcagttatcatttattgaatgaactgttacttgatgtttcatgctttgcgccattttcacctttctcactttatccaattagggaaagagtacattttgtgttcctttatcttgcttttacctaaaaatataatgaaaaagaattaataataataataacaaatataggaaggggatatcattcataattctaccatatttaagccctatgtgattaacaccaaaaattttgcctttaaaaaaataacacattgggggaagctgattcaatgcttcttacattataaaatggatgagggattttgataagtgatcagcaaggtgggggttgtataagctgctgtcagctgctcatattcacatctggcatggactggtcaaatgacattacccttggcaatacattttcctgtgcctcagttcctctggggattaaactgtgattttctaaagggcaaagaccatatcttcttctttatactcccggtccctaccacagtaaaggttgagctaaattctgttggagagtgatacctagattagggtggccattgatagcaagatctcaaagattatgctgtaaccattcttcctctattcccacaaatcaggaaataagtactatgatttctccttggcactctcctctgtatctttatacagattctgtaggctgattgtagggattccaagcaattagtaatgagtaatgtgccaaacttagatacaaaccaatctcacttgttaatgagatacttctgtcaaaagagggacccagaaaaggcagaaatggggtggaggtgcagaagcatgctggagcattgctgatggacttgtgacagctgattgcatgcatctcttcacaactttgctcagtgactttgtgttggttatcttgaaatcagccatggtagaagtagtcacaccatggaaattagcaaatgctacaaatagcctttctctaactggttgttagacatttaccatcacaccactggagaggtggtgcaattttagaggtgattgttttgctttgggttagagtggctgatgccccttaacaatagcagaatgccacatcacactgaatgatttagagatgttcctcaaaccaccagtcagatacattgaggaaacaggctctgcaatgaggtcatatttaaatagcaatgaagacatggggatttctcccccaatttgaaggactcctatgatagcagagactaaatttctttatggggaaacaaatggagccaacacctttataacacaatagtaatacaaacaattcaggggcaatgaatgtatatctagccttttacatttctaaaacatcagttttctctcccttgaaaaatgcattcttgagatgattaaatgcaagaatacatgtcaagtgttcagcacggggcttaacactctgtaaatattcataaatggtatattagtagtagtagtatattattgtttataataaatgactctctataggaaattctactagtcagtgtgtcactctggacccctaaccatttcgataaaccctacaccagacatcagcatttagaacactgggcttacagcttagcctagtggttctcaaaaggttcatcccagcaccggcagcatcagcatttcctgggaatttgttagaaatgcgaattgtcagtgatgatgagcattttttcatgtgttttttggctgcataaatgtcttcttttgagaagtgtctgttcatgtccttcgcccactttttgatggggttgtttgtttttttcttataaatttgtttgagttcattgtagattctggatattagccctttgtcagatgagtagcttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagcttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgagctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacgtcccttataagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatgcgtcccatcaatacctaatttattgagagtttttagcatgaaaggttgttgaattttgccaaaggctttttctgcatctattgagataatcatgtggagaaataggaacttttacactgttggtgggactgtaaactagttcaaccattgtggaagtcagtatggcgattcctcagggatctagaactggaaataccatttgacccagccatcccattactgggtatatactcaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccattaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggaggggggaggggggaggggggagggatagcatcgggagatatacctaatgctagatgacgagttagtgggtgcagcgcaccagcatggcacctgtatacatatgtaactaacctgcacaatgtgcacatgtaccctaaaacttaaagtataattaaaaaaaaaaaagaaatgcaaattgtcagtcctcaccccagacctattggatcaaaaattctgaggataagaccaatatttacccaccttttcaagtgatcctgaaccactcttaggctttgtcttaccataaggcagtggcaatgagaatccagtaaaaatgtttaagtcatgctaaaatattctctccagtctttctggaatcttgattggataagcagcctttaattgatccgtgtgaaatgttctgttgcatgtcatttaattttctggtctattatgtgttaacagtcctcctaagactatcctcaattaacagactgtaacatatttatcatttgttgaaaatcacttctaatactttatcttaatgtatattaaatagatgacaatccatagaaattctcttaagaaatatctggagaaacatttacagttctgctacttctcttggtgatcaattgattttgtaaacatgagaagagagttcatcttgttactatattgattggattaaagcactttaaatacaaaggtgaaagttgattaacttacagaaatagagtcccattgcaggtacacgatgaaacgggggtaaggaaggagaagaaaaacattgaaaggcatttgacagggtaaggttgtattccccagacaaccctgtcaagcagctctgttgacaacaaaaagaagaaaacaaataaattggaggttgtgtgaatgtcacaagaccagaatataaatacatatgacatggagagagtaaataccaataattctcattctcacaaaatgttttaggatgataccttccagctatgacaagaccaaaagggaaaaaaaataataagcaggtaaatctccgagacactggtccagtatctaccttttattcataatacaaaccctcaaaagacaccactgcagttataataggccaaataacaaagacaaagacaatgtgtgacaagactcaggactcgcacatccacaaaaatggatttaacattcagagaccatttcagccctgtctaactttctagctcacaagagagaatgcagacttcactctgcatggacaaaaagatatcttcaggcagaatgtggaatttaggacttcagttttctcttcacgctaaaccaattgtagaaacacacatccaaaaataaagtgatgattaccgtctttcttttttccattaaaaatcactttaagcttttcttatcgacttaattatttacatgcacattgactaaatcttaacaagctcttaaatgctagttgccctgttgcctctcagcactagccttcccagtgccacacacgtgccatttgcctttgtgctctgtgacaccaccatctgggtgtctggtccaacaagcgccttcttgaaaaccttacataactccccttttcctgtgccatgggcttcacctcaccatatctaatgggagctctggcctggactctaggaatgtcattccagataggcctgacgggtctcactgcccattaacatgagctcccccttccctgctgggaagccagaatgccgtgtcttcctggcacgtccacgtcctgccaactcaggagacaaaaccattagtctaccatgagaaatctggttttctctccatggccagaaaaccttcagttttcagtaccagtaaagcctacccttctaaaacatgcttacactgaacatcaataaactctttgataaagaagtcttgttacaacatgcaaagctgtaggcaaaaaaaaaaaaaaaaaaaatgacagtcccctctcaccttagaacatatcaagccctatcagaaggccaagaaattaaaatatgttgaatacatttaagctttatagcaaataccctgtacaagaacctaaattgaagctttcaaaaatctaaaaggacaaatctaaaaggataatccatttcatgatttttagatatgacatgacatagaactataattataagaaatatacccgagatgctttctgttcaaaaaattcaaagattcttcataactgggtaactaactaacataactgggcccttttctgttttcagactctctctggatgggccactgtttcctatggtgtcaattgcttcacatatggtgatgactaacaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcatttctcaggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacctttcctcacactctccttttagccactttctgcatatcctcaaaactcatctttctccaggaagttttcatcagggtagtcattccttctgggtattcctatagcagatgtagtcctagtacttttacaatattccaactcattatcctctcttttcccactggactgggagatccttagatgctggatagtccttggtgtaagggcctgttttgccatctctcatttcccaggatcatacaataacacagggcctgcttattgtatgtcctccataaaattctgtgaattgaataagtcaaatgctctagaatgaggtcatgtgttcctatgcaacttctttctggaagccagggtaaatgaaggctacaaagaagtagctactgctgaaattagaaattttgttcaagtagacgcactgaatcagatttttaaggtgctagttaggccttattactggaatgtgtctcttatggagacaaagaggaaagtcttggtaattgccaacttcagctggtagtctctagcgaagaaggcagttacgtgggagagcctgaccctgtgcacctacagacagaaactcacaggcatgtgcctagggatataagcaggattacaaacctcaatctggtgtgtcaccaataaacaaaaagtaggtctttctttgattgtttcaagttttataaattcttaatgtgagaataaatagtaaacccctacagttcttatcaaacttatccttcaatttagtattttttacaaatgagctttacaaaaaagcttcatcctgacttgaaaatgccatgttaggggctacatgaataacttcagtatctttacttttgtatgtgccagtcttctgctgaaaagctgcctccctgggtcctatctgttttcttttctctccagatctctccagtccatgccatgctcacatgttttaatgctgtgtctctccactgcaaatattccatcctgctattaaaccaggcagccatttccattcaatgatggaaaaccctggaaacagtctatagtaagagaaggcttggcttttgacttcatggtccagtagaaatctgaacaacctacaacttggcagtggatgagggcataggcagcttattgattatgtaaccgaagggagaagaggatagaagttttacctgaaaatgccatgttgcctttgcaaacagtttctccaccctaacagggtttgaagctggccctggggtaggaaatatggtttgaatctggcctatggtttgaagctggccctggggtaggaactatgaatatgtgcaaaccagttgtttaatgacttgctaggtgactctcagctgctctttcaacttctgtctctaggataattgtgcttatcaggaaatgcaattctgttgcttatgttttctattttgaaagtgtggaactttatcaatgttttaagctttccaaaattgaatgtgaatagatatactttgattagaaactctaaatcctagttctaaaaagtctagttcatgaaaaataaaatgcggtttaaataacaggttgagtatattttgcctcaaagctgctgtttctctggccagccttctttcagcaggcatgtccaccgtctttttgtcactgatacaccaaagcttggaggtcacttctggtttctccctctccaggtcctcccatcagttatgcaatagccaagatgtatagattcagcttttactatgcctgtcctccccatctctttctctgaatttgcatgctactatctgagctctggttcacctgatatattgatcttgctcagattagcaaaataataccctgatgttctcactgccaacccacccaacatcactgctaattttcctgaaatgtgtctctcaaatcatgtcattccctgctcagaaattttcaagggagtaccgctacttactaaatccatcccgtatccccagatattcatcctaccctttttgctctatatgttttttgtttttttgagatggagtttcgctcttgttgcccagactggagtgcaatggcacaatctcagctcactgcaacctctgcctcccagattcaagcgattctcctgcctcagcctcccgagtacctgggattacaggtgtgcaccaccacgcctggctaatttttgtattttcagtaaagacgggtttcaccatgttggccaggctggtctcaaactcctgacctcaggtgatccacccgcctcggcctcccgaagtgttgggatgacaggcatgaggcaccgcacccgcttatatgtcattgttttaaactatgggtgtgcatttgctgttctttcagcacattctttgtgcagcccttcctctgtgctattgcttatggtgctgctttatcccaagctacctgatttgaatccgggttccaaagaaaaggctttgtgccttttctttcttacttacaatatgagaatcataatatcacctaccttataggattttgtagcaattataggagggaatacaatataaaacaattacaggaggaatacaatataaagcccttagaagagctctagcatgtagtaaatattcagctaatgttagtaatcatgtttcatttctttcaaggaccatttcaaatccgtgtcgtaatggaagccttttatatcgcccaactcaatgtaatttcttcctctttttgtacttctttgaataatatttaacatgaaatgtcctgccttagaatttggtgtgcattcattttggctttcaccggattgtaaactgatgaacactgagtaaactttattcatcgtcatatactctgaaggatcttgtatagcacctggcatatcaaaagaacttagtaaatgctggctaagtggaaatcaattgatttttactaattttaaagtggttttccaccagttgaaagaaaaacacagtacataaagataagtaaaagaaacggacagctttataacatggatgtgactgcaggaagatactgagactgatgtcatttgaacgcacaacgtaccctgataacatcctttcttctgtgttctcccttgcaggtctgcttagtggcctatcttggcttgtttatgctttgtgtctcatatcaggttgacgaacggacatgtattcaattttctatgaaagtaagttgtgattgttctttctcttttatcatcacatagaaagaaatccaagtacaaaataaaggagtgccttcttaaggggttgcatatctgattagtctagaaattgcatttttaggcaggccaaaaaatgttttaagagggcattgatccagacctcaaaggtaatgctgattttttttttaagtcttaatttccatgaactgggttggcctggaggatatgaagtctgtccttcagtgcccttaaaaggaatattgaaaattcatcagttcaacaaaacacttggccagaaaaaaggtatctctttcagtgcccacttccatatctcgggggttatttgggatattttaataatgaagcagtctaagtgtatttcctcttgtaggtgggatcactgagacagaaaaagtacattgggcgcatccaaatgctctgtgccaagactctcagggcaaagtgggggacgggtgatgggatatgcgtggtttggcaagcgtgtgtgtctttcatttgtgtgtatcttttttctgttagggacagtgcatttggctggagccaattcaagtacacagcattttcactgcacaacagaatctactccaaagggaagcaaagacactacctttcagagtataaggacatagacatagaacttagcaatcagagctagtagaaagcaaattccttcattttctctcaactactatagcaaataatacaaagctatctttaatctttttttttttaatttggtccactaacattgttttttcttctacaagaaaacatataaaaactggatttttttgttcactacaatgagaaaacatcagacataaaagtaagtgaatgacattatttgaaagttactaaggtgaaaaaaaataaggtgtgttggaagattccagtataattgaagctgttgacataaaaaagcaaagggatgatatcttttaaaatcatgctataaaaagtaattaatagatacaaacatttacattataataactaattttaaaaagctggttacacaaaatgtatgatattatcctacagaaaaaataaaagctcttaatgagcatagaaaatacaattatctatgagtggtgggattatatttgcattttgcagtttttctctaattttgaaatgttctccaatagttataacttttctaagtaaacagttaatagatactacttttttaaatgatgaagttagaattttggtggatatgccttcatttggaaattatacttttctgtctgaggactttccttgaaagaaggccagatagagtagacatcagtctatgtttactatttgtttggagaggtttgactaaacagcaaggcttggtgattaaaaaaaaaaaaaaaaaaagccagaaagcttagtaagaaatggcctgttaaattacaagaacttcatccagtagctgaagaacaccccaaactaggtttttattagtttatgtgaaataccctcattttccccccagatgatcccagaaaacagcagagtcaaaagcatcagcttaagagagaccccaatgccatctcagcatctgcaccttagttaaaatagggagtaagagaaaaaaaatagaaaaaaaaaaaagtcactgccaatgtcagccaggttgaggattccccactaggaagatctcattagctacctctttttttccacccgtgacaggcattggcaaatactgaggcactttcctcttctcctgaacgtgacctttcttgatgcttgctgctagctctctaaggttgcatgctacattatcttcaggttgaaagtgagcttcagcccatctccagattttccaatgacacaacaggggacagctgacttcccttatgcttctcacactactgggggggcgaaggcataacatgcatcttcatagggcgtttctcatcagcatagccgcattttggtgcccccatctcgggaccctggcctaagctttgttagaggatttatttcctcctgttgaatgcccagatagccaggacaagcaaacgggccatgatgacagtctcattgtagtccacacgtgcacacacacgcaccctccctttcgcttagagaaaatagccacgggctcttttttttttctcaagctgggacagccctctgggggttcggggattgggggtagggtcccttcgcaggccctcgatgccaccagcgcgttcctttttcctccctgggctttgcctctctgcctctgggcttggctgggcatcggctgcaggtcgcgcttcctgcctttcctagtggcctgactttctcagggctcccctggaggttcggaaacgtgtcgggggcatgtgcctgcggaaacattccagggcacgttccctcctgcccacatccaggaggcccctgggctgcttgcggcagcctcctcccgagcagtgcgctgcagaagggcccttcccgttcaggccaccggggaaggtaattaaattggagcagaaacaccctcctcccgaggtcaccgaacgtgaaagctgcaggccgggtaccaattaaaggcagcgagcgagcggagacgcgcccgggcgctgctgttacataagcgcccggggccaccgcgcctccgcccgctgcgcagcgccgggctgatgggctgacacccgcaagacagatgcctcccgcgccgggcttttatcaagatatatttgctcggattctcaaggtcatcgtaaacactcttccttatagtgtattcgtgccatgtaggtaaaacaagccacttgattttaaattacagattctaacccagaagcttgttgctgtcagatgagttaaaagccatgaaggaaaaatgccacagcgctgcagataaagcctgcaggctttaggggggatcgagtatatatttatgtcttaaaatggataagaaacttgattccgtggctttctctagtttacttggcctgatgctttccggagtgggagaagccgagtcactaaagtgtgagatagatacgcacgatataaatttattcatactcagagaagctaaggggcatggtttttctttatgttctctttgggttctagcataaacggtttaattaaaattgagcaaccactgtgtttgtgtaaatgtttacatccttcctacaagccaagaatgcattgttactcccacatgacaaaataagacaaaagcagtcgaattaatatcctcagtcctcagaactggcagctctttccatccctactaatttgcttattatttcacaaatacttaaataggctcctgtataccagacgctgttctaagttctttacagacatcaactcttttgatccttgtaattatcctgtgaagtaggtgctattatgatcatcatgccaagtttacagatgaagaagtacaggtgcacagggattgatgaatttgcccagggaccatggctagtgaggggagaacctgactccctggttcacgctgttaatcatcagccagtactgctgcgcacttgttaaatggtcttgggcacatcttttaatctctgagccaaaaagtcatcttttaaaaatagacaaaattcccattttcagcaaatggatttttgtgactatcatgaatgagtaaaatctttttcaactatttgaattatttgcagattgagaatgagggattattgtcattgcttcaagatattgcccaacaaatgttacagaaaattgctatctaaggagcttggtgcggtggctcatgcctgtaatctcagcactttgggaggctgagtcaggaggatcacttgaggtcaggagttcaagaccagcctgggcaaaatggtgaaaccctgtctctatcaaaaaaaatacaaaaattagctgggtgtggtggcacacacctgtagtcccagttactcaggaggctgaggcatgagaatcgcttcaacccaggaggcagaagttgcagtgagctgagatcaagccactgcactctgtctcaaaaaaaaaaaaaaagaaattgctatttaaggatgtatgtatgttagaggtaggaaggttatcacaagacccccgcccccaacttccatccattgttggtgataaaacaggtagagaaaactccatttggggccattctactaagcagatgactaccaggtgggaaatgatcactttaacctgggccttccctggttaaaatcatagatataccattgttcccagagcaaactgttcccagttctctgctggctgtactgggaatacagctacgatgggtacacacacacacacacacacagaacatggtcaagacagtttaatttggctcttggcaccaagagtttgaagtcagtaatcaagcctgaatatttcagaacaacccagaattgttcaaatattcttccccattggttctacaaaataaatccatatttttaggctaaaaactccaatttttgcataaaatgtagtcactgaaaatattgagggccagacgaagtggttcacggctctaatctcaatactttgggaggctgaggtgggaggatcacttgaggcttggagtttgagaccagcctgggccacatagcaagactccatctcttaaaaaaaattttttttatgatggtaccactttgtatatatctggttcccttcctccaaggaacactaatattgagtataatcattgttatgtccctgagatataagatgtttctataaactgtttcacagatgaagatacttaggttacatctgacaatcctttaaatgatttgaagaggaaaaagaatgtgtgtttaagatctctttgatgaaaagatctaaagaatccatgatactaattaagatgtattaagaaaaaaatggctttaactaattctacgctcttccagtgaccttagatagacagtcaagctgtatgtaatccctgatggattcccttacaggcaaaccagagataagcttagggcaccagcaaccagtatgtacacccacacccacacatacatgcacacataccactcaagaaaaagaaaaagtaaaaatgtaaatacagcattccaaatttaagacttgaaaacacttgaaatcatcactgtgtggaacacactcatttggaggacttttgtacacatattttgtagtgtcacatatatgttttaattttgaattatatataagggaaggtgggggaagggcatcatcttctcagagctactttcctctgaacctggaaatgactggaactaatattactttgtgaagtgtccatttaccagaattgttctctgtagagagcaacttttgactgtggtaatgtaattcttgcactaagaactatgtgtactagtctcaaaagctggggactctgagccttacctagagtctcagcaggtggaccattaagattaacatttctagtaggtgagttcaatcacaaaaatatttcttgttccatagattttattgtggccatgtcagtgaacacccacaagttttgctcagaatattttaggtgtaagctaaatccctaaattgttcagagttcccacagccctgtagcagcagagcgagaactttaaccagactttttcaatcccaaagctaatctggaggccaacagtgttcaaaaccttggtgactgaggaaccatttagagttttttcaggctcaggaatcacatggtcgttgttgggcttggggtaagtttcacaggcgatgaagctgacgttgagtcacttgacttctggagccataatttattttctcccagcaacctcctactggggattctcatgtttatggatacagtttggcaatcactacattgaatgtagtcttttaaaaaaattaacttatgctattagttgacccatcattgctaattttggcccacacagtgtttgcattacaaaaacctgttctttacttcctagtcttgtttcagtcttaatatcagaagttcttgagttcaaaataagcacaacatgtcatccagggatggctagcttgtttgggattcatctaaactgctggcaatatctagacaaaaacattccacagtccagctaatatggttgtcacaactcttgaaaagggcccaacatctggatggcaagtgaaaatgtgatcagggtttaagaactacccactaataaataaacatggagctatttccatgtcttgggtgttgtgtttctaagaagagacagcctttccatcagaaaatttctgggagggaagaaaaagaacagttttgatgaattcgctttgcaaatcatcatccaatgttctttgtaaccagaaaggttttcttctgctttcttgcagctgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaacggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaattattaatagctcaggttaaaaacacccatttaaacaaaaacaagagcatttgtaataggaagtgtttatacaaatagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctattaaaaaaaaaaaaaaaaaaaaaaagccagtaactgaatccattttgatttttggttgagtttcctacacaaagaagaaaataactgagaatctggaatgttgtagtccatcctttaaagagtaagaaagtagcagttaatgctagtaaccgtgaattaggcaccactgaaagcacatcccgaatttctttaacaacaacattttatagtgaacactacaagtttttatatttaaaaattaagactctgtatatccttaaggtgctctatgctttaccagtaattcacagggtatttcaaatggtagaatcattttagcttctgtgcttcctttttctaaataatgcaacttgtaagagttgacattgtaataagctttataatagtataaccgtcaggagatatatatatatatatacacatacacacacacacacacatatatactatacatatataaaatggggatattactattgtatgattaaatcattcttaagtccccaaggaaaaaaaatcataaacaaatagaaagaactaaacagaaaagaaagaaagaaaagatccctttgctatgagctcgctgtatattgataagtgtaagaattgtgttgcatgaataaccgctttgggctggatttgaagtattttgatgttgtgttttgcaaatatt

SEQ ID NO: 16148 - DNA, 8891 bp, Human
ttaaaataaagtcagcattttaaaaatactttttaaattaagaaccatcgtgattaaattgcctgtttggtgcaaaatacgttcctctatttgaggaagtcgagagaccttaaaaggccctctaaacagatgaactgaacggaccgcgagcgtctcctcacgccggggtgatcctgggccgccgccgccgcccgagtcacgaagccagacgcagtgcgcgtctccgcccaggactccggagactgcagcagcgcgagcggccgccgcggcccgggctgctcctggagtcggggaggagacgcgactcccgcagacacgtgacctcctcccagccgccgcttcccgcgacccagatccgtccccggaacccgtgcccggcggggcgggccgggggacacgtagcgggcgccccagtccctgctgcgccctggtgcatgtacctttggcgttcttctcccctcggttcacttatcaccggcaataatcaacgtttcagagatcaccccggggagaatgtaaatatccctctctgtgcaggaaaaaccttggtttttttctctatgtctttatgtatatctagagaaatatatatatagcctccatcccacccctgggagtccctcaggacatgccttcccctgggctggcagggcggcgtgggcagtgcgcatccccgggcacctcccggtaactctcactagcagtgagtcatgctcccagggtggctctggggaaaggtaacccggctcttgctggcctgtgattcccggcgccgagcgccgcggctgcagggcgagcgcgcgcgcgcacgggttccccgagcagtgatgtggcagcagcggcaggtcggatcacgttgctggccctgtgctggtacccgtttgagaccggattaaggagggaggctttggaggtgccagcggtagtaaacgtgggctctgcacactccgggcgtctcttatcgcgcgggggggcggggggatggggaaagcacgtagcgtcaccggaggctcagaacgcggcagagttgagcgggcgggtgataaatgctgcatagcttttctgtggtagcccctctcgtgccaccccctctcgtgccacccccttctcccttcccagcccccactcaaccccggctcgctccccgccgcgttcctccaggagcacacgcggccccaaacgtcgtcatctgctgctgtgattagtggcaccgcaattccggctgctgcggggaagtttagttggcccagggacgccgtgtcaccgaaagacacttggattgcgacattcggacccagtgacaacgttttcatgtatcttaaatccttcaaggagcggattgcaagttgcttcttctcgaggcaacctctccacccagcgccaaggagtccctccaggccaccgatcagtgagcaaacaagtctccaaaatttcctttgggactcaagtttacccaccgcgaattctcttttcacttcctttctatggttcaaaccaacagcacaatcggtggaaaagcaaaaagccacgttcacattcctgcaccgtaacaacggacgaacccagggagtcgcattttggagccaaggaagctcaggctgccccgcacccctgcacccccactcccccctcctcctgccgactgcatcgcctttgggaagatgaatagcttggccgaagttgtttttcctttccggtggccctgatcaggtgtccccgccccctcctgccgttcgccttctctcgccgccttctcccgacgcccccgcccggcccggcccctcctcccccgcccccctccgggctggaccgcggatggtacgttccgcacgtgagctgggtgctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttatagggtaaggtgcacgcacccttgcgaatatctgtctaggctttggtttgatttttttcttctccagaaagtggtatggagctggcgagggcagagcccctccccgaatgggtgcctgatgctgatttctgttttgcagactggactattcctctttgtatatgtgtaaacccaaaaggagcatgaaacgagacgacaccaaggtaagtgtaagttcccgatattcctcataacctgcatgggtagttaattagagccattgatttcacagtgaagctctgcccgcaaatatattccagcccctgagcttccccaactgtgaattttaagtggcttgctgggtactctcagggggatattaaacatcatacctgaatttaaattgcattgcagaacagtccagaggaaagaggtttcttgggtgtagtttatcacatagtatgttttatggtgggggggcggggggggcagacgagggtaatatccaataagtgaatgtttcgcttactgttttctcttttccatgactctcatatattaaggatacctacaaattaccgcacagattaatagaaaagaaaagaagagaccgaattaatgaatgcattgctcagctgaaagatttactgcctgaacatctgaaattgacagtaagatgcacattttcattctttgctgctctccaagggcgtgttaatagtctggtgcgactcccagaaaatataagaataaatgtaaatataagttcctgacttaaaacttgtgctataccgtacagagtttcccgcaaactggagtaggtgctcccagctgaaggcaagaaatcatttataacctgtcttgtggaaagctcaagaagtaaaagaacagtacttctttcaaagtgtttgcttaaattgctgtgctgaatggacagccaattaagccaaatgtgtgtttttaagtaaccaagtgcccgtttcttttttgcaccactgcagactctgggacatctggagaaagctgtagtcttggaattaactttgaaacacttaaaagctttaaccgccttaaccgagcaacagcatcagaagataattgctttacagaatggtaagtcagttcagggaggccagcctaccctgatgaagcggggcagcccacaggggagcagtgtcaggactccctcacccgcaccccatctctttccgtgggctcatgggttccctctcatttgttaaattgcttatactttcccttcattggaacgagcccatttcccgaagcatcctagaggctttcagcagaactcggaggaatcaggatttaaagtggcggttgcacccgctccactttggttttcagctgggaggagagcgccctctccccgctccgcacctccgccaccccgcttctctcgtcaactggtggattatatcacttgaatactggggaaaaaccgagatcactttagtcgatgcagggcccacgtgataagcagatgttttaacgtgggtatgtttcttcttgcctccactcctccgtcccccacccccatcccttcctcatcctaggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaacttgtgtggtttgtttatgttagacccaattttctattgttttaatgattgacaagtttttcagttttcgtctgtgacatcacatagcctctctagtatggtcaggtgttcctctttcactgggtcttgtataactagatgatcacaaaggggtgcttaatatgagagtgttttggcttctttttataaaataattctgtcatgggactttatcatggaattccaggatcagaaataatttctagacttttctcaaatttccattcaaatctgtgatatgatacaaacagtgaaggattgtcagcttttagtttcaggaatgttcttcacaaaccccttgatttttgaaaatgtttaaatgagagtcagattgtataagatgtagaaaaagtgctccctctgctgactttatggcaactgaactgcaagtcataacagtatgaagccagaaggagccacagctcatccagtcccctgcatttcgtgataggaaaaaaagaaaggaagcccagagatattaagtatcttcccaaggtcacagagctacctagagtcagcactagcactagtggccagctctattatatccctcagtcactcaactacttcccattgcagtatcttggaccaagtaagctgaacttgattgagcagcccccatgaagcttcgtaacaaaccatagaacaaaggaaattgaaatcaacactagaaaactatgtaggatttttcagcattgttaatttattgaactttagaaaaattatctgaatcagaataatgggaaaaacagcatttcaaatattttgagctatattttgatgccactactgtagtaatattagtttcataaccaaaaaggattaaaagtgaatcagaggataatacagtgtttttagcatgtgtataattttggtataatgagataaaaaaatcttcagagttgggccagattttacaagtcagttatttagtccaagtgcccatatggtaacatggtaagataaagttagaacagaaatgcaaaaataatattgtctatattgtatctgaaaatctgaaaaaactttattttagtcattgatttattttaatgaattaaaaggctgaagtcataattcactaaagaggcttctatacttgtagtggtgaaatttcagctaaaatgattttccaacttcaggcaaatatgaatcttgagtcaatgtttttatgagtatagtattatactcataaaaatttaattttacatacatatattttacataatctttaaaaagattaattttatataacacatttcttagcaaactttatattgaattgaaaaaaaatggcccttccctcccctccaaagagctaaccttaagcacgttttcaaggcactagaaacaacactttaatagctatgtaaaatttggagttttagttcctatcattgtgaaactatttttcatttagttccctgtttctggccatccaggcgatgactttggttattgcccaccacccgagatttgttcaaaagttatgtaaaaggaggctcagcctactcctttctatgtcacaggtcaattcttaacctttccatggaaagtgattgccagtggagcctctggagagacatggctgggcaaacacacgaaggacttttacattagctagaaatgaacagagctctcatgaatgacttaagaccattatattgccaaaagctggctgtactgttgtgatcatggtattttacttcaggtagcaacctgatatttttcattaaacaaaaattcttaacctattggaccctcagctcaatatatttagacccacccattgttctcactgttattttaaacaagttcaagatggatttacagtgcatgctaaagtcccatggaagttctagtttttcatagaagaatttaagtaagggattgacgtgggaaattatcacatattttgtgtgattaagatgggatttatactagaaaacatgcgcagcatgtac

SEQ ID NO: 16149 - DNA, 12899 bp, Human
ttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaacatttcatcttttactttttagcaccaacagacttgataacagcctgatgctgatctgacaatgggttgatagccttcccccactgacccttaaatctgcttagtaacaagtcctttgcttctgtcattctcctgggggatggcctactgccctcctttctgtacaatctgggcaaaccgactggtgatggcaagagtggtgtcaatgaagcggtctacacagctggagagacaattttcagtgcgagagtctaggcgattccctggcttctccacacatttatcccaacataactccatgaagtgatgcacctaaaaggaaagaaaaatagtaaccattggggtctgcagataggcctaactcttgtttattaacttctcactttttgacacctgacaaaaccattctttaaatcaaccacggagtcactttgggctcttctctttcttcatttcctaattagtcaccaatattgatccagatcctcgtccctacagattgtacattctcaggtaggactaataaccttttatattccccaaagtagctagcaccattgtgaaccaactagggaaccaattaattttcccaaactattgcactcattttattccaaacctatcccctagacaaggtaattcttccattaaccttttgggggttatggatccactccccagaaaaatgcacatacaggcacagaaattatgtgcactgtcattagaatgttcagggcccaaagatttctagccagggttcttgctggtcatccgagcaccctcttcctcccacccaaaaggaaaaaaccattttaccaagagcttactatttgtgaggctgggtactaagaaatcagttctctctaaggtcctcaaggatagctgtcatcacctcccatttaagaggcgtgattatgtagtccaaggtcatgtagccagcaagaagtcaggccgcgttagaaccatgtccgaagggctccaaacccttgttctacatccatagtctacagcgactacttcagagtccaccttcctccgataatgttctagtcgttttcaaatacattgtcgcatatgatcctcacaatccagtgaggcagtggggtgacggcgaaaccaaaacccacagtggatgagtatcttttctacgggcacgtggcctgcaaggagcagagggaggatgagaacccagatctttcgaatgccagcccagtcatgtcgccggctaactagtctcccgtacccttgcgtcgcccaaatcttccctgctttacaccttttcttttctccacgctacgcttatatacctggcacctgagcactaccggtcaccagggacaggagagccataactttgtctttcgtgaggggaatgggatgcagccgggatcgagcaccagtgagccgccagtgtacagacctccgagcgtgcccaggaccaccaaggaaggtgaaacttcctttcccttcaccctccccgtccccgcacctgtgcagtaaactgcgccttctgctgctcggcggccaccaggcgctgcaactccgcttcatcggcttcgcccagctccgccattgttcgcctcaggctcgccaccttccgacagctgtgtttgcgcatgcgcgacgggtgtgcaccgcctctcgacttccggttcacccagcatttcctcttccctgttttctttcgtcgtcgtgggtgggaattgtcgcctaagtggttccgggttggtggatgaccttgagccctcaggaacgagatggcggttctctggaggctgagtgccgtttgcggtgccctaggaggccgaggtgaggggtcttcccaccctgaggtgcttagcgtagcctccagccagggaaggggatggaagtgaggactcatctgccgggtgggagatctcttgaggagaagaaaataccgaaatcacagcaatgaccactgtagtctaggggtccagatgtttacccgaaggtatatttcacttgctgtgagctgacgagttgagggaataatcagaaagagagctccctctggaagtcgcagtcctgatgaggctaatccacatagcagttctgttttctccccgttcactgtccctagaatgctccccactcgctcccaccctgagtcgggaaagagggttaggagcttgcccatttcttctggagttggtgtgtttggatgtgggagtggaggggggatcagttcgaaaatcatttaacctgggcatttgtgttacctcaggtactgtagtaatgctaggatacaaatgtgaagaaaacgtagttcccgccctcaacgagctttcattctgatgaggaaaacactgtcatagtagtccgggcaagatgaggtcctgaactaggaaagtagcacaaagaaaagaagattgtctcaagaactgttaaagagatacgccaataggatttggcgattgaatttaggggaaaagtctctcatgatttccagattactgagttaggttaaagaatgcctgaggtgtcattaaataaagtagggaacatgcagatgttccctggtcttaacttcacagtaaccccagtgaaatagatgctatcttcattttacaaataagatgttatcccctatttattgttaagtagcttacctatggtcatttagaaagtttgtcagtcctgttaaaggagaggttcttatgatcatcctaatgactctttcctcagctctgttgcttcgaactccagtggtcagacctgctcatatctcagcatttcttcaggaccgacctatcccagaatggtgtggagtgcagcacatacacttgtcaccgagccaccattgtatgttctctccatcgctgctgctttctgggctctagccatctttaccttcactaatggtcatgcctttagcaggacttcctacctgtaggggggactcttgtgtccaactttgtcaaatgaagacctagtttacacctttgggcagacagtgccattatggttgaatgatgccatttataatcatagaagaccttctagcctaagtctttacaaatttttttcttttgttttctttttttttgagacagagtctcgctctgttatgcaggctggagtgcagtggtgcgatctcggctcactgcaacctccaccttctgagttcaagcaattctcctgcccctgcctcccgactagctgggattacaggcgcccaccaccatgcccagctaagttttgtacttttagtagagacgggtttcaccgtgttggccgggctggtctcaaactcctgacctcctcaaactcctgacctcaggtgatctgcccacctcagcctcccaaagtgctgggattgcaggcgtgagccaccacgcctggaccactaacttacattcataaggtgtctgttcacttcactgaaccaagactggcttaattctgtagcaatacagcaattctgttttttatccatcttcttggatctgtcttctaatcaatatgtaggcattgagatacccttgtgctaaaagacttcaaaaaacagagataaagccttcaaaaaacagagatagcttctctcaactactattttgatattttacttcctttgtactcagagttatatcctatatgtacactgcctgtcagtttgggttactgtgtggcatatgttgaacatgaaagatgtgtgtttctcacatcaacttttatgaatctggtcctttttgtagctggctccaaggctgcatctctccactggactagcgagagggttgtcagtgttttgctcctgggtctgcttccggctgcttatttgaatccttgctctgcgatggactattccctggctgcagccctcactcttcatggtcactggcaagtatagcaattccaaatatagttgtctgctcagtttgtttgctgtgagcttgtcttatgtattatatatgagggagaagttgattgaaatgccctaaatttgttgaaaactttaaaatatatataaaatatgtatatgcctagatttatatatctgcctgcctattcaatgtctttcaattcgatttccgtatctaatagcattttgaatgtagcctgtcaaactgaatttctgatctcccctaatctgttcctcctgcactcttgccccatctgaattaatggcatttccagttttctctttgttcaagtctaaacctggtaagctccaaacttggtcattatccttgactctagtagtagtctcctaactggttcccatttgtgttcattcccaacacagcatacccagtgatcctgttaaaatgttaattagaataagacattccccttctcaaaaccctattttgtctcttcatgttactcaaagtcagaattcttagggttgtctgtagactctacatgattgaaccaccctgtttcttccctcatttttagctgctctctctctcattcacactgccttccttgagattccttgaacatgccagggacattccaggtctcagggcttctcttaactgcttctgcctgaaactctttttctagctatacacttggcttgttccttcatctccttcaggtcttgaatgccattctctcaacaaagccttccctaaccacttattcaaaattgcagtttctgtcctgccattccttatctctcttgcttgttttatttttctcaatagtacttactgccttctaatatactacatcatctgttcattattttatatagtaattgcttccttgcattttatcacccaaatgtatatccctaaatagtatagtttattcttgcctcttaaaaaaaaaaaagagatgtatgtgggtggattattttgttatttttactgtatttgtttgctgttgtgcctctagagcctagaactactctctggtacgtgacatatagcactcagtaaatacttgctgaatgaatgagcatccagcgcctgtttgtttgtttgtttgtttgtttattttttgagacagagtctcgctctgttgcccaggctggagtgcaatggtgtgatctcagctcaccacaacctccgcctcccaggtacaagcgattctccctgcctcagcctcccaagtagctgggattacaggcgtgcaccaccacatccggctaatttttttgtatttttagtagagacggggtttcgccattttggccaggctggtctggaactcctgacctcaggtgatctgcccgcttcagcctcctaaagtgctgggattacaggcgtgagccaccatgtccggcccagcttttgtttattttatctggtatagtttgtatgactttctacgtaatgaaccttctaaaatgagggtaaatgacaggttgggttccttgagttgttctttttaagttttgcaagggacaatatgttgtcattgtggggggtagggagccactttcggattgttgaaactggaagtactttggagagtatcttaaccaactcttttattttacagatttggaaactaagacccagggaggttaagtgacttgtcagaatcattttctagctagtgttaaagattttttttttcttttttttttgggacggagtctcactctcacccaggctggagtgcagtggtgtgatcttggttcactgcaacctctgcctcctgggttcaagcaattctcatgcctcagcctcccaagcagctgggattacaggcatgcgccagcacacctggctcagttttgtattttaaatcgagacggggtttcaccatgttgtccaggctggtcttggactcctgacctcaagtgatcctcccaccttggcctcccaaagtgctgggattataggtgtgaaccaccgtgcccagcctaaaggggttttaattatctggttttgtaggactggttaggagaatgagttgttgttgttgatgttgttttttaaccacacagacctttccaaataaaagattccagttgcatatgaaatattagatcacaagtacagtaagtaatatttctctaacatgtcatccctcttgaaggagctgtctataatgtgctccacttcctcaacactgagtctcttttagcctgtattaattggggtcttatcccaactatataacttaggttattcttaccaagggcactgaaggccttcatctttccaaatccggttgtctattttctgccctccacttgcttgaagtctcagccgccttcaactcaattaacaattctccccataagtcacttttctttggctttccagatgcatagaagtctcctctgccagatccttctcctcttgtctgacctcgagatgacaaaatctccagggctgagtcatggccttcttaatttctccatctgtacccttttttaggtgagctcagatctgacctgtttttctgagctgcagacttgtttatctaattgtctaattgacatccacttggatgtctgatagttatcccagatctaacattggccaaatcgctcttttttccccccaaatctcccttgatttctcctttaaaacccccttctcaaagctatgctcaaactaaaattcttaggagtcattctagatatttctttttgttcttaccccacttattccatcagttctgttctttctttaaaaaatagtctgaatcggccaggcgtggtctcacgcctgtaatcctagcactttgggaggccgaggcgggcggatcatgaggtcaggagtttgagaccagcctggccaatatggtgaaaccttgtctctactaataatacaaaaattaagctgggcgtggtggcacacgcctttagtcccagctacttgggagactgaggcagaagaaccgctggaacccaggaggtggaggttgtagtgagccaagatcgtgccactgcactccagcctgggtgacagagtgagactctgtctcaaaaaaacaaaactctgaatcggtcgaggggaaggggagggagagcactaggataaatacctaatgcacgcggagcttaaaccctagatgacgggttgataggtgcagcaaaccaccatggcacatgtatacctgtgtaacaaacctgcacgttcagcacatgtatcccagaacttaaagtaaaagaagaaaaaaaaaaaggaaaatggacattattagaaaaaaaaatagtctgaattgtcactttgcaccctgtcaccagcctaggttaagacaacagtctcacgtaggctacttcggttgccttctaactagtttcctcttcagttgttgctctgtcccccacccactctgttcattcatcacactacagccatagtgacctttttaaaacgtaaaattatattcctccaaagtagatatacaaatggccaataagcacatcagaaattgctcagcatcatttgtcattagagaaatgcaaatcaacaccacaatgagatgccacctcacaccccattaggatggctgtaataaaagatgggcagttttaagtgttgctgaggacttggagaaattggaaccctcgtggttctgctgggaatataaaacgtttcaatcactttggaaaacattctggcagttacaacaaaaagttaaccttagagttaccatctgactcggcgatctacttttaggtgtatacccaagagaactgaaaacgtgtccacgcaaaaaacttgtacaggaatgatcatagcagcattatttataatagccaaagagtggaaacaatccaaatggctgtcagtggatgaatagctaaacaaaatatggtgtattcatacaatagaatattattcagccatacaaaggaatgatgtattgataaatgctatgacatggatgaacattgaaaacattatgctaagttgacacaaaggccatatattgtatggcttttttttttttttttttttttttgagacagagttttgctcttgtcgctcaggctggagtgcaatggtgcgatcttggctcggcacgatctcggctcagcacgatctcggcttactgcaacctccgcctttcgggttcaagcgattctcctgcctcagcctcccaagtagctggcattacaggcatgtgccaccacgcctggctaattttgtattttttgtagagatggggtttctccttgttggtcaggctggtcttgaactcccaacatcaggtgatccgcccacttcacccacccaaagtgctgggattacaggtgtgagccaccacgcccagtggtgtatgggttcttttatatgaaatgtctagaacaggcaaagccatagagacagaaagtaaatttgtagttgggtagtgggctaagaggtagagggtttctttttggggtaatgagaatgttctggaattaaatgatgattgcacaactcaatatactaaaaaccagtggattatatactaaaaagcgtgaattttttctggcgtttgacttacattgcaataaaactgttataaaaatagtaaaattaggtcactcctaatctcaggcactccctgcttaaaatgtatcagtggtttcctattatatttcatataaaattcagattccttatcatgaccttcaagaccctatgcaaccgacccctgccttcctctgatctctgcttcacccatgtgctccagccacacaaatcttactattcattagagatgccactttggtttggatgttctcattcatgtcttcctttctaaagtgtttcttctcagtacatatatatttactttttccttctcattcactagtatattccataagggtagggatgctgtctcacttactatactcccaacatttatgacagattctggcacatgatatctacttaataaattctttttgaattaattaaaaatactgtagagttttagttatttttagttattggggcgaaaggatcacttgcagccaagagttcaagaccagcctgggcatcatggtgagaccgcatctttaaagaaataaaaaacaggccaggcgcagtagctcacgcctgtagtcccaacactttgggaggctgaggtgggcggatcacaaggtcaggagttcgagaccagcctggccaatatggtgaaaccctgtctctactaaaaatacaaaaattagctgggtgtggtggtgggcgcctgtagtcccagctacttgggaggctggggcaggagaatcacttgaacccgggaggcggaggttgtagtgagccgagatcgtgccactgcactccagcctgggcaaaagagcgagactctgtctcaataaataaataaataaataaataaatagaaggaaataaaaaacaattagccgggcatggaggcatgctcctatagtcccagctacttgggaggctgaggcaggaggatcacttgagctcaggagttcgaggctgtagtgagctatgatcaggccactgcactccagcgtgggcaacagagtaagactttgtctctaaagaaaagtcactagaaatagacttactgacatacacacgcaaaaggctatacagaatcccctaaagaagcaaacagtgacagtggagtggcaaatggagacattgcatttgaacttgacagattgtttttttgcagccaagttatctgtatagtcttctaatttcactgtggttttttattgatgttatgattttttctttttctttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagtcagtagataccacctactgatggttacatatactagggaaattttaaaattaggaaatgctgatatctcatattataaatttctaaatcctaggaagaaacgcttggagtgcttctgaatatacagaagttccatttaagggcaagtttccccgtagacgtatcaaaatattaccaattgtaaactgagatttaattctcaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgcttttatatattagctatcagtagttttattcattagaattaggtgtccattgcatccacagcatgaaaacaaaattgggttttttttttttttttgagacggagtcgcactctgtcacccaggttggagtgcagtggcgtgatctcggagcactgcaagctccgcctcccaggttcatgtcattctcctgcctcagccccccgagtaactgggattacaggcacccaccaccacgcccagctaatattttgtattttcagtggacatggggtttcaccgtgttagcaaggatggtctcgaactgctgacctcgtgatccacccatcttggcctcccagagtgctgggattacaggcatgagccaccccgcccagccaaaattgagtgtttaaattttcttctggggcttagcagttaggtaaatcagacacaaagtactggaaaacaaaaaggacttgtaataggcagaaaaataccaagtgtataagtaatttggtataaacagagtataaggtttagtatttaggaataagaactatgtccagattatggtgttctgtgaataccagcctttggaattcatattatgttctatgtgtatttagtctggtctaagagttgagtgtaaggcatgatgctgtcttctatcaatatagagtaactgggactaagcacattttactcaccaaggaccttactgggaagctgaggcaaaggaagagtatgtgtttatgaatgtgtactaggggttaaagacatgctctccttgatgtgcctgtggtcttgtagagactcaagtgtgcattagggtttaggaagaggtgattaattctgttttggggtgggtaaaaggtttcaaaagagggtgatgcctgaatagcagtggcacaccaacagatagtggtggtgggaccagtccaccctggtgggagagaatatataaacaatattctgacattgtttagaattgctgatgcttgatgatgataaaaaacaaatggactaaaagtcaattttattgttttaaaattctctatagacgatcccctccccaccttgtagtgtcattccttcccttccctagctctcagtatactgctgctgtagagtggagtgatgaaatggagtcttccataaagtcaaaatggggatggcagtgactctggataatatgggaatccatagctatctctagtaccatcagatcctagatatacaaggctgtctagtgctaataagcttcattagatggtgaacgaagttggagtggaggctggttgggcactgcctgccccatgtccctgctggtttggtcattaggatggagctgagctgtctttgggaagtcagtaggttgctgtgagctgctggaaaatgaggcaagattccggaagggtgctgtggctcatgcctgtaatcccagcactttgggaggctgaggcagtaggattgcttgaggccaggagtttaaaaccagcgtgggcaacatagcaagaccctgtctctacaaaaatacaataaaacaaaaaaaagattagccgggcatcactagcagtggcatgtgcctgtagttctagctacttgggaggccgaggtgggagaattgtttgagcccaggagtttgaggttacaatgagctatgatcataccaccgcactccagcttaggtgacagagtgaaatcttgtctctttaaaaaaaaaaaaaatccaagggctaacagcaatagtagtttctgacggtaagcaggacatgatcagaactgtgctttagaaataatttgggtaccattaggtgggttaataagctagaggtagaaggacatgtgaggggatagagacagaataaagggcctgaactttgagagtagcagtggaagtaggagtcaatctcaaaaggtattgtagaagtcaaaaacattaattcattcatttgatagatactaagtacctcatgtaatcagcactgtgccaggtactgtggataacgataaaattttacctgc

SEQ ID NO: 16150 - DNA, 36620 bp, Human
agaaaaaaaaagggatggaggggtgggagttttatagacaaagaaatacataagcaaacagataagcaaaagcacgtcctcagtaattccatgttgctttatctgtattcatgatcatgtttacaaatccattctggaattctgctgactactgatatttgcaatttttggcattacttctcatccaccttagaaaacctggagaacattttttctatctttaatcttcatatacatgcttaatgaattctgatgattattaatggaaatttcataacatcaatttattcaccaatatttattagacccttgatatgttcaagaccctgtagctggtgctgtcggagtcactaagatgaactatataaataactactctatgtgtacgaataactaccctacaaagcagaaagctatcaagtgccttaagggagttgaaactgtatttgctacaggagggctgagagaagacagaacatctacgattttttttcttttcaattctcttcctacaactaattcatccgaccttggaagtttggtcttactaaaaacaaaagttagctgttcttttacaacctcctcttcaagattacttgtcagggtttgctgtgcccttcgcagcttgaaagactttctcttcatccaacgatttgaggcaattaggagccactgccttctctctgccattgggttccagaaagcaccatacattgtccgcagatactttactcatgcttacactttcttgttctgaatcttcaaaaattagtggcgtgtggtggcacacgcctgtagtcctagctactcgggaggctgaggcaggagaatcacttgaacctgggaggcggaggttgcagtgagccgagatttcgccactgcactacagcctgggcagaatagagagaccccatgtcaaaaaaagaaaaaaaaagtatctgattgtgtttagcatatctgcaatatccccttgactttggcctttagcctctttatgagtaccctgatggaggaaggcccaggaagcggtagccttcctggtttgtgacgcacggtgtgcattgcgtattagattaacatcagaatggccctgaaggctggaacatcttatctgtgtttgagagttatggaaactctgatcctccatgagaataatttttccaaggtctcagatctctaaagcagtagatcttggatctgaacattgctatttctgaccttaaagcccatgcatttcccacaacatatgaaccatgataaggtgtattttaaagttcatcttttctgttttttgtgaaagtcttttagagatctcagctcatcacaaagtttccggttcagtctcgtgggtttcatgtactcagccagcatttacttgccagtcaaggtctaggatggctacctgtcctctgcaggagccccaagcctattcattaatttcatttacaattttatagtcataattatttctttgtataatagcattctgagattttccaaaatttcccactgtttttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaaaaaagcatccagcttacaacggaacctggagggttggtaaaggccccctgcgctggccccgccccatgggaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcaggtagggcgccgtgcgggcgcgatcgccggcgcgggccggggtccccggtgggtggcgcctggctctctgggccgagtctctggttccagtgccttctgcgcgccgggcccacaccccggaggcctgcctctcgcccccctcttctggggtgctctcgcggctccgtctcgctgctcggtggcgtcgctgcctcccttccgtcgcaccgcagagttcctttccgcatcacccactcccggcgggaatcggggaccctggacgcccagctccctttcccagcgcttcccgtgccctgaggaaagccgggactttgctgctgcttgttctccgtgtgatttgtctgggatctgacctttgctctgcccgaaactggcagtgaccttcgcgacaggcttccctcctgctgtcctggcctgacacacctgccagctgtttttttcagggccttgccctgctttgagaggacacccaggtcccaggtctttgtcagggggtgtccaggtagaatacacccagcccataccctctgctgccctgtaggccctttgctagttgctcaagtgttgaaagcccctgcgttgaagtaatctgccgggacttgaaacttggctttggcactgattgtctgacgtgcctaacttggtcagtccttaggaacccagtttctccatttgcaagttggatataataacagtgtagacctcctatggttaattgaagaatcaatgagttaatacagcgatacaggtagtcttgtgcctagcacgtaatgagggctcagtagatgccacttggtagcagcagcagcagcagcagcagcagcagcagcagcttcttaggttcacaatgttaagagagttttgtattaaatattgaaagaaatgtgacaatttatcccaaatgtgttgaagttttaggttcttgggcatatttgtttttcaaagacactccttagatatactagagatacaatttacacataatttttaccaacatggtggcgatttatataatgcagatctctcgacagctctttgaccgcatgatgtagggtagcaggaatcgagaactagagggagagtgtgttggatttgtacgctgctttgtctagtttctttttgaggtctctgagagcagggtctaagactttcagtcatcttttccccactaatcccgttatctagtgggtgctccatacatttttgttgtgtgaactttgggggaaatcagggagaaggcaagccagatttatttgttcctgtttcctctgcacttccccccctgtctttgaccagtgtgggtaccttgctttctgttatacaatggatgagttttggacaactgaatcaattgggacagatattgaacatgcttgtgtaactggtataagggaacatgaatgtttttgtagtaattgggagttatctttctcagatttgttttttggatttggatatgtcaggttgttttaaaggggagcacgtctatttcctcataatcctgctgccctctttattggcacaatttctattcatggtcttatcattcctcttacagactttggagctacaactggattttccagttcttactgtgttaatgagacttgtgctgtaactaccgtaactactaatcacatgtggctattgaagtttaacataattaaaggtaaataaaattaaagattcaatctcgtagttacactagccacatttcgagttctcagtagccacatgtggctagtggctactgtattggacattgcaagtatgtgtagaacatctttgttatggcacaaagttcttatagacagacagagcagttctagaaactgtagttctgtctttgaagtttaacaactcgataagctatcagtaattgagagtcagaaaaactccttttactctaaaataccgtgacacaagggggtttgcagtgattcaggtagcaaagatctttcacgtgtattgtttcgtatgactcttaagacaattctatgaggtagggagggtagataaatgggaataaaaatttcatattaagtagctggcaaaactaggactagaactcaagaagtttttgcggattttaaaaaaattttaaatttctatttatttttaaaatttcagtagttttgggggcacaggtggtgtttggttaatgggttagttctttagtggtgattttggaggtgttggtgtactcttcacctgagtgcagtggtgccatcatggctcactgcagcctacacctcccaggttcaagcgattctcgtgcctcagccacccgaatatctgggattacaggcgcgtgccaccacactcggctaagttttgtagttttagtagagatgagatttcactatgttgaccagcctggtctggaacccctggcctcaagtaatctgcctgcttcagcctcccaaagtattgggattacaggcgtgagtgaccactcccagcatagggtctacatcttctgactcttaggttccatactctttcaacttaagaattacatttttctttcgtttccgcctcctctcctcttctttggtaaacctgttaatactcttacttggcagttttttgtagggctgtttacctttaatacagaccaacaggttgggcttcttagcaaaagggcttggtctttaaataacagttattaatcagtgtgtgttgaattctactatgtgttacgtattttgcatacattgtcagaactataagattaatgttgtccaattttatagaagaggaggctgatgtaagagatttcgaattcctttgctgtaagcttagctctagagtgcttcagaagaacagcaacgctgaaacctctggctttcagtagtgtgtataaatgatggaattctttctaatgtgcttcctgtagctttagctaccaggcattcgttgatgtcaaatctctagacttctctgctgggctcagacccatacccatattgccatctggtgtttggacattctcatctggctttttcattattaaattcagcaggtctaagcttcaacttatttctgtcttccccaaagttcctttggttcctgtcttaaacctaggttaaatggtaccacctaattgtgtgagctggaaatcccaatgtttttctttccgcttttcagtttatcttatgtagatggtcactaaaaccttttggtctacctcctggatgtctgttaagtcactgcattctctgtccctgattagtttatgctgttttgataacctccaaagtggcctccctgcctctagggtattttcattctcagccattgtactttgaaaaaaatggcagttattcatgttgaaaattatgaataatatgtgggaatactagttttaaagcatgttttggctgtgaaaagaagttggagagcgcaggcccttttgaggaacattctggtacacacacacacacccttttgatgagttttaatgaatagaatcctgttttttttcccagtgttataatattagggagggcattatcccagtggggcttcagttgcctcatttgtgaaatgggatcactggacttgataactttcgagatagttatggctctgaaattatttaattctgagttttacttaaagatttgtttgatgggctattgccatctactggtagtaataagaataacaactcattattttaagttgaagagaatcttttcaagtgtgaggtaaaaattaaaatgaccaatggtggaggaataaggatctagtttttagtataatggcttctcaaattttggagggatgtttgtgagaagtgaaggaaatttaagtcagctagctgatagttaacatactatcttaaaaaaacatgtaaggaggtatttatcttacagattcaaacaaataaactttttctagtccctttgatttgtaagtatacaatgtggactgaaatgagatgtcaaatacgcagaaaactactaaacaacatctctcagcagtagtattctatgtagcactggaaaagcaatcgccctattgatttttttttttttttttttggagacagagtttcactctgccacccgggctggagtgcagtggtttgatctcggctcactgcaacctctgccttccgggttcaagcgattctcctgcctcagcctcccgagtagctgggattacaggcatgtaccaccatgcctaatttttgtatttttagtagagacggggtttcaccatgttggccaggctggtcttgaacttctgacctcaggtaatccgcccgccttggcctcccaaagtgttggaattacaggcgtgagtcaccatgctcggccatgatttgctttttagaagctcactacaaccctggtctagtcttttatggacacattcatgtttttcagagagctgtgtgatgactttttttgtttttttttttttttttttttttgagacagggccttgagctgttgcccaggttagagtgcaatggtgtaatcacggctcactgcagccctgaacttctgggatcgggtgatccacctcagccccatgagtagctggtactatgggcaaataccaccatgccttttatttttcatacacctacaaccatctcatttttatttttattttttgtagcaatagggtctctctgtgttgctcaggctggtctcaaactcctgggctcaagcagtcccctgcctcggcctcccaaagtgctaggagtacaggtatgagccaccacacttggccttttcttttttaaatgacagggtcttgctgtgttgcccaggctggagtgcagtggtgcaatcatatcccattgcagcctcttcctcctcctgggctcaagggatcctcccgtttcagcctcccaattagctgggactacagatcacatcaccacacctggctaattattttattttttgtaaagatgggatcttgccatgttgcccaggctggtctcaaacttctggcgtcaaacaatcttcccacttcagcttctcgaagtactggggttacaggtgcaagctactgcactggcttgtatgagagtaaaatagagttcatgagtgataataattgccaaatgttttataactgtgactattagggagacatatactgaggccaccaggtggcgttgaccaggtagtcattgccatttcctgtaaggtagtagagcttattacctggtaggtgggtagatatatatgcctttgatttccaaataagctttggaaagaaaagaaaataccttcggctaggcatggtggctcaggcctgtaatctcagagttttaggaggccaagttgagaagatggcttgaggccaggaatttgagaccagcttgagcaacatggtggcaccccgtcactacaaaaaataaaaataaaaaaaattagccaggcgtggtgctgggcacctgtattcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttggtgattctctgctagatgttgtggttgaaaataatctagatattgatggctttggtgagtatgaaacatttcttaaaatgcataagtgaaactgttaggtttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgatacaaagccgacggtagggagtagagttaaaagataccaggttagagagaataaatgtcatagcacagaggggtacttaaatatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgtatatgacctgtcagttttgttcaagcaatgcatgtttagattagcagttctcagagggtttccttgaccgttagcattagtgtcacctgggaaatgcagattctcagacactcctccccacccaccgcccccacccccgccccagacttactgagtcacaaagtctggggtaggtccagcattgcatgttgtaacagctgtctgtgtgattttgatgcatgttcaagtttgagaaccactggtctggaataaggttcaaggagcgtatctgactctgcttctttcaaggcactgttcacattatcctttaaagaaccatttctagatcagaattaatttatctctcttctgttttcccatgatatattaaatctacctctctttgttaatgcttataacagttttcctttttagagagaatggctatctttcttattagattattagtttttgaaagactgtactccatgaggttacctgagtcacctcatggagtaggctttgtccagagttggcactcaataatatttgctgaatatctttttaaaaattttttgagacaggatcttgctctgtcacccaggctgaagtgcggtcgtgcaatcacagttcactgcagcctcgacctcctggactcaagtgatcctcctgactccgcctcctgagtagctgggactgcaggtgcaccatcacacctggctgaattttgtattttttgtagagacagtgttttgccacattgcccagcctggtcttgaactcctgggctcaagagatcttcctgccttggcctcccaaagtgctggcattacaggcgtgagccaccatgcccagccttgaatactgaatctaagtattttttgctagttttaaaataattataacaactagaatttgagtgtatactatattctagcatatgttaaatgaagtagattttttttttaactctccatttgatagttgaagaaacttgagtctcatggaaattaagtttccctggttatacatgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtcttcttttgagaggtgtctgttcatgtctttttattttccaacttttatttagattcagggagtacatgtgcaggtttgttaaatggatgtatcatgtgatgctgaagtctggagtatgagtgatcctgtcacctaggcagtaggcttagaaaccaataggtagttttcctccttgcccctctcccttccccctctggtagtgcccagtatctactgttcccaactttatgtccatgggacccagtatttagcttgcacttataagtgagaacactttgcttttctggttctgtgttaatttactcgggataatggccttgagctgtatccatgttgctggaaaggacatagttttattctttttatggctgcatattccgtggtatatgtgtattacattttctttatccaatccaccattgacaggcacccagactgattccatatgtttgctattatgaatagtgctgaggtaaacatacgagagcatgtgtcttttggtagaattatttgttttctcttgggtatgtacccagtactgggattgcttggttgaatggtagttccatttttagttctttgagaaatctccaaactgctttccacagcagcttaactaatttacattcccaccaggactgtcttaagtgtttccttttctccgcagccttgccaacatctgtaattttttgactttttaatgatattctttatgactggtgcaagatggtatctcattgtggttttgatttgcagagtggagtattttttcatgtttcatgtttgttgaccacttgtatgtcttcttttttaaatatttatttatttatttttgacacaaagtctcactgtcacccaggctggagtgcagtggcgcagtctgggctcactgcaaccttcgcctcccaagttcaagcgattctcctgcctcagtctcctgagtagctggaattataaaggtgtgccaccacggctagcaaatttttatatttttagtagttttatatttttataattttatgattattttcaaattttatatttttagttttgccgcattgaccaggctggtcttgaattcctgacctcaagtgatctgcctacttcggcctcccaaagtgctgggattacaggcgtgagccaccatgcctgacttctgcccgctttttaatgaagttatttgttttttgcttgttgatctgtttaagttccctattgattctggatattagacctttgttggattcatagtttgtgaatattttctctcattctgtagggtgtttactttgtttttttgtttgttttttgagacggagtcttgttctgtcgcccaggctagagtgcaatgatgtgatctcggcttgctgattcacctccacctcctgggttcaagtgattctcctgcctcagcctcttgagtagctgggattacaggcactcactaccacgcccagctaatttttgtatttttagtagagatagggtttcaccatgttggccaggctggtctggaactcctgatctcaaatgatctgcccaccttggcctgccaagtactgggattacaggtgtcagccaccatgcctgctctgcccacttccccccaaccccgagacggagcctcactctgttgtccaggttggagtgcagtgctactgtcttagctcactgcacccttcacctcctgggttaaagcaattctcctacctcagcttcccgagtacctgggattacaggtgcatgctaccatgcccggctaatttttttgtatttttagtagagatggggtttcccatgttggccaggctagtctcgaactcctgacctcatgatctgcccgatttggcctcccaaagtgctgggattacaggtgtgagccaccacacccggccctctgcccactttttaatgaggttatttgttttttgcttgttgatctgtttaagttccctatagattctggatattagacctttgttggatgcatagattgtgaatattttttctcattttctagggtgtttactttgttgatagtttctttaatgtgtcgaagctctttaatcaggtcccatttgtcaatttttgtttttgttgcaattgattttgaggacttagtcataaaaattctttgccgaggccaatttccaggagagcatttctgaggttttcttctaggacttttgtagctttagatcttacatttaagtctttaatctattttgagttaaattttgtatacagtgataggtaggggtctagtttcatttttctgcatataatagccatcaatcccagcactgtttactgaatagggagttctttcctcattgcttatttttgttgactttgtgaaagatcagattttctagatgtatggctttatttttcgggtctctattctgttcctttggtctgtgtgtctaggttttctaggttgtgtgcataggggtgctgataatagtctctaggatctttgtatctttatgggattggttgtaatgccatctttgtcatttctaattattcttatttggatcatctctttttttttctttgttaatctagctagtggtctatccattttgtttattctttcagaaaagcaacttttggttttgttgatcctttgtatagatttttgggtctcgattttgttcagttctgctttgagtttgttatttcttctgctagctttgggttttttgtttttcaagttcttctaggttaattttagattgttaatttgagatctttctaactcctcaatataggcggtcagtgctctaaacttcatcttagcactacttttgctgcatcccagagattttggtatctgtgtctctgcttttatttatttcaaagaattttttgatttctgccatatggtggagccactttagctggtagaaatattttctgatctttgacagaatgggtaaaccatgctattgtttgtgtgcattggaagttgtggctgttgtgctgttgaaaaaatttaaatcttaatatctcataacagtgttaactaaactttcatttagtgatggtgtggtactgaaatatgtcccaaatcaataacattggaatggatgctaaacatgatctaacacaaaaaaaggctaaacaatcagcctgacgtttggtgctgttaatttaggtgtagatactgtaaagacaaaagtacttagaaaataggattttaaaaagacattacggtaggaatatttttaagctcacaaaaaaatcacttggtgaagggtaatggaaaacaatactggtggtctggctgtgtccacacccaaatctcatcttgaattcccacctgttataggagggacccagtgggaggtaattgaatcctgggggcaggtctttcttatgctgttcttgtgacagtgaataaatctcacaagatctgacaattttataagagggagtttccctgcacaagctctctgcatgcctgctgccatccatgtaagatatgacttgcttcttcttgccttctgccagtattgtgaggcttcctcagccacatggaactgtaagtccattaaacactttttcctgtataaattacccagtttcggatatgtctttgtcagcagtgtgaaaatggactaataaagcaaattggtacgaggagtagggtgctgctgaaaagataccccaaatgtggaagcaactttggaaccaggtaacaggcagacattggaacagtttggagggctcaggagaagataggaaaatatgggaaagtttggaactccctagagacttgtggaatggctttggccaaaatgctgataacgatatggacaatgaaattcaggctgaggtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaatgtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagtccctattggggcaccgcctagtggagctgtgcgaagagggccactgccctccaaacctcagaatggtagatccactgacagcttgcatgatatgcctggaaaagccacagacactcaatgccagcccatgaaagcagccaggagggaggctgtatcctgcaaagccacaggggtggagctgcccaagaccatgggaacccagctcttgcatcagtgtgacctggatgtgagacatgtagtcaaaggagatcattttggagctttaagatttgactgccctgctggattttggacttgcatggggtctgtagcccctttgttttgaccgatttctcccatttggaatagctatatttacccaatgcctgtacccccattgtatctaggaagtaactaacttgcttttgattttacaggctcataggcagaagggacttgccttatcttggatgagactttggactgtggacttttgaattaatgctgaaaagagttaagactgttggaaaggcatgattggttttgaaatgtgaggacatgagatttgggagggaccaggggcagaatgatatggtctagccatgtcccctcctatccagacctcatcttgaattcccacgggttgtgggagggacccagtggtaggtaattgaatcttgggggcaggtctttcccatgctgttctcctgacagtgaataagactcacaatatctgacagttttataaggggaggggggttccctgcacaagctctctgcctgacgccatccatgtaagatgtgacttgttcctcgttgccttctgccaggattgtgaggcttccccagccattgtggaactgtaagttcattaaaccctttttcctgtataaattacccagtttcaggtatgtctttatcagcagcatgaaaatggactaatacaattggttacatagttgaagacacaaaactgtggcagtgtacctcagtctgcaatggctgatgtttatgggtgctgaaaattcatctttacccctgccctgccccgctaccttttttttttctgtaggaaaatgtctcaagttttaaattatgtaaagctttcagcactagcatcttttgtataaaaaaagatgattggatttagattatcttccctccccaccacatcatttaacatgccgtctgttgttttttgacttaataatatcctttttttttttttttttttgagacgtagttttgctctttttgcccaggctggaatgcaatggcacgatctcggctcattgcaacctctgcctccctggttcaagtgattctcctgccttagcctcctgagtagctgggattacaggtgtctaccaccacgcccacctaatttttaaaatatttttagcagagacggggtttcaccatgttgggcaggctggtttcgaactcctgacctcaagtgatccgcctgccttggcctcccaaagtgctagaattacaggtgtgagccactacgccttggccaacagctaatgccctttctgattggtgtgagatggtatctcattgtggttttgatttgcatttctctgatgattagtgatgtggagcatttttttcatgtttgttggctgcttgtatggctttttttgagaagtgtctgttcatgtcctttgcctatttttttaatgaggttgttttttgcttattgatttaagttccctatagattctggatattagacctttgttagatgcatagttggtgaatattttctcccactctgtaggttgtctgtttactttgttgatagttttttttgctgtctagaagctctttgtttaattagatcccacttaccaatttttgcttttgttgcaattgcttttggagacttagccaaaaatcctttgccaatccaatgtctagaagagtatttccttgattgtcttttttatagtttgaggtcttaaatttaaatctttgatccattttgggttaatttttgtgtatggtgaaaggtagggagtccaagttcagacttctgcctatggctagccaggcatcccagcaccattattgaatacggagtctcttaaaaagagtaagtgctgtccgggcgcgttggctcatgcctgtaatcctggcactttgggaggccaaggcaggcagatcacttgaggtcaggagtttgagactagcctggccaacatggtgaagccccatctctactaaaaatacaaaaattagccaggtgtggtggcatacacctgtagtcccagctacttgggaggctgaggcaccagaatcacttgaatctgggaggcggaggttgcagtgagctgagattgtgcctctgtactccaccctgggtgactgagcaagactgtctcaaaaaaaaaagaaaatatatgtgtgtgtgtgtgtgtgtatatatatatatatatatatatatatatatatacacatatatatatatatatacgtatatatatatatatacgtatatatatatatatatatacacgtatatatatatatatatatttgcagaacaacctctgagctgcctcactctgggcacactgcctatgggatagctgtgctccacaaggagtcctacttctgctgctgctgtatgctgctgcttcaatgaaagttgctatttaacacgaccgacccgccctgaatcgtttcctgggcaaagctaagaaccttcctgggctaagccccaattttggggcctgtctaccctgcatcaattctatatgaattttagaatagtttttttataattctgtgaaaaatgatgttggtagtttgataggaatagtgttgaatctgtaaattgctttgggcagtattatttgcttatttttctgatgaggtattgtttatttttataggttagcaaaagctctttaaatgtcctatttgataaaaattgtgaagatgaaaattttaaacatttatttaaatggcttccaactgctattttacatgaagttacatattctcaaaatagtgtaaaatgctttttgcataaataatttgtgtggattgctttatattaatttcttctaaattaaaacataagtattatgatcttaatacttgaaagtattcttttaagtttttaaaagtatttttttcttcatcacttgtgactatatattacagtacagttttttttaaaccgcaggtgacaactattacaaggtcatgaaatcaatttagtcactcccaactagcattttaaagaaatcaaaaagaacatataaaaacatatcatcttttgcaagggtattatcttaggaaatgtttatttagctattttacaagtatatatgtactgggtcatgatgtaaaatgaaattcgtactgtgagtcacagttaaataaagttttttctgaaagtcattggttggaatggaagaatgtcctgcctgggcttctttcccagctgtatccctttttcagctttgtgaccttgggttgggtatctaacctactcataactcatcttttcatctgtaaagcagggataatattaatatctacctcataaagttgctgtaaagatcaaatgagtaaatccaagcaagtcctaaataaatattagctaatattgttaacataggtattaatacagattcattgttcattatagcaaattttaaaaatacatttaaaaagaatttaacacttcatatcatcacacagagataagcactgaaataatcttttttccgaatacccaagaaatatagaaaatttaatgtaaatttaaaaattctgctggtatcatagaaattcgcgtattcagactcagaagaaaagctttaaagatcaagtatcctgacatgtccacaaatctttgtatttaaagataagcttgagataagtaagctaaactagattcaccaaagacagagttaagcctaagcttctttctagaataaagatgagagaaatgaaatcaggaagggtgcaatgttatcattataaagaagagcttattaccacaacattatgggggcagctgtttcattaattcctaaggctgaatgcaggagcccatctaaacactgcatttgtcataagtcatacagatgaacaccgtactccaaacatggctgaccgaagtacttagtttctttacagtttctccctgggtgatctcatccgttctgtgaccttaaatcctttctagatattgataaactcttaaatttacatccttagctcagacctctcctctgagccctgatttacagatctaacttcttgctttacatcacttcttggaaatctaacatatttaaaacagcttttgccttttttcctcctgatgaaacctgtccttcctcgagtctttcctacctcagtaatgagcaccacccggctgctcgaacctgaaaccgtagagcaccattccttcctctttcttcccaacctgacatccagtccatcggcacctcctgccagttgtgcccccaagattcgcctccagcatgtcctgttggctccatccctacagtcggcacgaggggctggccagccactgggcgcctggagctgtgctaacctgcttctgctctggagtttaacagccaggtaatttgtcctaacagaaatcagacatgtcagtcccctgattaaaagccatgagtgggccaggcacagtggctgacgcctgtaatccctgcactttgggaggcctaggtgggcagatcacaaggtcacgagtttgagaccagcctgggcaacatggtgaaaacccgtctctactaaaaatacaaaaattagccaggtgtggtggcgtgcacctgtaatttcagctacttggggaggccaaggcaggagaattgctttaacccaggagtcagaggttgcagtgagctgagattgcaccattgcactccagcctgggttacagactaagactccatcttggaaaaaaaaaaaaaaaaccgagatgggcggatcacgaggtcaagagattgagaccatcctggccaacataatgaaaccccgtctctactaaaaatacaaaaaaaaaaaaaaaaaaaaaaaaaaaaaacccagctgggcatggtggtgcatgcctgtaatcccagctacttgggaggctgaggcaggagaattcctcgaaccagggagtcggaggttgcagtgagccgagattgcaccactgtactccagtctggcagcaaagtgagactccttcaaacaaacaaacaaaaaaccatgagtgtcttcctttgcacataggataaaatctgtattcccagccgtaaaaggctctgcattatctggccccatctgccactcttcctcttttttgtttttttctcattgttctttgtctcactttggtgatactggccttttctcaagagcttgaactcacccaaaattcctacctttgagactttgtatatactttaccctctccctgagacacatccctctctctcccatccccaaaatttagcttttcatctatcaaatctcaatttatgtacttccttagcgaggctttgcccagccacccagtccaaagtagtggttctcctgttaccctgaacccattattctctttctcagcatcttgttcacttgttttatagtatttgtcacagtttagtaattatgtatttcttgtgtatctttcccaatagactgcgatgagggataaagtcattcctgtttaattcctcattgtatacgaaatgaagtaataagtgaacacatgaataaaaagggacagtcataaattttggaaacagttcaaacttataaacattctcattgccaacttttatattaatatagatcttttggatgatgcaggtacctgttttcagagtgtatcataatattctgtcactagggggcagttacacacctgagattcaacttacctagtttactctcaagacatttttttcttcaatattacctgttttcttcatgtgtctgttttgagggaaattatacaaattggaagatcctgattgtgtttgtataagtttatttgtattcccctcatgcttgagtccctattgatataatgtatttctgactatgctagatcaatctttaatctagaaaattagattttatatttacacataatttccatttctaatatataatattcccacacagccatcctctagatttttgtttgggaaaggggttaggtgtcggggcaggcaattgtattgtcagcatcgtagtagataatacaaaatgatcttaatatgagatgcacacacacaaaatgtcttttcccgttggcaaacactcaagttacatgaaaggaaaggagcagagcagtctgcagagatctgactttctctaggaattaatttcacagctacaacttctgaggatttgcccaagtacttactatcattattcctgttttaaaaaaacaaaacttggttcatgagttcaccaaccttgaaattagtaagcatgctttactattcttcatgtcattttatatgcatatatttgaaattgtgcagattaacagtattgagattcttactctagcaaaatcagaagcattgcagaaaccaaaactgttgtcaggaatcctgtaattttaagctggcaggctgtgtgagttgtaaattttacatttgttactgcagctaaagatggaccattttagctaataaacaaatccctgccatcctttgtcagcaccatgtgaaccatgctgtttatagacatctgaatatctgtatgattttcttgactatggtgatgatattttaaactgtggttataatttaaaatcatttttaaagcctgtatcagtttcagccaagcattaagtgctaatactgaaaaatgtatctgaaaatgagttattttggaatagaggttagatataacaaaatgttaggaagaaagccaaaaacctgtcatgatacatactactgttaatttaggagaaagcactctgaattgttagccagtatgtaaacaaaatcaaagcagtactaaaatgtatatacttttaagttcatgaaaattgttgtataaccaagccaggatggtggctaaaatgctagcaccaggggctaatatcagtgttgctgtaaggtgttcctaaatcaggttattatctgtgctaaggcatgaagtatgttattattattaattttaattgacagatcataattgtatttatggggtaggtacagtgtgatgttttgatacatgtatacaatgtggaatgattaacttaagctaataaacatatccttcacctcacttattttttgtgatgagacatctgaaatttactgttagtaacttttgaaatacacaatacattattattaactgcagtcaccatgctgttgctatagattttttaaaattaattttttataatattttgagacagagtcttactctgtcactcaggctggagtgcagtggcatgatgttggctcactgcagcctccacctcctgggttgaagtgattcttgtgtctcagccttcctaatagctgggattataggtgagcaccaccacacccagctaatttttgtatttttagtaaagatggggtttcaccatgttggccaggctggtctcgaatacctgacctcaaacagtttgcctgcctcggcctcccaaagtactgggattacaggcatgagccactgtgctcggcctgtgctagagatcttaaacacaaattcctcctaactgaaactttgtagcctttgaacagcacatgctcatttcatttccttacccccactcccatctgctggtaactaccgttgtattttctaaggcagtggcccccaacctttttggcactagggactggttttgtggaagacaaattttccatgggcaaggttggggtggggatggatttgggatgattcaagtgcattacatttattgtgcactttatttctattattattacactgtatcatataatgaaataattatacaactcatcataaggtagaatcagtgggaagccctgagtttgttttcctgcaactagatctaggtcccatctggaggtgatgggagacagtaacagatcatcaggcattagattctcataaggagggtgcaccctagatcccccacatgcacagttcacagtagggttctcatcctatgagaatctaatgcagctgctgatctgacagaggtggagctcagacggtaatgtgagcaatggggagcagttgtaaatacagatgaagcttccctcacttgccctctgctcacctgctgtgtggcctgtggctcgggactgctgtaagacatgatgtatttttggttatttgaaaggtggacatagtaatgaaaagaattttacatcaaacatttgttctacttaagtatattttaaaacaaaaatgtttgaggattttagatttttaaactttaggaatccacttttctattttgtttctttgagaaaataattcttgaaatatgagacttgtacaatttccaaaatctttgagaatgcatttctcataaaacatcactttgtgtttacatatatgtgtatatccatgtatatatatacatgtacatacatgtatacacatagacatacacattttccctgttcatttacttttatatagccaaccacttataaagacactaaaagctgacagccaccaatattactctggggctgtgtatataataagttatataacttttgcacctcattccttcatatacatcatatattagtatacccatattgtgatcagctgcaagttttagccttgtagttgttgtttgttacttttatatcctttattcttttatagttttataggttatcttccactgtttattttgtagggttctctgtgtatatgaaaagccaaaaaaaaaaaagctccccattttgtgaatagcttttgtttccataatctattttcaggtcagctgcttgttatttggaatttgttttcccataaaaaataatgttggctaaatttttgagccaacacacagaacctatttcttcacaactgacttaatcaccatttatagcttgttttttgggataaaatgcattgcaccttctaactcttgtaattgtagctgctgctgcttttcttctacttttttaaagagacagggtctcatgccagtcagaatggtgattattaaaaagtcaagaaacaacagatgtggtgaggttacagagaaatatgaacacttttacactgttggtgggaatgaaaattagttcaaccattgtggaagacagtgtggtgattcctccaagatttagaactggaaatacaatttgacccagcaatctcattactgggtatatacccaaaggaatataaatcattctgttataaaaatacgtgcatgtatatgttcattgtagcactattcacaatagcaaagacatagaatcaacccaaatgccaatcaatgataggctggataaagaaaatgtacatatacaccatggaatactgtgcagccgtagaaggaacaagatcatgtcctttgcagggacatggatggagctggaagccattatcctcagcaaactaatgcaggaacagaaaaccaaataccacatgttctcacttacgtataccacattttctttatctctttatcacttgagagatatttgggttgtttccacctcttggcaatggccaattggtttttgacaaaggtgcaaagcaattagtgaagaaagggtattcttttcaacaaatgatgttgaatcaattggatattcatgtgggaaaaaaaaggtgcatcaacctaaacctcacatcttataaaaacatgaatgcaaaattgacttagatctaaatgtagaacttagaactgtaaactcctaaaagaaagaacaagaaaaaatctttaggacctgtgggtaggtaggcagagaattcttagacatgactggaaaagaatttatatataaattcttatatataagaaaaataaattagagttcatcaaaattaaaaacttttgttcttccaaagacactgttaagggactgaaaagccaaactacagactgggagaaaatacttgtaaatcacatatccagtgaaaggacttgtatcccggctatgtaaaaagctctccaaacttaacagtaagaaaacaacacaattaaaaaaatgggcaaaagatatgaacagacacttcaccaaggagaatttagagatggcaaataagctcataaaaagattgaggggcatctggacctgaacttgtatgtgtgaatgagtttgtgttgtttagagtttctcctagaggcacaagagactaatggtgatgtcatactcccaagtggctttgggaaaaaaatgaggcaaagttaaaaaaaaaaaaagatattttacacctttaatttcttggagaaaatgtgaatgaaagtcacaatgtgacaccaccagatacctactagaaacaaaccatgggacattcaaacagtggaatgcttcttagcaatgaaagggagcaaactatagatacatgcaacacattggatgaatctcaaaggcattgtgttgagtgaaagaagccagtttcagtcaaacactgtatgattctatttatatgaacattctggaaaagactaaaccacagtgatagagaacagatcagtggttaccaggggttagggatgaggtagactgtgacaacaaagcaacagcaaaagggaattaaaagttttaggctgaggaagctgctctgtaccctcagtgtggtggtggttacacaagtctatacatacattaaaactcatagaactggccaggtgcggtggctcacgcctgtaacctcagcactttgggaggctgaggcaggcagatcacctgaggtcaggagtttgagaccagcctggacaacatggtgaaaccccgtctctgctaaaaatacaaaaattagccaggcatggtggctcatgcctgtaatctcagctactccaggaggctgaggcaggagaatcacttgaacccgggaggcggaggttgccgtgagccgagatcgcaccattacactccagtccaggcaacaagagtaagactgtctgaaaaaacaaacaaacacaacaaaacaaaaagcctcatagaactgaacactgaaagagacaactagtaattggaggacatagctctcatgaaattggcaatattttatgagataaagaaaacagaaaaggagtaactttttttttttttcttaaatagcctcttgttcttcttacagttttaggctcttttttatacccaaatatttaccttatttttgcaggtttttttttttcctcctaaataccctttttggttaggtgtctccaatattctctaaaattctttaatttttaataaaccgtataggttaaatctcaaaacaaactctagaaaactactcatctgtcttcttatggatttttgaaagattgaaagtttctttttacttttctattttttaaatttttctttgagccctgaccatggcaaggacagaatagttcataagtgctatccatagggtcttggaaacccttggtacagatcgtttctgtagtgatagttgttctaacacagtctgaccgttagctttctctggtttagtgttagctctctcacataggctggtttcattctgagtcttatagtttctattatatttgaacttcttcctagtacaaagaataacaaaggataaattgttggcaagtttttttggcagaaaaggttcgaaaaggaccataaaatagtgagggatcatgaatgtgatgtgttcatttaaagaataaatacgggactagaatgtataatgggaacttagtgtgtaggcaccaaaagttaatctgaaaatattcagcatttttcaaattcttattagaatagtctcttcagcgctgagcttagcaacttaagcaagatgtggaaataattgccaaggttcctgagaagagccatgaaaatttaaataagagaatagaataatacctttaagagaaggttaaaagaactgaagcttcctagggaagagggggagaatttgaagcctatgaacagctagaacaggttggtaactcttcctttcgactggctactggtacaaaaagcaatgtcctttgtttttcaggagggatttgttggcatatgagccttttatctccatttaatgtataagtaaggcaacttacattattgtatggcggtacaataattattagttgcctacagcattgggaaacttaagtcaaagtcataactcatctctaactagtggtatgaccttagtccatttctttaacttctggggcttaattcttaattcctcttatgtttacaaataaagttgaattactctaagagtttctgtaactttggataataataataatgtttaccaacacttacatagtacatactatctgccagtcatggttgccagtatatatattcatatatattaagtatacagtcatgtgtaattcttggaactactatgtgaggttagtatagttactcttgaggaaactgagacatggaaggtaaagtagcccaaggtgacagggttagtaaaaaggaaagctgtggttgaagggaggaagtctggctaacagcccatgcccctaactctgaacttcactatatggtctccctctcccataattctactgttgctttgaattggatttaataaaaatgaagatttagagaaacttcacgatggtgtttttttgtttttgttttgttttgttttgagatggagtctcactctgtcgcccaggctggagtgcagtggggcaatctcggctcactgcatcctctgcttcccaggttcaagtgattcttctgcctcagcctcccgagtagctgggattacaggtgtgcaccactacacccagctagtttttgtatttttagtagagacagggtttcactacgttagccaggctggtctcgaacctcacgtgatccatctgcctcggcctcccgaagtgctgggattacaggtgtgagccaccgtgcccggcctgttttttttttccttacggtaaaatataaataataaatgcttaaattataaggaaggaacaactctagttaaaatgatccattcagaggaaaattaagaaggttactagttgttaacagtggttgtgtatatttcatataatatttagtgaccaaaagagaatataaatcaaactgaagttactctgaggactctatattctttgaaattgtacagtggctttaaaaaaactgtaaaaacaaacccgaatcactgtttttaaagtcagatttaagcagactgtgattctgcacgcctctgttgtcaggtcctcccctgggatactaatgtgttctggatgccatattttaagaaaagcccaactggcctgagggatgggatttagaactgtgttatgtaagaaacagtggaaggacctagtggaaggacctggggatgctcagctgggagaaggaagaatgatctcaaataaatgaaaagctatcctttagaaggattaaactccatgggatagcgttggaccagtaggtgctagttacagagtggcagactttagcttggtagaagccagccgaatgcaaaattggctgacttatgtggtgtcggtttctttgtcaggagattttcaagtgaaggctgagtaataccaggaaagggatgttacagagcagattcgtcctggtttagttggacaaggtggtgttttagttctctcatcacagtgtctggcgtacgatatgtattcagtaaaccactgttaaattaatgacttaaaaaatggaacaggataaatattctgattatttaagaccatagtgacttattttaaaatgacttgattctgtccaaattacaaggagagattgagagggaagaacatttaacttaatttagctataggtttgattgctttctagttcctcttatataccataactttcatcgctattatgtcagtaattactatgtaagtttaaaattgcacaaatttttatatgtatgcatgtctcagcttattaacttgtaagctctctattaggactatattttcataggtattccttcacagcaccaagccagaacctttgtgaaataatataacgtgagggatttcaaactcatgcgtgtgtgtgcatgcgtgtgcatgtggcaggagatggaggcttgttgcccctgttctgttcattttcacctttcatttatgtattctttttttttttttttttttttttgagacagagtcttactctgtcaccccggctagagtgtaacctcagctcactgtaacctccgcctcccgggttcaagtatttcttctgcctcagcttccctagtagctgggactacaagtgtgtgccaccatgcctggctaatttttgtcttaattttagtaaagacgggatttcactatattggccatgctggtcacgaactctgacctcaagtgatctgcctgctttggcctcctaaagtgctgggattacaggtgtgagccactgtgcccggcctcacttatgtattctaatgctgattctaacatttagaagcctttactgaaccaggtatgaatcgtctgatgtagaagggactatgttcagtgtttgttgcttttgtcaggtgcatgtgagggaaccctggcttgttcaacctgtcacctcatctttgaagatcacatatatgagaagttagatgcaatcactgatgaggagaatgacatgctcgatctggcatatggactaacagacaggtaagatttttggactgcttcaattgtaataataatctgggaacatagatgttgtattatgttgtctatgtaagaccagacccataaatgtaatagtgttctaccaggttaaataacagtcacagattttgagtatcagatatgtggcatttctctttgttttcactgttctacagtttagaccttatgaaattttacaaaagtaaaaaaaattaattggaagtataagttctagatcctaacacctcttctttagtctctttttactccaggaactaatatgtatcacaactgaatggaggggttaaatctaatgcttttatatttgataattgaacacaattataatggaaagtttcacctattagaacagaatttttaaagaaacttaatatataatagtaattatgttaaaatgaatagctctttttctaagtgtaccttaaagtaatcagagcttattcttgttattaattaatagttactcttaaaagtggtgagatttacagtagcaagtgacatcaagtgatatcttattttttaaaaaaattatctagtcttttgattggagtcaatgaaggtagctagctgatatactatttcaaggggtaagataatgagggcatattacttaattaaggttggctttgtttaactctagtttggtgaccttaatgacaaataattttttaaaaattaaagatagtaataatagttttatttcatgtgtattatatagctacaattttgttatacacttttaatataaactacctcatttaatcctcacaaacattttcaggtcatttgtatttatttagagaagaagaatcattttgttccttttatagttcatttccctcttggtggatgtgagactgataaccctgggaagagaaactggtgaaatagtatctctttggacaccaaagcagagtggattgtggctactgtctgcctgtcctctcacatcttcagtgccgtgttctctatgagcacctcctttcttccccttaacacagaaactaaatccaatgactgtattagtttggttctgagaattgtgtctcttaataagagagttaaatcatagctaactgcttgctcttttatacagttacaatttgtagatgcctgtaatagataatattctaattgaaaagaaagggaaaagggagagctacagttagatacaaaaggtctataataaatgtaagctagcaagagtattgatgataaaatttccaagttttacagctacacaatagagagcaaggaatagcttttatggtgttttatagctggtattcttaagtacacagcattttagtagaaatactttgtgggaaagagtataatgggtttcacaggtagcatttacaaaacacattgacatatttggaatggaaagaattttgctcaaagctagtaaccacatgtaaacttatttttagggtatcagaaagtttcagaaaaagaaataaggaaattcagccttttagttcatatacttactttaaatactatgtaaatgtttttaatttttaagcaaaaacaccatcgtttctttttttttttgaggcagagtcttgctttgtcacccttgctggagtgcagtgacatgatcttggctcactgcaacctctgcctcccgggttcaagcaattatcctgcctcagcctcccgagtagctgggattacaggtgcctgccaccatgccccgctaatttttgtattttgagtagagacggggtttcaccatgttggccaggctgtctcgaactcctgacctcatgatctgcccaccttggcctcccaaagtgctgggattacaggcgtgagccaccgtgcctggcttcaatgttttattggttgtccttaaccttgattgttgatggatggatggatgatacatggacagcctcattgtttttttcatactggttacctatctcccttttcccattaaaggagcagccatgtcttattttaccattgtatctctaatgccagattcacagtagaggtcaccaactgcttgcggaattaatagttgatggaaagggagattcaggaattacctgtgagtttacattggatgattgtaattgctccctgccaccagtttgcatgggtaatctacacagaggcctcagattccttatatgtaaggtgaggataataatagtacctacctcacagtattgctgtgtggagttaatgaggaaatatatgtgaagctctcagaacagtgcttggtggagaaagcattcattaaatggtagttgttagcattgtaactaccatcatatcgacttatctattgggaacttactgtaatgcctaggcacttaagtattatttctaaccttcagggttaggcagtactatcaccatgttgtaggtggggaaacaaggtttagttatcacggatttgcttaaggctgcacagctagtgggtaacacccctgatttaaatccagctgtgttgggccccaaagcctttagtcttttactatttcaagctgcttctctgagttgaaaaccaaaccctagaactaaagtaaacctaatacccagtatattttcaccatcagggatatgtggcaagagtaactggagaaaataccttccaggtttgcagaagtgtcaaaatgttgtgggactcaaagtgtgaaatcaggggagccttgttgtttgtctccttctctagaagtatgagacaccatctatactggtggatcttggagccagagatctttaaggaggtagaagaagtaggagagtgagaaactagccacagagcgccactgccttattctctagactgagcaggagctttttgttccgtctctttctgtgttcccataacagatttattgttcttctatcaccacacttgtggtaccctgccatgtttcactgataactgtttccatctctgtttcccttactaaagtaaccgttccttgaagaccagcatcatcttgctatctgtgtatgaataccaagagtaaccaacagactctctagagctcactgctgtcttaacgaatttgtccaaattggcttgccactttttctctcttgcagacagagcttaatgcataattgagtattgtgaaggctgtttccaattctacaaataaagaactcttgatagaggggattttttttctattagtaatcagtatttctcatggttaagcacactcctttactccaaaacttcctggtggttcctccttgctcaccagtgaaacacaggccccttaactgatattcacagctgcctgtggctctggccgcttttctggcccatcattccccttgtccttgtttacgctgtgcagcaaccaagctaaaacacccatcttgctttaaatgtgacttgagcttctttgcattgtgttgcctttgcctcacatacttttctcctttatcttgtactaaatagtaaatcctacctatcctccaaagcccattgtggacaacaccttctgtggccagaagtaagggctttcttcttagacctctcagagccatttggctttctccctcggtggcatttgccacagtctcacatgttaactatctgaatgtgtctcatctcatccctttgattgaaagtttactcattaatgctggcattagcaaccaatcctcacagcagtcctgtgaggaattctcctgctcatcttgaagattaggttaggaaactaccatttggtgaggttaagcaagttgcctgtgaacatggtatattaagtgctggattctgcactgctggtctctttggctgtaactctgatgctgtctctttagtgcatcccaatgcccagaaaataagaagtgttcagtaagaaagtgtggagttgatttgctcttcctcattgacatttagtgttgtgcctttaggtgctcaataaatgcttcatgagtacattaataaaaccaagacctgaatatcagatttcatcaaattgaagacatgtcaattgtaagattaacatttctttttatatgccactaaggaagataaaagcactgctaattcaaatatggcacagtcttatcacttaacatattttctgaatattgaaagagttatttagacttatctagacatagatttgaattatatatcactgctaagaaaagaaaatggctgagtgcggtggctcatacctgttatcccaacactttgggaggctgaggcggatagatcacttgagcccaggaggttgagaccagcctaagcaacatggtgaaaccttgtctctacaaaaaatacaaaaattattcaagcatggtggtgcatgcctgtagtccccgctacttaggaggctgaggtgggaggatcaccagggcctgggaggtggaggttaacagtgagctgaaatcatgccagtgcactccagcctgggtgacagagccagaccctgtcttaaaaaaaaaaaaaaaaaaaagaaggaaaataaacacaaaataaaattagtagtaattctgcaaaaaaaaaaggaaattagtcattcttaaaatgacaaatatttattaattccaaatttacaccctgctttctttctgtattcttcttcattttcattttgtaatctttttagactattttgaaaagtaggtaaattcgacatgtgtacttacatactttgcataactaagttgaagagacccctgtatgaatattgtcaccaaatctgtagctgtgacatgaccattacctgacagtgtagcagtgattgtaagattccattgattttaagatgcttcttgatttccagagatggtaaaaatttgagaaaaaatatgctcttataattgatgacttaagtctatgtatttattccagatttcttcttttaaaggctttaaaaagtgtagctttcttttatagtctgtgtggttttaattatctaggaattgattaatcattttcttggccttgctaataacctcagttctccaccattgtgccttctgattgtttccttgcttgtcagctctttgaccaaaaagtagtggtctggtgaaacagttaatagataataggaaccaaaggctaaaatgaagctttggtacaccaagtttattgtattcatatttaccttttgttattctctagttgatagggttggttatatctgttttgacataaaggaaatttaaaaggttaataagttccctgactgctttgggtaagaaaatataaagactatcttaaacaactgcattgccttgtgaatatatatacgtaatactaaaccataccttcccccttttccatacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtgga

SEQ ID NO: 16151 - DNA, 146401 bp, Human
taggggtgattctgccctccaggggacatactagcaatatctagagacattttcactgatcacaactgggtaagggtagggtggggaacgggtgtcctactgtaatctagtgaatagaagccaggaatgctgctaaacatcctacaatgtttgagcacaggatagctccccacaataaagaattatgaggcccaaaatgttaacagtactgaggctgagaaaccatgtttaagactatagttaccgaaactcaactagattaccaaactgccaaaactcagaattcttaagcaaaagattaatcagacattaacaaaacattaaacttgtcattaagtttcttcaaaaatggatggtggaaccatttccgtttaacgtttcctgcaaaatgtgcttatcaagagccctgcgcaaataacatttttgtggacagcgctgggcatttaaaagaggcacaagacaaatgggttttccgaacaataaaataatagtagtaatggctgtgaatactatgggaggtttcatcacagatgcttgccatttacttttagggacgtcgcatacgacgtccgtaaattactggctcgggttttgagctttacctggctctcgtcccctgtagtacaatcctctttattctttcaggggacaaacaacaacaaaacccgtctctcacacagacaatacaccctgacagacaagtgacccacaaacaatccctcctcaaatgaaggtaaaactagggctagaaaacgttcaactaatttaaggcaattaaccctctgaaatttttcgctgatcaaaggaacaggaattgctgttttaaaatatgcaactggcatttcacacctctacactggacgacgtattgcgtggaggatggagaaggaagatcacccctactcccaaattcgtagttataagggcgggttattagaagggcgccaggaaggtctctctacaaagatggggggccggggaactccctatttgccctattttggtcccaacactgaaccaaggaaattgcgcccaaggttgaagcacacgcaatccgtccgtcatgcagacaaatgctctttcaggggtcctaattaagtgtggaggcctgactttccttccgaatccgccccaggtgttccaccccgagcttcccctcgggcttcccctcgccacgcagcctctgaagagaggagcatctacatacaaagaggcttaaactgcccagaacctccgaatgacgaagaatcaccgccagtctcaactcgtaagctgggaggcaaaaccccaaagcttccctaccaagggaaaacctttggcctcaaaggtccttctgtccagcatagccgggtccaataaccctccatcccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtgggtgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccaggtacagataagacaactacagtggatgataatgtatgtggtgataggggagtactctgatggtagaggagtgactttggttctctgcaaactcagcctgagactatcaattcagtttgtggtgagacctcgcagtgttaccttggcagatggtagaagccttccagatggaaggaaaaatgcgtgtaaaggcacaaagtgtagaaggaccctgaagctccagcgtgaggcctggcattgaatgaaatatattttgtgggttttcagctgctgaagtcataggaatggatgagaccaagaaaacaaagctgtttttgaggtatgagcggaagaagagatatcaggagactttcgaaacagtcataacggaagttaatatgatcattgctaacatttgctgtgtttcaggcactgtaagcatgtatatgggtccttaaagggactcatagaggtaggtactagtattgtttttccttttatcattgagaaactgaggtttgaagagattagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataaatgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaaccataaggaatggaaaaacaaaaatgataatacttgtccacaggaagtatataatcaaatgaaaagaactcaaataacaatctgtaatctatagcagagtaaagcggaagttgtaatagtgttgggggatgggggaagtcagaagaaccaccagtgaatataaaaggagaagagaatcagagccatctgctaataaaatgggtagtcagctctttttgttttttttgtcttgttttgttttgagacagtctcgctctgtcgcccatgctggagtgcaattgcgtgatctcagctaactgcactttccgcctcctgggttcaagtgagtctcctacctcagtctccccagtagctaggattgcaggcacatgctaccacacctggttaatttttgtatttttagtagagacggggtttcacgatgttggccaggctggctggtctcgaactcctgacctcgtggaacgcccacctcggcctcccagagtgctgggattacaggcatgagccaccacgcctagccccggtagtcagctcttactgagaatattcaaagacagggcattcattttgtaagagacattccttccttcataggaagattggacctggtcttttagttcctcccaattttgagattctgtgagattgaatcggggcagagaaacatacttaatcttgaaagattaagtagaatttagatggatggataggagaaggactttccctacctttttacttcttgagatatagttatttgtaggtataatatacataaatatatgtattttttctctgtttacagacattcatagtttaataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttggtgtacgaatgatcctgtcactcaggtagtgagcatagtacctgataggtagcccttcaagccatacctccctttctttccaaccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagacaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaaatccttgagtgctcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagtaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggttgatgcatttttacattgagacatcattttcaaccgtgaaatccatttataactagaaacagattgtaaggattaggaaagatgaataaagtattttaaatactgagagtattaaataaactagaaataacatttgtagtcaagaggaagtgtgtatttagttgtccttcagtgtttatgacagattctgttttatttttagctcctgtttggtattagattgactgttacagatttgaaagcatataaaatgaaacatgcatgctgtttttcctctgattttctagtttattttaaataccacaaatataattacaacctgaagatgaatactattttgtataagctgatctggtaggtcaaatatgcacccagcattcctggctagttatgaatatcttctaggcaggcttaatttattggctggcaacattaccaactgcctaagaaacaggtagatcctgtacagaataacagaaggagttgagagaggattgagagggtccttactagcattgtaagcttttaatgacaaatttagaaaacaggcagtaaagcaatagaaagtcatagaagattaagagctttgcagaccagatattaaattggtcttgtaggagttaggccttgaaagagagatttaattgttttatttgtttttttcagctgatgtagtaatctaagcaaggtggtttaaaagttgctctttgtgatggcatgaacagcttttgaaattattataatttaagtattcaacgagtttctgaaattgcattttgttttcttgaagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattactgtcgcgtgagttttttttttttttcagatcattttaaggacttaactgttgcataagtttgttctaaatagaataagataaaagttgagtgtaagtacatataatgatttttatttttattaaaaggtttttttttagggctagtcaagtgaagcagtgggagtttagaaggaacaaagaaatctgtaactggttgtgatcaattcgttgtaaacaccactgcactcaggccagcctgatttttaatattacaagttcaaatatttggggaaatttatgcaagcatagaatgacagaaatctgaggattgaagggatttatttatttaagagatagggtgtcactctgtcacccaggctggagtgcaatggtgtgatgatagctcactgcaggctgaagcttctctgttcctaagtgatcctcctgtcttggcttcctagtagctaggactacagaagtgcatcaccatgccaggctgatttttttttttttttttaagaggtgttatttcactgttctgcccaggctgatcttgaactcctggcctcaagcagtcctccccctgctcagcctccctagttattggtattacagatgtgagccaccatgcccagtgaaggaattaaaaattactgttttaactacccagtcttggatgccctctctacgtccctagcctttaggtagaagtgcagtcttcatgattgaatatactttcaaggctttcttttccatctttgaatagcattaacagtattaaaaactggccaggcgcagtggctcattcctgtaatcccagcactttgggaggccaaggcaggcagatcacctgaggtcaggagatcgagaccagcctgaccaacatggcaaaaccccgtctctactaaaaatacaaaaattaattgggcattgtggcgcacgcttgtaattccagctacttgggaggctgaggcactagaattgcttgaacccaggaggcagaggttgtggtgagctgagattacgccactacactccatcctgggcgacagagcgagactgtcaaaaaaagaaaagtattaaaaacctgtcttttgttactgcttctcccttctgagagtatatcaaaaactcctatttatgtttttagtgtgacatccttagagatgtttgaaagtagccacaatatttcctaagtcctcatctctaaagttcataatctcactttcttcagctcacgtgacctaggttttatgctactctcctctgaatattcttcactttaattgtctgtcttaaagtgtgggcctctacttacagggaagaggccagaaaaacaaacaaaaaagtgtgggactcattttttttaatacaggctcttgctctgtagcccaggctggagtgcatgcagtggtgcaatcttggctcactgcagcctccgcctcccaggctcaggtgatcctcctgcctcagcctcccaagtagctgggactataggcatgggccaccatgtctggctaatttttgtatttttaatagagacagggtttcactgtgttggccaggctagtctcaaactcctgacctcaagtgattttcccgccttggcctcctgaaatgctgggattacaagcgtgagccactgcacctggccaggactcaatcttttaggtatattctgattagtacagagtgaagcaattcttgcttatctttcattctgtactcttactgattaattctaagatcatgtgagcttccttggctgtcagaaccaacacttaactgacattttacttgctatgatttgaggaaaaaaacaacccccaaaaatatttttttctcctgatgagccaaatagttcccatctttaacttgtacaattaatattgtgaagagttgatttttcggaaccaaaatgcaggatcctggcaagcttttgtaaggaaatgggctttacacatactgaaaagctagaggcagaagtgtgtgttcagggactcctgggctcttcacagataaggatgttgctttgtgataccaactcttaatttaagaatcaggagtgtgaggcgcggttgctcacacctgtaatcccagcactttgggaagctgaggcgggcagatcacctgaggtcaggagttcgagaccagcctggccaatatagcgaaaccccatctctactaaaagtacaaaaaatagctgggtgtggtggcgggtgcctgtaatcccagcttctcgagaagctgaggcaggagaattgcttgaacctggaaggtggaggttgcagtgagctgagattgtgccattgcactccagcctgggcaacaagagtgaaactctgtctcaaaaaaaaaaaaaaaaaaaaaaagaatcaggaaagcccccaaattggtaaatatttagtagaagtatgcagattattagtgaatatttcagattggtggtatgagacttgagtccaaagaataatggtttagtcaattttctacctcctctgagatgcgagttcgtgtggatagcttcaaccccttgtcagagactccagcagagacaaaggaaaactacaccaaaatattctgcactcacttttgctctgtgtagtagctttgtatccagtaaaatattttatttgctaataatgctgggatatagtaggtacttactgaaagagtgaatgagagaaagataacatgtcaattttgtagcccaccagaaaagtttgcaatgtgtacagtagttttgccttgcagtgaacaaaccttttaattgcaacattaacaatggagattacgtttgaaaatgcatcagcctgttggtttataagaaatagttggtgaaattatcaatgctggtcatgtaagtagttgaaaatttgtttttttatttacggcttccttttctttcaaatttgactttgttacttaaacctttttaatattggggcaaaaccagggagttactattccctcaccccacttcagttgtttttgtttgtttgtttgtttgttttttacgaaaagattggagggttgatggaaatttaacatatgtctaaactttgccattcttgcttagcattggtatccaaggtatgatgaaagaaatagagattagtaaaaaagaagtaaaaggcagctgagaagaaacaagtaagcaaatattgttgatttctctcctttttttttttttttttttttttttttgagacagagtcttgctttgttgcctaggctggagtgcagtggtgcagtcttggctcactgcagcctcttcttcctgggcgcaagcgattctcacgtgtcagcctctagagtagctgggactataggcacacgccgccaggcccggttaatttttgtatttttagtagagacgagggttttgccatgttggccaggctggtctcaaactcctggcctcaagtgatctgcctgcctctgccttccaatatgctgggattataggtgtgagccaccacactcacacacccagcctactgttcatttcttttctttttttttttttgagacagagttttgctcttgttgctcaggctagagtgcaatggcgccatcttggctcactgcaacctccgcctcccgggctcaagcgattctcccgcctcagcttcccaagtaactgggattacaggcatgccccaccatgcccagctaattttgtatttttagtagagacggggtttcaccacattggtcaggcttgtctcgaactcctgacctcaagtgatccacctgccttgtcatcccaaactgctgggtttataggcgtgagccactgtgcccaccctgttcatttctttatgttagcatttgtctgcttttgtacaaagcttaaatagagtctagatagtgcaaaactcagctgcgaaaaatgttaagttccataagattcctgaaagtctctgtaagtaggctgggcacagtggctcatgcctctctaatcctagtactttgtgaggccaaggcaggcagattgcttgagcacaggattttgagaccagcctgggtaacatggtgagacctcatctctacaaaaacacaaaaattagccaggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagtgagtcataatggggccactgcactccagcttgggtgacagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaaatgttacaaggactataagagaaatgcacagggtactagaaaaaaggatcacatggttgtgcatttcataactggacaatgcctaaaattatgaagtgagccataagtgaagatgattttgcagttatatcagtgtatatttgtttaccatagcctgtgaatataactagtttcatcataggaaaaccctaatccagaatatattcatatttacatgagttgtgttctgctcatagttatggcaataaatatattcaattttaagattgtcagtatggaaaaatggcatttctgctgtgacgtaaatataatttactgaaaatgataattaaattatttttaaatgtaattttgttaccttcaagaatatgtgtgtagtcatgccaagttttcagaatctctagtaagtaaataacatgctgttaaaaatgacacaggtacaggggtcaagcacagtggctcatacctatagtctcagcactttgggaggccaagacaggagaatcccttgagctcaggagttcaagaccagcctggggaacattgtgagagattctgtctctatgaaaaatttaaaaaattagctgggcatggtggcacaacatctatagtcccagttgctcaggaggctaaggtgggaggatcccttgagcctgagaggttgaggctgctgttgggtgtgatcatgccactgcacaccagcctgggtgatagagcgagaccctgtcttaaaaaaaaaaattacaacctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaaaaaaaaaaaaaaaagtgaaagcaagagagttgaaagttcaaaggggcgtggccaacattttaagtgttgtagaaaggataagacacaaaagtatccattggatgaggcagttagcacgctacttctaaggtaatggaaatcaaatatattagaatagaatgcattagaagacaatgtacagaacccagtgattcattagatgtgtagagtgtgtgctagggaggaatctggtgttgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcaggtgtcaaagtcttctaatacacgaactctaaaagtttagaagcttttttttttcatggaaagtatttaagctaaattttgctagctaaattaaaagacatttgtccatattctttattgccattttattatttcaaaatgagatacatgtgaaccacaaaactactacctaatcagtaccctcactcctgcattacactctactgttcccctgagaataaatgccttctcagctaatttcttaggagtcatttgtagcctttacgttactctgaacacaagataggctgtgtctgtaacagggccctcaacaagcctagagacagcctttgggaataggctggtgatatctaggttacctaaccagatctttccccagtatggctggtcatatttaggtcattttacattatcacttacaaccatggctgtcactgaaacaaaggcagtctttcccctagtctgcttactatattctgtcatctagtttgttctctgaaaccccctttttatttttaaactaactactcttacttctttttttttcttttttctttttatttaagctaacctttgccacttcttcccggatgttacttcttataattagcttttttgtcaaagtatttttttacttagcttccttttaaaacttgcttagatgaggactctgtggaagaagcgaagtctgtgctcaaaatatatatttggtacaggtggtgactgaagccatgactatggatgagatttgtatatagagtttagtgtgagatgagaagaatggcctaagattgagtcagcatttgcatataaattttggaatcagcttactgatttctacaaaagatcttgctgggattttgatactaattgcattgaatctgttgcacaatttgagaagaatagaaatcttaacaatgtggagttttccaatccatgaacactgtatatctctccatttacttaggtttttttttttttttttttttttgcttctttgtttgtttttttgagacagagtctccctctgttgcccaggctggagtgcagtggcacgatctcacctcactgcaacctccacctcctaggttcaagcgattctcctgcctcagcctcctgagtagctgggattacaggcatgtgccaccacacccagctaatttttgtatttttagtagagacagggtttcctcatgttggccaggctggtctcgaattcctgacctcaggtgatccacctgcctcagcctcccaaagtgctgggtttatagacttgagccaccgcgtctggccacttgtcttttttgatttctttcattagtgttttataattgtcagcatatagattttttgttgtaaattgacaattttttttctttaattttatatattaaaaaaaatagagacaggatctcactgtgttgcctaggctggtctcaaactcctgggctcaagtgatacccttcccttgacctcccaaagtgttgggattataggcatgagccaacatgcccagctgcaaattgacatttatttataattgtataaacataaagattttgtatatgttttgttagatttatactgcagtagtttgtaattgcattgtttttaacattttgattttcaaattgttcaatgcacaaaaattatacagaagtccagttaatttttgtatagtgaccttgtattttgggaccttgctaaaatcacttactaaatctagtagctttctttgaatgttcttttggattttctttgtagacaaacatgtcttctgtaagcagtaatttttttttctttctttctgagccatgtggcttttattttatttttgtgctttattacattggctaggacctccagtgtgatttattgtggtaaaatatatataacatttataattttaacttttttaagtgtacagttgtgtagtattaagtgcattcatattgttgtgtaatcatctccaccatccatctccagaacttttttttctatactcagtaaacaatgatttaccattttcccctcccctatcccctggcagctaccattctactttctctctctatgaatttggctatttggggtacttcatttttatggattgaatgttgtgtcccaccaattatgttgaaatctaactcccaaagggatggtatttggaggtgtgggatttaggaggtaattaggtcctgtgggtccagccttcatggatgggattaatgcccttatgaaaagaggccagagagctaacttgctgtctttctgccatgtgaagatacagttcaaagtcagtagtctgcagccccaaagagggccctcaccagaaacccacaatgctggcacctgagctgctttcagcctccaaaattgagagaaataaatttctgtggtttctaagccacctaacctataatactttgttatagcagcctgaagtagaggactcctataagtatttgtccttttgcaacctgcttattacacttaccaaaatgtctttgaggctcatcagtgttacagcttttgtcagaatttcacccttattaaaaactgaacactattctgttctgtgtatatgccacattttgttaattcattcgtccattggtggacatgggttgtttctaccttctgattattgtgaataatgctgccgtgaacatgagtatacatctcctgagtttcctgctttcagtcttttgattatatacccagaagtagaattgctagatcatgtggtaattctatatttaattttttaaggaaccaacatcctgttttacacaggagctacgccattttacattctcaccagcagcccacaagggttccagtttctctacattctcactagcacaactaatagaaaatgaggattcctcttctaggccttgaaagtgctgcataattttgcttcttcctacctgtctaacttaactaaagcgcttctaatttctgtgctcaagctacactgtcaattattcagtttctcaaacctagtggtttccatttttttaaattgacttttatcttttagaggaattttaaatttacagcaaaacggagtggaaagtccactggacacacacagcatgccctactgtcaacatcttgcaccagtggtacatttgttaccatcagtaaacctatgctgggacacatcattattatccagagtccaaggttcacttttggtggtacatatgctatggattttgacaagtgttttgacatttttaaagatctttttctgtatctaatgagatggtcatatttttttttcctctgggagagaatggtaacaatttttcactattacagaatcatacagaatactttcactgtcagaaaaatcctctgtgcttcaccttttcatctcttccttcttgtaaactgtgggaaccatggatctttttgctatctccatggtttagccttttccagcatgtcatatacagttgtgcgtctcttaacaatgtggatatgttctgagaaatacatcattaggcaatttctttgttgcgtgaacgtcatagggtgtatttatacaaacttagatggtataacactacgcacctaagctatatggtattactgctcctgcactacaaacctgtgcagcatgttactatactgaatactgtaggcagctgtaacacaatggcaagtatttgtgtctctaaacatatataaacatagaggaggtacagtaaaagtatagtataaaggataaaacatggtacacctgtctagggcacttaaccatgaatggagcttgcaggactggaagttgctctgggtatgtaaatgtgtggtaatgtaaaggcctgggatactatatactactgtagaatttgtaaactcttattctgtaccaaatttaaaaatttatgtttttctttcttcaatactaaagtaacattagctactataacttttttactttataaactttaaaaatgtttaaactttttgactcttttgtaataacacttagcttaaaatacaaatgcattgtacagctgtacaaaaatattttttccttatatacttatagatgttttttcttttgttctataagctttttaaatgaaattattattactctattttttcctttaaacttttttgttgaaaacaaagacacaaacacacacatgagcttaggcctacataaggtcaggatcatcagtatcactgtcttctgtccctgcatcttgtccccctgggagatcttcagggacatgcacagagctttcatctcctatgataatggtgctttattctgaaatacctcctaaaggacctacctgagactgttttactgttttgttttgttttgttttttaagaagaagaaggaggaatatagtataaaatggtgataaaaagcatagtagagtaagtacataaacctaacattttaccagtaacttagtcatttattatcattatcaaggtttatgtactatacatgattgtatgtattatacttttatatgactggcagtgcagtgggttttttttacacaagtatcaccacaaatgcttgtgagtaatttcttgtgctatgacatcactaagtatttaaataggaatttttcagttctgatacaatcttacggtaccaccttttcatattgccatttgtcattgaatagaatgttgttatgtagtatgtgactgtggttggaatcataacagtatgtatcattttcagattgccttctttcatttagtaatatgcatttaaggttcctccatgtctttctctttctttctttctgtctttctttctttctttttttttttttttttttttttttgagatagggcctcactctgtcacccaggctggagtgtggtggtgagatcatggctctgcagcttcgacctcctgagctcaaatgatcctcccacccccttccaagtagctgtgaccacagacacaagccatcacaccctgctaatttttcatttttagtagagataaggtcttattatgttgcttatgccagcagcttgaactcagcctcccaaagtgttgggattacaggtgtgaaccaccgttctcagctcctcgatgtctttttatggcttgataggctgaagtgggaggatcacttgagcccaggagtccaaatctagcctgggcagtgtagtgagacttccgtctcttaaaaaaacaaaaaacaaaaaaaagaggaccaaagttactgatattagaaatgaaatgagatctaattgcagatcctatagatattcaaaggataataaggaaacactatgaacatctattaatttaaatgggccagttcctcaaaaccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagtaaaatttcatacccttcataggtctcaacacattttttgcatattattaatcaaacagtattattattttaaaaaactgtggaggccaggcccagtggctcatgcccataatcccagcactttgggagaccaaggtgggtagatcacttgaggccaggagtttgagaccagcctgaccaacacggtgaaaccccatctttactaacagtacaaaaattagccaggcatggttttgtgcgcctgtggtcccagctacttgggagactgaggcatgagaatcacttgaacccaggaggcagaggttgcagtgagccaagattgcaccattgcactccagcctggacgacagagcaagattctgtctcaaaaaacagaagaaagaaaaacccatggagcatgtactgtaagtgctttcttaggcctagatgatggaacagaggcttagagaagttaagtaatgtttctgcgacctggctcttaaactggtgctctcacagcagtttatagttattcctgtcttaaaggcattttatataagataaaattaaatactgatggagtacttttactatgttaaaaataaattagtgcagttttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgattttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtataaaggaaatgtttactgttttgaatttgcttcttcattcaaacatagaagtctaagtataaaattagtgttctttaggaggatatgactttcctctggatttctctggttgataatgttacttagccatgagaatgtttttcatagagtttttagaatttgaagcagtggtagcagattctgttatgcctttctatttgttcaatacaatattaggtattatgggaaatacaaaaaaatctgagacattgttccctctaggagctacttatgcatcaatacttagatactaaggggtctgacacagactgtagggcaaaagaatttaaagaaagcaggatcttgtttatccacctattacttttattagaagataaaatacgtaaattggactaaaaccagtcagattattcagctcctgaggaagatacatacatattactttaataggaatttgaggcagaaacagggaaattgctgccttaagcctcatagttactctagggccctgtttgccctagagtatcacttgttaaggagaatcacttattctccttaattccttcatatatgtcctataccaagagagtattgcccagaaggtatagtgcttttctgtagttaggaactttattggctggaactggagtttcctcttgctctgtctatgattgcctttgggcttatactagcctttggaccaactcatcatggctagtatagtgactttcttaaaacagcataccacattgagtaatagcagctataatggaggaaatgtcttgtagccactttttttttttttttttttttgagacagagtctcactctgtcgcccaggctgaagtgcagtgacgcaatgttagctcactgcaacctccgcctcctgggttcaagcaattctcctgcctcagcgttctgattagctgggattacagatgcctggcaccatgcccagctaatttttgtattttaatagggatggggtctcaccatgttggccaagctggccttgagctcctgacctcaaaccatccacccgcctcagcctcccaaagtgctgagattacaggcatgagccactgtgcccggccgtgtagccactttttatcaaaagtagctgtgtatttgttttatgggctcttctaataagtatatctagataatatgtagcccatgaaactactataagtgaaagaatagtgacttttaatagtttttcatcttttactcacctcttatctccaggatgaagatcaggcttattaggaggtgatatgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccacgcccagctaatttttgtttttttagtagagactgggtttcaccatattggccagcctagtctcagactcctgaccttgtgatcctcctgcatcggcctcccatagtgctgggattacaggcgtgagccaccggtgcccagcccagaacttttttatcatcccaaaagaaacctcatcccttcttagcattcagtcccaattccctgcatctcctagatcctggcaaccagccactaatcaatcttggtttttgtggattttcctgtttgggacagttcgtttaaatggaatcatacaatatgtgagtcttttgtgtctggtttctttcactaagcataatgttttcaaagttcatgttttaccatgaatcagtacttcattcatttttattgctgaataatattcagttgtatggatatactccattttacttacccatccatcacctgatggcctaatgtttcttaaataaaactctgttccccagagatttggttaacatcctgagtagtaatttcactctgtcaaatattttcttaatatttcttaaaatttcttaaatttaaaaaattgaatccctttgaaagtaaaggtttttgctttacttttagatttcttagtgcttttagtaaatgttcccaggaaataaaactaatgcattacttggtaatacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagagaggttaagcaacttctgtagggacagagatttatagattatagtcaaactcgtgatcagtgctcttttgattaccatgttgatggaatgtttaagtgtaagtgacttctggggaaaagcatattgatttagatacctattgcttaagctcatttttatatagttaagagtagctatttaagattcttaatttgtccttttagtcaagagtaatttattgaacacctgttatgggctaagcgttagatatacagagatgaataacataagactcctattcttaagtatcacacattctagagaatacacagcaaatgtttattggattaactgaattaatgtaaaggaaaaacagttttttgggtttctttgttttcctgttttagaggaatcgtttggtgactaaagagcaaggatgtacaagataactcagaaataaaatattgctaaatatatatatatatatatatatattttctgagacggaggctcactctgtcacccaggctggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatggtaagttcagcatgcattatgtctgacttacagataaacacacacagacacacacacactcacatatccctgatcattttcatagtttgttacttcagttaaagatgtcaaattctatttcagatgcttttcttgtttggccgagaagacttaataaatgcataagtgaatttagtttcaaatgttgacaaattattaaagactaatgttaaggaatttcttttttagttaaaaaatttttaattgatctataatagagttatatattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagtattctttacatggcttttggtcttctaagtgaagctttttgtttttctttgtagtaattttcctcatcttgtactggagaaaattcttgtgagtctcactatgaaaaactgtaaagctgcaatgaattttttccaaagcgtgccagaatggtatgttatctaataatgctctttatcattttaagctatagctttaattacaaagatgataattttagctgggtagtagctgcatcttaataattgtaaactaaattggtccaaaaaaattgcaactgttagccagggaagaggttgttttaattcagtgattgtaatctatgttatataacattagaccaagcttactattttttaatgctgtatagtataatatgtgacaagtgccaatgagaaaaactgaatggttatgctgggaaattaagaatataaaatttatatgaaataagttcttaaagatgttacccatttctgtacatcaactatgatttgactatttgttagctttaaaaactaatgataattgaaaacaaaaataaatctaaacctgagtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattgtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgaggtgagattttttaaaaaaagaactaagcttatatatgattcaactttggtaaactgttaggaaggagaaataggggcaggaaaaacagcaaggatggtgggaggcttcattttaaaagcaaagtggcagtaaagggctctaaattggacaacttagcataattaaaggaaaactcaagaataataatttgagtacttcctttgtactggaaattatggtagacataaaataattccttgtgtaggttagtgaggaatagtaagagtttgagcatagggattatatgatgaaaaaaacctctaaatacaaaggagggaaatgttacagtaatagaaaagaacacgatgtaaacaaatctaatagattttggtggcatctgaagagagatgagtgattagtaaagacaataaatggactagcaattattttagacgtcatctaggaatttcctttagcctcaaaatcacgagttctcttcatgtatactattctcttgccaaaacttgcattttttaaaatgtgaaatgtctttctacctatttctgtgtattcagatcatccacatgtgaaaatccttgctaacgcctttcttagaatctcagaaagtaagattctaagaatttttatttttgagacagagcctcgctctgttgcccaggctggagtgcagtgacgtgatcttggctcactgcaacctccgtcttccagttcaagcaattctcctgcctcagtcttccgagtagctgggacaggcgagtgctaccacgcccaggtaatttttgtatttttagtagagatggggttttgctatgttggccaggctggtcttaaactcctgacctcaggtgatggacccgcctcagcatcccgaagtgctaggattacaggcgtgagccacggtgcctggcctaataatttttcatcttttaatttcatagtacttaatgtttcacatttttaatggcagttagcatcttctttataccatggatatttacatatggtttgtatacaaatatctcttgaactataactcttaaacataaactcttaaaagggcatacatgtttttatttatctttatatcctccacagtgccttattacatggtaaatgattaaataaagcctacaatccattcaaaggagtgaattcggtagccagggaaaatgacttgaggacatgagaggggacagtgtgcctctttatgatctttactgacattcttctgcaccacaattgtaaccactttcattacaaagtaatttagttttgtatattttctcctaaaatgccgtttcctaccctgtaggaacaaaaaaaatctgaacattttgtgtgtaacttagcagattcttagtaattctataaaattgtctaaactttttttttttttttttttgagatggagtcttgctctgttgcccaggctggagtgcagtggcctgatctcggctcattgcaaccttcgcctcctgggttcaagcaattttcctgcctcagcctcctgagtagctgagattataggtgcctgccatcacgccctgctaatatttgtatttttagtagagacaaggtttcaccacgttagccaggttggtctcgaactcctgacctcaggtgatctgcccgcctcggcctcccaaagtgttggggttgtaggcgtgagccaccatgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgcagagcatgcaggtttgttacatagatatacagtgccatggtggtttgctgcacccatcaactcgtcatctgcattaggtacttctcctaatgttatccctcccctagcccccgaccccctgtcaggccctggtgtataatgttcccctccctgtgtccatgtgttctcattgttcagctgccacttatgagtgagaacatgcagtgtttgtttttctgttcttgtgttagtttgctgggaatgatggtttccagcttcatccatgtccctgcaaaggacatgaactcatccttttttatggctgcatagtatatcatggtgtatatgtgccacattatctttatccggtctatcattgatgggcatttgggttgcttccaagtttttgctgttgtgaacagtgctgcaataaacatacgtgtgcatgtgtctttatagtaaaatgatttataatcctttgtgtatatacccagtaatgggattgctgggtcaaatggtatttctagttctagatccttgaggaattgccacactgtcttccacaatgattgaactaatttacactcccaccaacagtgtaaaagcattcctgtttctccacatcctgtccagcatctgttgtttcctgactttttaatgataggctgtaagcatgaaactctttcttatctcttggtagtactctgtcactggtatgatttgcaagaacagagtataagatttgccattttaaaaaattgttaatgagttttgcttatactgtatgactacgtggaacttctaaaaacatttcattttttctcttaagtgcactttattttttattttatagtatgtccaagatcaaagtacactgtaaaaagcaatactaaactataattttaactggaatttgcatttttccttctattcacaatagtctctaatgcaatgtgcaggagaaagtatcactctgtttaaaaataagacaaatgaggaattcagaattggttccttgagaaatatgatgcagctatgtacacgttgcttgagcaactgtaccaaggtaagattttcttcttcttgttttgttttttgagataggatctttctctgtcacccaggctggagtgcagtgggattgtcacaactcattgtagccttgacctcctggtttccagcaattctcctgcctcagcctcccaagtaattgggactacaggcatgtaccacctagctaaaattttctttttacttgaaagtgtagcctatgcagggaattgatcactggttggtgttactgttttggtgtccactcgtaagtttattttttacttttatttttcttttttttgagacagtctctcactctttcacccagagtgagtgatcacatcactgcgatccagcagcctcgacctcctgggctcacagcagcctcgacctcctgggctcaagtgattctcccacctcagcctccttagtagctgggactacaagtgtacaccaccatgcctggctgatttttgtatttttgtaattttttgtattgatggggttttacacattgcccaggctagtctcaaaccctgggctcaagtgatgcttacatctcaaagtgctgtgattacaggtgtcagctaccatatctgttcacattcataagttatacaaattgatttaaaattcagttgaatggtacataaaggtaatatccagacaaataagcaataggaatctgagtttctcatgaaactaattttataatttcaggaatttttctgagattgccttatgacttttatatacaaccatatagatgactcttttattcctgggacactttcattcatttaataaaaattttttgacccaaactatgtggtatgcgtagcggggctagtgagcaacacaacaataactccagcacatagtttactttcttttgctcagatcaccttacataacatttggtagaaagagtgctactgtgtttaatctttgtttttatctgcagcagcctgtgggatagccaagccaggccccagagtattgataataattggaaatatatttcaaacctagtattaggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatcaatacctagcatagtagtgcctgcctttagtttctcaataaataatacatttaaaaattgggaacgaatcatccaggctcacagctatatctgcgcaacattgtaccaaaatttaaaataattatttgttctttaaaagtgaccaaaaatcttgccaggcaagcaacatattcttattgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtgtggtgatagtgaatagtatatatgtatatgaaagcttatctgctctttttttttttttttttttttggagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgtgaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagccgaagcagggcgaggcattgcctcactcaggaagtgcaaggggtcagggagttccctttctgagtcaaagaaaggggggacggacggcacctggaaaatcgggtcactccccgaatactgctcttttgcgacgggcttaaaaaacggcgcaccacgagattatatcccgcacctggctcggagggtcctacgcccacggagtctcgctgattgctagcacagcagtctgagatcaaactgcaaggcggcagcgaggctgggggagggatgcctgccattgcccaggcttgattaggtaaacaaagcagccgggaagctcgaactaggtggagcccaccacagctcaaggaggcctgcctgcctctgtaggctccacctctgggggcagggcacaaacaaaaagacagcagtaacctctgcagacttagatgtccctgtctgacagctttgaagagagcagtggttctcccagcacacagctggagatctgagaacgggcagactgcctcctcaagtgggtccctgaccctgacccccgaacagcctaactgggaggcaccccccagcaggggcacactgacacctcacatggcagggtactccaacaggcctgcagctgagggttttgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctccaccaaaggaacgcagttcctcaccagcaacggaacaaagctggatggagaatgactttgacgagctgagagaagaaggcttcagacgatcaaattactctgagctacgggaggacattcaaaccaagggcaaagaagttgaaaactttgaaaaaaatttagaagaatgtataactagaataaccaatacagagaagtgcttaaaggagccgatggagctgaaaaccaacgctagagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgggaaaagaccaaatctacgtctgattggtgcacctgaaagtaacggggagaatggaaccaagttggaaaacactctgcaggatattatccaggagaacttccgcaatctagcaaggcaggccaacattcagattcaggaaatacagagaatgccacaaagatactcctcgagaagagcaactccaagacacataattgtcagattcaccaaagttgaaatgaaggaaaacatgttaagggcagccagagagaaaggtcgggttaccctgagagggaagcacatcagactaacagcggatctctccgcagaaactctacaagccagaagagagtgggggccaatattcaacattcttaaagaaaagaattttcaacccagaatttcatgtccatccaaactaagcttcataagtgaaggagaaataaaatactttacagacaagcaaatgctgagagattttgtcaccaccaggcctgccttacaagagctcctgaaggaagcattaaacatggaaaggaacaaccggtaccagccgctgcaaaatcatgccaaaatgtaaagaccattgagactaggaagaaactgcatcaactaatgagcaaaataaccagctaacatcataatgacaggatcaaattcacacataacaatgttaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccactacaggagcacccagattcataaagcaagtcctgagtgacctacaaacagacttagactcccacacattaataatgggagacttttaacaccccactgtcaacattagacagatcaacgagacagaaagtcaacaagtatacccaggaattgaactcagctctgcaccaagcagacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaccgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagcaatacaaactaccatcagagaatactacaaacacctctacgcaaataaactagaaaatctagaagaaatggataaattcctggacacatacactctcccaagactaaaccaggaagaagttgaatctctgaatagaccaataacaggatcagaaattgtggcaataatcaatagcttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcatactgataccaaagccaggcagagacacaaccaaaaaagagaatgttagaccaatatccttgatgaacattgatgcaaaaatcctcaataaaatactggcaaactgaatccagcagcacatcaaaaagcctatccaccatgatcaagtgggcttcatccctgggatgccaggctggttcaatgtacacaaatcaataaatgtaatccagcatgtaaacagaaccaaagacaaaaaacacatgattatctcaatagatgcagaaaaggccttggacaaaattcaacaacccttcatgccaaaaactctgaataaattaggtattgatgggacgtatctcaaaataataagagctatctatgacagtcccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttcttcacagaattggaaaaaactactttaaagttcatatggaaccaaaaaagagcccgcatcggcaagtcaatcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgctgcatatctacaactatctgctctttgacaaacctgagaaaaacaagcaatggggaaaggattccctatttaataaatggtgctgggaaaactggctagccatatgtagaaagctgaaactggatcccttccttacacctgatagaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacagaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaatccttttacactgttggtgggactgtaaactagttcaaccattgtggaagtcagtgtggtgattcctcagggatctagaactggaaataccatttgacccagccatcccattactgggtatatacccaaaggactataaatcatgccgctataaagacacatgcacacgtatgtttattgtggcattattcacaatagcaaagacttggaaccaacccaaatgtccaacaatgatagactggattaagaaactgtggcacatatacaccatggaatactatgcagccataaaaaatgatgagttcatgtcctttgttagggacatggatgaaattggaaatcatcattctcagtaaactgtcgcaagaagaaaaaaccaaacaccgcatgttctcactcataggtgggaattgaacaatgagatcacatggacacaggaaggggaatatcacactctgtggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtgtaataaaaaaaataataatttttaaagtttgcatattattttgttatgtagacatattacaggttatatatccattttactattgttggacatttagtagaaaaagtactgtagttttcatacttacacatgaaccttgaattgtttgattaggtaaattttttttttttttttttttttgagacagagtctcgcttcgtcaaacccaggctggagtgcagtggcatgatctcagctcactgcaatctctgcctcctgagttcaagtgattctcctgcctcagcttcctgagtagctgggattacaggtgcccaccaccacacccagctaatttttgtattttaaatagagacaaggtttcaccatgttggccaggctggtttcgaactcccgacctcaggtgatccacctggctctgcctcccaaattgctgagattacagatgtgagccactgtgcccagcctgattaggtaaattttgactacagcatgctcctgcaagaagccatcttgaacatctttgtttctcttccttgaaggcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtaaatacatatttactacttgggatttcttttacttctttatattgatttggcagtataagaggcctcattgatatcaattttgtgcttatttcattttctcttagtatagccttttaggattgttcctttcttatatactttattttttttttatttttacttgaatttattagtttcatattttattcttcatagaaggaacttaagataactattaaagaaataaaaccaggccaggcatggtggctcacgcttgtaatctcagcactttgggaggccaaggcgggctgatcatgaggtcaggagatcaagaccatcctggctaacgtggtgaaaccccatctctactaaaaacacaaaaattagatgggcgtggtggcgggcgcctgtagtcccagctactcgggaggctgaagcaggagaacggcatgaacctggggaggtggaggttgcagtgagccgagatcatgccactgcattccagcctgggcgacagagcgagactccgtctcaaaaaaagaaataaaatcatatgataggttatttcctcaatagaaagcaggaaatgaaaacacacctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacgcagatacacacatcattttctctgaaccattttgagatgaaatcgcacacgtgatgctccttatacttcagtgtatatttcctaaaaacaaggatacacttctgtttagccacagtataatcatcaaaatcaggaagttaacattttgtcattgcatttaggtgtgtagtctgtttagtctccttcaatctggaacagttcttttttttatttatcatgaccttcatatatttgaatagtacaggtcccttgctctgagtttgtctgatgtttccttatgattaaatttatactttgacgagaatgttgcaaaagtaattcctcttctgccttcaccctgtccatttatctgtctgttgatagatatcttcaaatccaagccaacatcacacagtttatctttttttctgtccaaatttataaattgctttactagcagttaaaaaaaacaccccaaaacctgactatccactcaacctgaatgcatttacttatttgctcaacaaccttatatataactaatctaaccatgtgggccattttcttagccctagccccagtgtatgtggaggtagagcctctggcctagcgagtagcaagttgggtcctaggtcatgtccccagttccagcaaattgtcacacatgcctggtgagtccctaattagaacctctgatcacagtaaattgtaggctgagtcattggtggaatccctggtcatgtttcccacccttggtgaaaatgcacgtcaatcccttagagtgagaagacaagtttggttgtgccctgtttgggcccctggtttaggtcctcgcagatactcaagtctctatccctgaccaagaggaagttacatgcttttcttgaagtattgatgtttcaagtcacttcagaacattcagtaacctcatgtacatgactctcatgtcaaataatgaaaaggatcatttaatttcctttgttaatatctgaaaaggattaagaaatatattattctatatgtaaataggaaaaaaaatcccttattatttcagtatagccagaaaattatttggtagttctcggaaactggctgcccagataataactaccattataactggtcgttgcagcagccctttctgtgcatagtaccataaagagccttacaagattgccttatgggaagataggtcaaggtttttgacttcttccctgcccatgattatctctgctttccaaaattcattaatagttttcaaccactggtctattatccccaagcattattttgggagagtggagacttacagtttcagaatcttgctcaagctcttaactgcaacagtggtaataatgatcatttattgaattccacaatagaagctagacttttacgtttattttctctaatcctcacagttatctggccaggtaagtgatatatcttcactctactgatgagggtacgaaggccctagatgacataaggcaagttttttaccagaaaagttaaggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaacccttgtactatctgattgctaagtaattctaaatcaatagactgttttttgtttttgtgtttttttgagatggagtctcactccatcacccaggctgcaggctggagtgcagtggtgctatatctgctcactgcaacctccgcctagtaggttcaagcaattgtcctgcctcagcctcctgagcagctatgattacaggctcccaccacaatgcctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtggttgactcgagtgaggtgtgtctactatcatgtacaggagatacggactgtttggaaattactgtgattttatgtgagtttatgaaatgataattagcacattttacattgtgctaattacaattatatttacttgagtgaacatccagtgaagcactggaaggattctatcatgaggatcttttatatttgagtactggaataaacatatattaatttcattctttttttttttttttttttttttttttgagatggagtttcgctcatgtctcccaggctggagtgcaatggtgtgatctcggttcacttcagcctctacctcctcggttcaagcaattctcctgcctcatcctcctgagtagctgggattacaggcgcctgccaccatgcccagctaatttttttatttttcgtagagatggagtttcaccatgttggccaggctggtcttgaactcctgacctcaggtgatccacccaccttgtcctcccaaagtgctgagattacaggcgtgagcctttaatcatgtagtttttgtcattcgttctgtttatgtgatggattatgtttattgatttgtgtatgctgaatcagccttgcgtcccagggatgaagctgacttgatagtggtggataagcgttttgatgtgctggattcagtttgccagtattttatcgaggattttcacatcgatgttcatcacggataatggcctgaaattttctttttcttgtgtctctgccaggttttggaatcaggatgatgctggcatcataaaatgagttagggaagagtccctctttttctattgtttggaatagtttcagaaggaatggtaccagctcctctttgtacccctggtagaattcggctgtgaatccctctggtcctgggctttttttggttggtaggctattaattactgcctcaatttcagaacttgttattggtctattcagggattcgacttcttcctgctttagttgggaggttgtatgtgtctaggaatttatcactttcttctagattttctagtttatttgcatagaggtatttatagtattctctgatggtagtttgtatttctgtgggatcagtggtattatcctctttatcattttttattgagtctatttgattcttctctctttattagtcttgctagcggtctgttttgttaatcttttcaaaaaatcagctcctggattaattgatttttttgaaaggttttttttgtgtgtgtgtgtctctatctccttcactcagctctgatcttagttatttcttgtcttctgctagcttttgaatttgtttgctcttgcttctctagttcttttaattgtgatgttagggtgttgattttagatctttcccactttgtcctgtgggcatttagtgctataaatttccctctaaacactgctttagctgtgtcccagagattctggtacattgtgtctttgttcttattggtttcaaagaacttacttatttctgccttcatttcattatttacctagtagtcattcaggagcaggttgttcagtttccatgtagttgtgtggttttgagtgagtttcttaatcctcagttctaatttgattgcactgtgatctgagagactgttacgatttccattcttttgcatttgctgaggtttgttttactttcaattatgtggtcagttttagaataagtgtgatgtggtgctgagaagaatgtatattactctgttgatttggggtggagagttctgtagatgtctgttaggtctgcttggtccagagttcggttcaagtcctgaatatccttgttaattttctgtctcattgatctgtctaatattgatggtggggtgttaaagtctcccgctattattgtgtggaagtctaagtctcttcgtaggtctaagaacttgctttatgaatctgggtgctcctgtattgggtgcatatatatttaggatagttagcacttcttgttgcattgatccttataccatcatgtaatgtccttctttgtctttcttgatctttgttggatgtttgttttatcagagactaggattgcaacccttgctttttttctttctatttgcttggtaaatattcctccacccctttattttgagcctatgtgtgtctttgcatgtgagatgggtcccctgaatacagcacactgatgggtcttgactctttatccaatttgccagtctctgtcttttaactgggacattttagcccatttacatttaaggttaatattgttatgtgtgaatttgatcctgtcattatgatgctaactggttattttgcccattagttgatgcagtttcttcatagtgtcaatggtctttacaatttggtatgtttttgcagtggctggtaccagctttgcctttccatatttagtgctaccttcaggagctcttgtaaggcaggcctggtggtgacaaaatctctcagcatttgcttgtctataaaggattttatttctcctttggttatgaagcttagtttggctggatatgaaattctgggttgaaaattattttctttaagagtgttgaatattggcccccactctcttctggcttgtaaggtttctgccgagagatctgctgttaagtctgatgggcttccctttgtgggtaacccgacctttctctctggctgcccttaacattttttcattcatttcaaccttggtgaatctgatgattatgtgtcttggggttgctcttctagaggagtatctttgtggtggtctctgtatttcctgaatttgaatgttggcctgtctcgctagattggggaagttctgataatatcctgaagggtgtttccaacttggttccattctccccatcactttcaggtacaccagacaaacgtagatttagtcttttcatatagtcccatatttcttggaggctttgtttgttccttttcattcttttttctctaatcttgtcttcatgctttatttcattaagttgatcttcaatctctgatatcctttcttctgcttaatcagttcggctgttgatacttgcgtatgcttcacgatgttctcatcctgcatttttcagctccatcaggtcatttatgttcttctctacactgattattctagttagcagttcctctaaccttttttcaaggttcttagcttccttgcattgggttagaacatgctcctttagctcagaggagtttgttattacccatcttccgaagcctacttctgtcaattcgtcaaactcattctccgtccagttttgttcccttgctggtgaagaattgtgatcctttgcagcagaagaggcattctggtttttggaattttcagcccttttgcgctggtttttcctcatcttcgtggatttatctacctttggtctttgatgttggtgacttttgtatggggtttctgtgtggacatcctttttgttgatgttgatgctattcctttttgtttgttagttttcctttttacagtcaggcccctctgctgcagatctgctggagtttgctggaggtccactccagaccctgtttgcctgggtatcatccatggaggctgcagaacagcaaagattgctgcctgttccttcctctgggaaggttcgtcccagagcggcacccgccagatggcagcgggagctcttctgtatgaggtgtctgtcgacccctgctgggaggtgtctcccagtcaggaggcacgggggtcagggacccacttgaggaggcagtctgtcccttagcagagctcgagcgctgtgctgggagatccgctattctcttcagagctggcaggcaggaacgtttaagtccgctgaagctgtgcccacaaccacccctttccccaggtgctctgtgtcagggagatgggaattttatctataagctcctgactggggctgctgcctgtctttcagagataccctgcccagagaggaggaatctagagaggcagtctggctacagtggctttgtggcactatgttgggctccacccagttcgaacttcctactggctgtgtttatactgtgaggggaaaacatcctactgaagcctcagtaattgcagacgcccctccccccaccaagcttcagtgtcccaggtcgacttcagactgttctgctggcagcgagaatttcaagccagtggatcttaacttgctggtctccatgggggtgggatccgctgagctagaccacttggctccctggcttcagccccctttctaggggagtgaatgggtccgtctcgctggcgttccaggtgccactggggtatgaaaaaacactcttgcagctagctcagtgtctgcccaaatggccgcccagctttgtgctttaaacccagggccctggtggtgtaggcacccaagggaatctcttggtctgcgggttgcaaagactgcgggaaaagcgtagtatctgggcaggaatccaccattcctcacagcatagcccctcacagcatagcccctcacggcttcccttggctaggggagggagttccccgaccccttgtgcttcccgggtgaggctacaccccaccctgctttgactctccctccgtgggctgcacccactgtctaaccagtcccaatgagatgagccatctacctcagttggaaatgcagaaatcaccaccttctgcgttgatctcactgggagctgcagaccagaactgttcctatgttgccatcttgctgttcccttgttttatttttctctagtatttatgataacgtgaaacatattttaatatatttacttctccgtattccactagtatatatgttcctaaaggcactggtttttgtctgttctgttcattgttgtatttttagcacctaaaacaatacttggcatgtgataggtatccaataactgttttaaaataaatgaatgtacttgaaaaaaaattacatgatgcttcaaaaacatcaaagctgaaaatcatttgagtaactttaaaatgtaagcaatcaataataaaagattactatattgttcagcagtcacataaagtattaaaactaatatttcagtatttgaatatgccgacagtaatgttttcataaactagattttgtgtctaactcctcaggtttggaactgtttttagtaagaccataatgcattgcaaggatttctaatgaatatgtttagtagttcaagcccttattaaatttcacagataaaagcaaatgtatgctgaactttaaggactgaggtaatataagactgaattgaatgtaataaggcggcagtgtagtggtggcattaaaaaaactgaagattcaaaaagtataaattcaagaataacatgcaagtagcattcttttttttaattttacacttgttagattttgtcttagtccctttgtgttgctataaaggaatacctgaggctggatatttacaaagaaaagaggtttatttggcatatggcgtctacatctggtaagggcctcagactcatggcagaaggcaaagaggaatcagtgtgtgcagagatcacatggtgagagaggaagcaagggtggaggcggggaaggccatgccaggctcttttttttaataaccagcccttgtgggaactgaatagtgagaactcactcattccttaccctcaggccttaatctattcgtgagggatctgcccccatgactccgacacctcccattaggcataacctaatggggatcagatttcaacatgacatttggaggggttaaacattcagacaatagcagatatctaatgttcagctattttaagagcagtgagtgaaactagaagaatcagaggaacataaacaattataaaagcttcgattactaaaaaaggataaaagacaaagttgattaaagagttatccttaaatatgtgggtgttacgcaaaaggtgtactgatcaacttttttccatcacataaaacaaaatttaaatggtacataaaaacattaacttacccgctttcagagtgattaaatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttacaagtatttaaggtagttaaataactgtcaagtctgtgatagcaggaaattgaaaggaacaattgaaagaatgtgagtttagaaaagaatttcaatagattagaaagataagtgtaaataacataaaatctaatgagataatgtatattatacattttaaatcagcctgtcatctgcaaaaagggaaaatactgatctgacagcaattcatttagaaaaagacctaggaagttttgtatcttgtgattatagtatgaatcaacattgtattacagttaccaaaaaggctaactctgtcttacactgcattaatagaagcatattgtcatgaacaaagttaatacaagaacttggatcttttatactttttgctttatttttagatcttttaatttttatgggtacatagtaggggtgtgtgtgtgtgtgtgatacgggtatacaatgtgaaataatcacatcatggagaatggggtatccatcccccaaacaaatatcctttgtgttacaagcaatccaattacactgttttagttattaaatgtttctgtattttttagaggataactataatgtttggtttggttctgagtaaagtaaaagatttttagccagaatgttatagatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggtatatatggatgagtattttattagaagcttccttaggtcactgtgaaataatttaaaaagttaaagctagattttctgagtggcacttatttaagactaggaaacaattttattttttaggttgggaatattggaaagcagttatacaaaaactattcaaatggtatatttatggtatgcactgtttcttacattccatttaagagcatttcacaaggctttcattgtactaacaagagtgaatgacttgtccaccagactgaccaggcttttggaaatagtatttattgagggaaacacatggagacaagagcagcataggtgttttgcccggtagattctggggcagcacattgggatccagcagggccagaagtcaaattttagagctatcaggcttttaagttcagttatcaggggagaaggactagggtccaagccttataattactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttcggtgtttcttaaaagtatacaaatacattacctaataatcataagtgttatgtattgtttggatttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagtctcgctctgtcgcccagactggagtgcagtggcatgatctcggctcactgcaagctccgcctcctgggttcatgccattctcctgcctcagcctcccgagtagctgggactacaggcgcccgtcgtcacatccacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtagaagaaaaatttgaaaatggagaggtttgaaacaactaaaaagtaatgtttaggtatcaggatgatgggaaggcatctcatatttgttgaacatgctctgtgttatggactttgctatgcattttacatgtagtgtatcacagatctgagtttcagacttatcctaatagagttttctaatagattatgagttgtatgtaggtagtttcctttaagaaggatattcctacaaaagtaaatttagtggtccttatagttcattcattttggcaagaacaatatagctatatctctgtatatgcgagggattcattccaggatcccccatgtatgcctaaatttacgcgtactcaagtcaccaagttggccctgcagaacccacgtatatgaaaagtcagtcctctgtatatacagactttcacatcctgtgaatactgtttttctatctgcatttggttgaaaaatatgcaagtataagttcaaacccatgtttttcaagggtcaactgcatttatgttagttgattatgcagaagaaataaatataaattcaagtctccatttttatttgtttattgttttgttttttctttttgctaagggtgctactgaacaaggtcccatttttaaatcccataattatggtggtggtatgttctaagctttctaatttttttaatgtgactatttagaatttacttaatttttccatttataaaattaaagaatgtttaataatctggataaagtatgatactttaatgctgatggtattaaaacagtttttaagaactattttataaaattttacttggaaaagttatatataacctgtattttaaatttttctatttttagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttttgtttttgagacagagtcttactcttttgccaagactggagtgcagtggcatgatctcagttcactgaagcctctgtctcctgggttcaagcaattctcctgcctcagccacccaagtagctgggactacagctgcgcaccaccacacccagctaattttcatatttttagtagagacggggtttcaccatgttggccaggctggtctttaactcttgacctcaggtgatcttcccacctcagcctcccaaagtgctgggattacagatgtaagccaccttgccagaccataatttacttttgaattatgtttattatttaccagtcttctccagtatacatttttctctctttttttttttttggctgatgtatctctaatatattttgagtattcattaaatgtttgtcaaaagaaggagtcaagtaaggaaggatttaaaaagcttcgtttgttttataatcatttatatacatttccaaaattttttgaagcaacttatattaaaacatacatacaaattttttaagataaaaaagctgtggtcaccccacatttatgtatgtatttatttattttggatataagtaagggataagtaaccaaacttggtcaatattagataaacttcaagggaccttttttttttttagtttcctagttatctatattgaaccaagaaatggaacagcaagttccttagttgcttaggtggacctattcagaactggttgtaagtctgcagtctgaagggaaatggtgagcagaggactcctttcccaaagacagctggaacagaaataggcactccagaggttatggaatttgagagagatactcagcctctagccactcccattcaatctcccagcttagtcttctgagcattcttaatcttactattcttttcttaatgtattcaaaccaaaagacagcaatttttagagcctgaataggttttggagggaaaagtaattacgttcaacttcgattgaaactcttgcctcaagaatgaagaacagcaaaaattaaatcacagtttcttagctttttggttaaagatgtaagttaaattcttggccgggtgcggtggctaacgcctgtaatcccagcactttgggaggccaaggcgggtggatcacctgagatcaggagttcaagaccaacctggccaacatggtgaaaccccatctctactgggtgtggtggtgtgtgcctgtaatcccagctgtttgggaagctgagtcaggagaatcacttgaacccgggaggtggaggttgcagtgagccaagattgtaccactgcattccagcctgggcaacagagcaatatttcgtctcaaaaaaaaaaaaaaaaaaaaaaaagaattgtataaaacacacaaacaaagcaaggaaagaatgaagcaacaaagccagagatttactgaaaatgaaattatactccacagagtgggagtgggccctgagcaagtggctcaagggcctggttacagaattttctggggtttaaatacccttcagaggttttccattggttacttggtatacaccctatgtaaatgaagtagtggtctgtaatcagtctgattggttataggaggggaccaatcagaggtactttcaatttcttatctgccacagtaaaagggagggggttgcaaagggagtagcctcttgtccttttgttacttgagcatggaaagttggggttttccttttgatttcgttctaggaggtcagcatggattgaccttaggttccctgcctccagaccttattgccctgcctcatttacgttaggtttctttcttgtcaccttctaaaatattttttgttattaggaagtatgtttttgaacttccttatgcattaagtaaattagccatttatcactgtaattccttatttggaaagttgttatattcacccttaagacttcacaattctcattcatttaactaaagtgcaacatagcagacttattctttatatttagagaatttgtgtcttttgtgaagctacctgtctatagtgggaagtagattaatgaaaagtccaaatctgttggggagggttttattctactattgatgaaaggggatgtggatcgcagctagccttagaatttgggatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgacagatgcacatcactgcgcctggctaattttttatatttttggtagagacggggtttcactgtgttgcccaggctggtcttgaacttctggcctcgaatgattcccccgtgttggccaaccaaagtgctgggtctacaggcatgagccgccgtacccagcctcaccttttctttattgtgcgttattatctgtacaatttaatttggatgtgaatgtctctgagttgtatatgaacatcagagttgtttccctggcttgattgtaagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaagtactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaacaaaactttttaaaacgatgactgtattttttcccttaactctgttagggatttggatcctgctcctaatccacctcattttccatcgcatgtgattaaagcaacatttgcctatatcagcaattgtcataaaaccaagttaaaaagcattttagaaattctttccaaaagccctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctaggattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggtaaataacatatttagaccaatatataagcagtctttctatcctgttcttcctgtttttttgctttgttttgttttgttttgagacaaagactcactctgtccgcccaggctgggtgcagtcacggctcactgcatcctcaacctcctgggttcagattatccttcctcctcaccctgccgggtagctggggctacaggagcataccaccatgcctgactaattttttgtgttttttgtagaggtggggtttcaccatattgcccagggtggtctcaaactcctgggctcaagcgaactgtcagcctcagcctcccagtgtgctgggattacaggcatgagctactatgcccaacctatcctgttcttttaattgaaagtttatatgcttctaagaggtagataccagaatgttgctttctgaattttgctttttaagatgtctattatatttacttattagtttttaaaaattgcgctacttgcctgggaaacatagcagacctcgtttctactaaaaattttttaaaaaagaaaattagggcaaggtgtggtagctcacacctataatcccagcactttgggaggttgaggtaggtagattgcttgagcccaggagttagagaccagcctgggcaacatgatgtgaaaacccatctctacaaaaattttttaaaaaataagccagggattgtggcatgcacctgtagtctcacctactccagaggctgaggtgggaggatggcttgcgctcaggaggcagaggttacaggttacagtgagcaaagattgtgccactacactccagcctgggagacagagcgagactcttgtctcaaaaaaaaaaaaaaaaaaaaaaaaaaaaaaaattatccaagtatgatgatatgcgcctgtagttctagctacttaggaggctgaggtaggaggatggcttgagctcaagagtttgaggctgccagtgagccttgattgcaccactgcattcatgcctgggcaacagagtgagactttcactcaattaaaaaaaaaaaaaaaagcactacttctccaattctagaaatcttaagaaggatcttcaacattttaatactaatattctagctattgatggcctcaaataaatgttactatagaattggggttgttcggccgggtgtagtggctcacgcctgtaatcccagcactttgggaggctgaggcgggtggatcacaaggtcaggagatcgagaccatcctggctaacacagtgaaaccccgtgtctactaaaaatacaaaaaaattagccaggtgtggtggcaggtgcctgtagtcccagctactcaggaggctgaggcaggaaaatggccagaaccaggtaggcagatcttgcagtgagtctaattcgcaccactgcactccagcctgggcgacagagcaagactccgtctcaagaaaagaaagaaaaaacaaaaacaaaacaagaattggggttgttcaatttagcatctctgatcttttccattgattttaatgagatttctattttttaaggtcttttttattgtggtaaactatataacataaaattttttattttcgccattaaatggccagttcagtagcatcaattacatttccattgttgtgcaaccatcaccactgtctatgtccaaactttcattatctcaaactgaacctctctactcattccacaataactccacattcctcctccccactggccattgagaaactaatctattttctgtctcaatgaatttgcctattgtagatattttaatctagagttgtacaatatatgtccttttgtgtcttgccttgtgtggtcactgaaaactttgtaccttagcttgtgtttagatagtgtttgatagagatttccttggataccaagagtgttgggatgaggaagcatgagaggagaaaacttttcctagtgtttgcagattggctttatgctaggattcttcttcaacacttagccatgcttgcattgcttgggatcagccccaaatacaagcttagggtcttctctggtcttttctgagcaagagtcttatcttgagcatgtgtgtggctttctgaattccccctaatttgtgggtgcttttgaatatactaatttcccaaagaaatacgctccccagctactcctaggctttaggcagcctcttgtatgtctcaacagtaatcttttgccctatgcacctgcaggttgttggtctgccttacaaagtttcaagcaacacccatatcttttgtagctggtatgaagttaaacaaaacagagctacgcactttacatcagtccttggttccagacaggttagaatagacatatacaatagtttgcaactaatctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataattttttctttttaaattatatttaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggtaataaaaatttcatcatctactattttttattagagaacatagtagtacttttcaaaaatctgtaatgctctagcagtaaaaaatggaatcttttctttaattgtgattaaaaatatatacgtaggccaggcacattggctcatgcctataatctcagcactttgggaggctgaggcaggaggattgcctgagcccaggagttcaagaccagcctgggcaacatggcgaaaccccgtctctacaaaaaattagtcgggcatggtgatatgtgcttgtagaatcagctactcaggtagctgagatggaaggatcacctgagccctggaggtcaaggctgcaataagccaagattgctccactgcattccagcctggatgacagagtgagaccctgtctccaaaaaaaaaaaaaaaatatatatatatatatatatatatatgtgtgtgtatataaacacatacttgtgtgtgtgtaacgtgagatctacctacttaagaaataaaaaaatgaatcttaatgtatctctttgcattgaagccaaagtataaataacaaaacttcctggtaaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacatatttaagtatgttaagatgtaaagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgtaaaagaaaattttaattccttagagccagacatacaagttagtcttgtcttctagtccagtttacctgaatgaaagaaatatgtctcattttaatactttagtcatatgtgttatgtgtgtctatatatatgtaagtatgtatttgtaagtttttctagcttgcttgttaatttgatttgaaatgtacattattacagtatttgggaaactttctactttgtgttttgattttcatcttcctataccaattaatttcatatttcttttttttttttgaaacgaagtctcactctgtcgcccaggttggagtgcagtggcacagtctcagctcactgcaacctccacctcctgggttcaagtgattctcctgccccagcctcccaaggagcagggattacaggtgtgtgccaccatgcccagctaattttttgtatctttagtagagacggggtttcaccatgttgtccaggctggtcttgaactcctgacctcaagtgatccatctgcctcggcctcccaaagtgctgggattacaggcgtgagccaccacgcctggcctaatttcatatttctcttgtgttgtttttactctcagtactttttaaaatgaattttagttttgactatctgagcatagagtttctaatacatttgagatatataaaatgtatgtaaatagaaacaccattatttcttgtacttgtgttcttgagtattttatgggctagagatctgccttgtgcattacagccactagccatttggctatttaaatgaagtaaaattaaatgaaatttgaagttcagttttttcattggtactgaacacatatcaagttctcagtagtacatttggtcagtagtgatcattggacagtgtagattatagacatttccatcattgcagaaagttctgtgggacagtgctggtctaaactctaaatgttagatgttaaaaagccaagcaggctcccaaagtcccttctagctttagtgttgaatgattcttgtgcttctgtttgtgattttgctaaggtgttgacttatctgcacaatttgtttaagacattttattttctctgttgtcacatattgctaatcactttcaaaagaatctgttgtattaaggaagttcagattcattccctacatattttttgagctactcatgacttaaaaccttttttaaactttatagaagttttctagtcagataatttaatatatatgcaattataaacaaaagtgttgtcttcatgctagtttaaactaatttttaaaaaattatttctagataatccgcaagatgggattatggtgaaactagttgtcaatttgttgcagttatccaagatggcaataaaccacactggtgaaaaagaagttctaggtaaactacagtcatgcgctgcgtgacatttcagtcaactgcggatcacatataggacagattataatactgtatttttactgtatgttttctgttgcctgtagtattcagtatagtaacatgctatacaggtttgtagcctaggtgtgtagtaggctataccatctaggtttgtgtaagtatattctgtgatgttcacgcaatgacagaattgcccaatgacacatttctcagaacatatctgtgtcattaagcaaagcatgattgtattggcggaatgaatgtgagttatgcggtggtcatctttattatatgagtggttatctttattatatcttcaaaataagtgagggtttgtcatttgggatattggggaaatatgagatgctagctaagttacatgcctatttaattaaaatgtccctaaaaaggccccttttgtacttttcttccttaaatattcatataaaatgaaaagttagagatttacatatgtgtataacttaatttgaaaatgccttgtaaatatttaggaaagtcagaaatacttgtttttagagttaagttgcaaataaattgactgccgatatattttataaatacattataactgacaggtactcagtgtcttttgttatgtagcagacataagaatgaagacttggagggctagattaaacttaaataattaaaaaccattcaagtcctttcctacagccatttgaggggaaacctaatgtaaaataagaagccaacatcatctctagtttaggtgtttagatttagtgaccacgggatggagaaatcacctggttaaagtcagcttgaagctctcgtgatggtttttgtttctaattagaaaaataggaataagtagtgtttcacagattctactatctttcttcaacagccttaacttctcattaggagcctaatatctacagtacttccttttttgtagattttaaaaaattgagatatatcctaatatagaaaagtatacagatcaaaaatatctagcttgaagaatgtttgcagagtacgcttgtacatgtagcacccagactaaaaaacagaatcttaccagaactgtagaagttttctttaaccaacatacttacctccttgtccatagtggcactgcttttatggacagacctgatttacaacagaagccctaagtggctttcctgtgtagcataaaattaatgtggtttgttctcacagctttccccctaagatcaggaatgagacaaggctgtccactttcactactgctgttcaacagtgtactggaagttctagccagagcaattaaacaagaaaaagaaattaaaagcatgccaattagaaaggaagtaaaactatctgtatttacagacgacatgatcttatgtatggaaaatcccagagaatccacaagaaagctactgtagtgctaataaatgaatttagcaaagttgcagggtacaagatcaacacataattagtggtgtttgtatatactagcagtgcacaatccagaaagaattagaaaagcaattccatttacgatagcatctaaaagaaataaatagccaggaataaatttaatcaaagaggtgaaaaacttatatacattctgtttgttagacgtgagtcactaagtacagaccacactcaacgggagggaagttaggctctaccctttgaaagaagggctctcaaaaaatttgtgaacatattttagtaaataccatcatgatggaaagagcacgaagagccctctgggttgctgaaaatgtcctgtcttcatctggttagggagaacacaggcagaaaaaaatgtgtatttgtatgtataaattttcattgaactgtgtgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccgcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattggtgagtatttattgataccttatatgtaatctcaatatgacattcatggagaatgatacttcacacaaatagatattctcagtaactaaagctttgtccttttttaaatctcagtgtctttatgaaaattcttatatttttattaattcacataattatttaccctactatgtgccagacacttgatataatggtgaacattccagacaaggtccctgttaaaattttagtgggactagacaaataaacgataaataagaaaaatgccagatggttctacacagaaaattaagataggggaatataaagggagatgttttaggctcttgtcagtatcagaggtgccactctcctctaagcgaggccttattttgatccttttaaaataagtcgtaaagcagagaggttgttttataatcctagaagtcttaagctaatcagacagggtcttctattacttattctctgtgcaaagcagaattgcaccacatatcaaaatttcaactggttggttgagattacttttgcgtgcatgctctttctctctcttatttatttgttgattgattgattggtatctttgagtactccatcaccaccatatttgatggtagcctcaaagggttttcctcacaaccaggcacctttctaagataaatacgtgttttgatttttttctgtacttcccttcctccttctcttgaggaataaatgattggcaataatgtctaactgccatgtttccgttattgatttaatgtacctgtatatttctttcttttgttgttgtttttgtttcattaaacaaatttgtatggtttctttccaaacattttattataaaaagtttcaaacatacagcacaatggaaataattttatagtaaacacccatatgcttatcatatagtatctatattttatgctgtccttgcttaatcacttctagccatccgtctatccttgtgttaacatgtattaattcatctctctctttttttttttttttttttttgagacagggtctcgctctatcacccaggctggagcgcagtggcatgataatacatcatagatcatagctgactgtaaccccaaattcttgggctcaagcagtcctcctgcctcagcctcctaatgtgcaaagtttatgtgcttgagccacaccacactcagccagttcatctcattttttaaatgtatatcaaggtatatcaagcacagtttttgaagagagtgccacagaaaatttgcgagcattaaatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtgaaatataggaagacccatagatttctccctttttccatgttgatatcgtaataaggttccactgtaagtattctgtgaagcatgtttaagaacacttgttccttccttagtctaagcattcctctttactatcttcttttcataaagtgactgagaaatacacagtttagttttcaccaatttaatttcagggcagaaacccaacattgaagcagtactttcagtgcatcataaatataattttagtgttagtaaaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataccaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatactacaccgcactcataccaattcagcagagtggtaccctgaacacacatacagcttatttctcattagtgaacaaagctaagatttttataaagttttacctttgagccagaaaataaaatgttccaaatatacatatgtacacaccccatttgtggtactttaaattctctagctctaaaactggtgttttgccttgtctttggtttgaaaaagaaaaagggtgcaattagtaatctataacctgtcttatgtgtgtgaagtatgatgaatatgatggatatggagtgtaatgattcattcatatgttaaatatggagtgcggtgaatagcaaaagtaaagctgaatactgttttaatgtgccagatgtattggagcacttttctgctctttggaatataccacaaataattacccaaattttatgcccagaagttgggcttattaaaaaataaacatttttaacatgactgttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttggccgggcacagtggctcacgcctgtaatgccagcactttgggatgccaaggttggtggatcacttcaggtcaggagttcaagaccagcctggccaacgtggtgaaaccccgtccctactaaaaatacaaaaattagccgggcatggtggcaggcgcctataattgcagctacttgggaggctgaggcaggagaatcacttgaactcaggaggtagaggctcctgaggctcactagccaagattacaccactgcattccagactgaacgacacagcgagactgtctaaaaaaagaaaaaaaaccctttgtataactataattaacatttagtgtatatccttctaattgtttaaaacaaaaattgaactgtactttatttactcttataacctactttccttctatgacatataatgggtatttctcatgccaagagcataatagcaaaagaaattccaccaagggttgggtatgtataatacatatatgcatgcttgaaggctcattatgggtcagttttttaaacctaaattttataaaaggatacaaaattcacagatctttattgttaactgtctttattatatattattaatgtgttttatatgcaaacataaagctaggtgcaaattcacttgttgtacttaaagaccaatcaattctaatacaaatgttgatttaatgtgatattttgccacaactaatctgctcctcccaatccttccagtcacttcagcaaaggttgtgattactcagttcttccaattgtttcttttagttttactgctacaaccttcatttgacatgactctaatgtcatttagacttcagtttgctatgctttatattttatgtattttattttctgttggctaacagcaattacaaatctactatttggaaaaatataaattataaacatagacatagatgcccatcctgtgatcctactagattataggctgttctctaaatgatctagaatgtgcttatatgaattttccttaggccactgaaatgaaaatcctaaaataaaaattctcatagaggctttgtaaactatctaaaatgtatctcttatctttaattgggaaaatacaggtataagtgatttaagcatttaaaactttaatatgtaatttacagtactattaaaaacaatttttattacatagtttaaggtaatcattgtttatgataatctggtaatttgttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcccttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattactcttctttcagatatcactttttcttttttcttttttttttttctttttttctcttgagacagagtctcgctgtgtcacccaggctggagtgcagtggtgcaatctcggctcactgcaacctctgcccctcaggatcaagcaattcccgtgcctcagcctcctgaatagctgggattacagatgtgtgccagcatgccctgctaatttttgtgtttttaatagagatagggtttcaccatgttggccaggctggtctcaaacttggcctcaagtgatccgtccgcatcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtgtggtctgacatgatctgtcttgttcatgcttatatactgaggacctagcacataaaagatcttattgaatcaattaattagtcctcctttgaaataaaatataaattacaatgtaagttctcactttttttaagataacagtttcttttaaaagcaaaagaaatcctattaaattccttcagaaccaattttgtgttaggtactgcccaccagaaccttatagcatagtgggagacagacacataaacaagaaggaagaaggtgtgtaagcaagaatgcctgggactgaggggagatatttttgtttgtcagagtcagagcactttttccgatgctgtttggataaaaaatcacaaagaacaatgcttgctgttgtggactacatgagaagacaaaagaggtaatgtaatgagtgttgcttcttacgtttaggatctagagtgtaacttgttaactatcggctgaattttaacatgattattttaggtgaaggtgttgcaaagtgttatatttaatttgtgtgatatttatatctccttgcagtaatccatattcaggatagcagtttggttaaatcagtgtcaagaactctcaattctagtaccagctgtaccagtaaccatgttacctttgttaaattatgcagccttcttggctccaatttatttcatctatgttagggataggagcaagtgtttttccaagttacatttagctgtattacccctctttttacttttctctttgctttagttctaagaagtaaatagagttgtgtaaatgtcttctttatgtatctttattttaagatgtaagtttctttactgtgtgcagtggtctcaaaatctgtggcaatactgtgctgtgacaatgtttattttcttgtttctggtaaattgttttatagtatagtatctttgttcctgttatttctcatgagatttttaacagtgcatacagaaattgctagaatggatggtctgactgatgagtactgcttgagagttgaccagaactctgaagaaatagtgtagtaggcctataatttgaataggtaggaatcgatgtctcataagtgtgtatggtggtggtaggggtggttggtaaagaatgagagggagaggtgagtgaaaaatgaaatgtttttaagcctaaatgcattaatatcttaaaaaattaattcctatgtagtcttaaaccattcttcttctctagtagaaaaagaagttttatgcttttcagtgtctttgcttctggttattttaccttagagttttataccagattatcttctgaggaggcctatcagaagctttaatgtagtggagagcatttgttttcttggtgttgggaggcagttttacctttgagtcattcatttcagacttaccattggggtagaatggtgttgacattagcaggagttggagaagataaaaattcttcatattccattttaatgctgaataagatcctgaagaatattcctggagaaagtatgaatgggatatagaaaaacgggtaaagacatgcattcaagtccaagcttgtgctgtgtaaaaattacttgttatcctgtacagtatgttgggcaaaaacaaagaacaacaataaaacaacaacaacaaaaaaattgcttgctgtctttgaacctcagtcttatcatctttcaaaatcagaataatgtctgtagtgtcttcctttccatggggaaattatttcacttctctgaacttaacattcatcggaaaattaactttagttgagtgcttgctgtgtagtagggtgtgccttattcatcagctttgcaggcattatttaattgttgcacccattctccaaggtccatgttgttccagcatttgcaagtaaggaaactaggaaactgaggtttaagaagttaagttgctgaagatcacacagctggtagtaggcaatatagctagatttgaacctacctgtattgtacttcaacactagtgctcttaagcactaccatgtcccatctctacaatgctagttttgaaaaagatactatctatggtccctttcaatcttgacctacctattaacacagtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaagaaaaaccaaaaagattaattaaataggactcttcagccatgttatcttataatgtttataggtatatattggggaaatgtggtttttgggaatttgtaattttctgttaagcagtcactaccattgtattctatatcaacatgcttttattttgatattgaagtttaaaaaagtgaatgacattatatctcatttttctttagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaaggtaatggaatttagaatttttggtttttaaaattaatgttggcattgtctcaataagggtatatagtaaagatttattttgcctcctgttccccatttaaaagatattttagatagaaattttgttttaaagtgaaattataataaatttttaaaaaggaatatgtaattcctgttctgaaataataggaatgcttattacttaggtattataaaaatttaacagatagcaaattcctataggacagagtccatacttaattttctgtatattccccataatagccctagcattgagaacttaatttaagggtgataaatatttttcaaatgattaaattatttcctaacttcagtcagattagatttaccactaatttctaaactattcaagattcattttggatataaaatatccaaaattataatccaaaatggctataatgtgactgatttatttctgtgactaattaagtttcatttctttatctacctatatttctagtgaatttaattcgctttcctctgactgagttagaactgtcataagaatctaataaatatactcctagatcatggggaagaacaaaaaataagaaagtaagagtaaaaaataaagtaaaacactttattatcccaactgctcttttcaaatgtttgttcgtttgaaatggcctgggtctcattatttcgcccaggctgtggtgcagtggtgcgatcatagctcactgtagccttgatcttccgggctcaagtgatcctcctgcctcagcctccaagtagctgggactataggcacacaccactgcatccaactcattttttttaatttttatttttaatagagacaagatcttgctatgttgctcaggctggtcccaagctcctacgttcaagcagtcctcccacctcagcctttcaaagtgctgggattacaagcatgagccgctgcacctggtcccaaattgttttttaaagcggttatacccatttgtgtacagaaatgtagttgataaggaagtggatcggtaggaagccttatatttgaagaagggagccaaagtataactgttcctagtttagttaaaaaagtaaagaaggttgggcacagtggctcacgcatgtaatcccagcactttgggaggccaaagtgagaggattacttgtgaccaggagactgagaccagcttgggcaacatagtgagacctcagctctactaaaaataaaaataaatcagctgggcatagtggcctgcacatgtagtcccagcaactcaggaggctgagggaggaggatcgcttgagcccaggagggagaggctgcagtgagccatgattgtgccactgcactccagcctaggcgacagagcgagaccctatctcataaacaaaaaaaaaaaaattaagaaactggaatatgtatataggtaaatattagaggcagtatcacttatgatagtatttattttatgtactagattattactgttatagacaccacagctgtcatggttttagaattgaagttacttacagaactgaatgttatatgtataaaatgcataaagttaaggccttgaagtaggcaaatctgagttctaatcctgactgtcaaactttctagttttatagtcttggtttaagtggatcctactgatctacttccttttcaatagttaatatcagatgtcttaaatttatatctgttaagtattaaattctgtcttattgtggtctttatttgtgtgtctgtaattattgattgggttgaatttcaggtgaaaccactgacagagtatatagtacctgaattggatggcatctgctctatttttaaacaatccaatctctttataaataatcatatttttgcatataggcttcccatatgtagattattcttaaaatataattttcattcacaaattccttttccatcctaggtataaatggtattatgttttaaagtataagtgatttattctgttttgtttgccaccttcattagtttttttctgtcaaagtctatagtatatgtattcaggagcttccaaatagtatgttctcattaaaagaggtgttcttgtgacaaacagaagtcttgcatttgaagaaggaagccagagtacaactatttctagcttgagtgaaaaaagtaaagaagaaactggaataagtttacaggtaaatattagaggctctattatttatgacagtatttatctcatactttgggttattttgttatagacactgtacagatgccatgtgatttttaaactgaatttacttactggactaagcatcatatatataaaattatggtctgaagcttaagccttagagtagacagacttgagttctaatactgactctgccacttcttgagttccttatctgaaagacgaaggtaaaaccacctgtctcagagtttatgccatgcattttctgccatagcaccctgttcatttcctttatagcacttagggtttataattatatatttatttgtttgcttgtttattgtatgttacagaagaagcagattgcctcttctataaatttcttgatatccattcttaaattggctcatgttactgtctgggatgcttgccgaatttctttggtcaactcattcctccacaatgacaatttcagcttctccattctgcttaaacctctcatcttctcttctatgccgctgctttcagcctgcctcctacttggagaaaatagaaggcatagagaggaaatctcgccacatcccactctcaaacattgaaatctcctggcatctcctcctttaataatcttccgtcatgttacagaaacagtttatccttctatttgagactaattcttcctgtgctttgtttttttatctgctctttctcaggtgctttattttttaatatgctgttctccctctgaactatgttctgaacattttaaaacctctcctgtttaaaaattccctttctcacaaagacaaaataatttccctcttccctatgttctcttttaggtatcaccctctctcttccttcctctcacagacaaactttgtgaaagagttgtccatatttgctgtctgcatttcccccccttccatttattccagtaaaatagcacttgctaatgtctctcataaacttcatgttgctaagtctggtggtcacctttcattcttccttttccttaatgttttattaatacttcacatcatcaaccatgccttgcttgaactgtgttctgtttacctttttgatccactctcctgatttttctcctttcacttttgccttcttcataggctcctcctctctactgagtttttggaatatcgtgtgtgtactaagcactgtgctaagcatgggtactgaacttttctactctgaggacttgatttcacgttatgaatagaaacatttgagttggaactatagaattatgccaatataaatgaatttgtgtgtagaaaatatttcacagagcaagcaccatataggcagttcaattgcttgatcaattttctatgcagtatagttcctagttttttctattttattttttttatgttttcatttttatttaactgagattgttttaaacagaatatatcttttctgtgtaaattttacaacaaagatttcagtaaccaaactactttatccatatcaaattttaccaattccaatacagttttgtgctatttttcaaagaaaaatccacgacctttattcttaccaaattgagttttcaagagtcagactttgtaggactgtattttctaatgtacagtttttttgtttttttttccagacaggatctggctctgttgcccaggctggagtgcagtggtgcagtcataacacactgcaagctctgcctcccaggctcaagccatcctccaacctcagcctcacaagtagctgggactacaggcatgccccaccatctccagctaatttttgtagagatgggtttagccatgttgcccaggccgatcttgaattcctgagctcaagcagtctgcctgccttggctacccaaagtactgggattaaagatgtgagccactgcacccagcccatgtacagttttaggtgttgacaagattgtttggttttgtttgtgtgatttttttttttttatgtgatataagcctggtaggtcggtacttatttcttatctaattcatgaaattgtaggcaattcttctcgggtagactacagtcctcctgttgtctaggaccagtctactgtgttgctgatccaaatcattagtatatacagttgacccttgaacagtgtaagggttagaggtgctaaccccctgtgctattaaaaatcagggtaaaactaaattagtagtcaaaagttaactactaatagtctactgttgaccagaagccctaccgatgatataaacaacacaattttgtatatgtattatatactgtattcttaaataaagtagcttgagaaaagaaaatgttattgagaaaatgataaggaagagaaaatgcatttacagaactgtactgtgtttatcaataccgtaagtttatatcatctgtttacaaagaatcatctgtctgaaattgtaggcaaccactgctggttgatatgtactttaggcctcaatctacagaatgtatcaaacaattcacctttttcttgtaatggcatgacttttctctgcatcttggaagcacctccagccactgtggtgttaatcaaggcttatagtattgcagtaaacacagtgaaaaaatacatgagaacctggagagattacttttcatttctggatacaatttactagagaaatgaactgctcatgtggaaattattagtgtcacatggcattttaagcagatactcacaacacaataatgcttaccacagtagcaactgaggtagctgcaaaattattacaatagtacaatatgtacgatagttaatcttatgcaattatgatttaatactgcatctttacatttgtttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggattaaaaaaatgtttttggccaggcgtggtggcttgcgcctgtaatcccagcactttgggaggccgaggcgagcagatcacgaggtcaggaggtccagaccatcctggctaacacggtgaaaccccgtctctactaaaaatacaaaaaaaaaaaaaaaaaaaaaaattagccgggtgtggtggcgggtgcctgtaggcccagctacttgggaggctgaggcaggagaatggcgtgaacctgggaggcagaggttgcagtgagccgagatcgcgccactgcactccagcctgggcaatagagcgagactccatctcaaaaataaataaataaataaattttagagataaggtgtcaccctgttactgatgctggagtgcattagcgtgatcatagttcactgcagccttgacctccctggctcaagggcacctctcgcttcagccacccaagtagctggggctacaggtacacactaccatacccagctatttaaaaaaaaaaaaaaaattgtagagacaggtcttggtttgttgtccaggctggtctcaaactcctgggctcaagtgatcctcctgcctcagcctcccaaagtgctgagattacaggcatgagccaccacacccagctgatattttgggattttaaatgatattgtgaactaaaatttgtctaagttaatttgtatctttgctgtttttttctctggttttctgttgatatctttgattacttaacttaaaaacaaaataactcctgtttaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcaggtaagaaatttgacttgaattttttttttttgcctctctcctcattctaaacaacaactgtttttctcttctatgaatataacaggagttgttttatatatatatatatatatatatatatatacacacacacacacacacacacacacactatatatatatacataccatatatatagtgtgtatgtgtgtatatatatataaaaaaatatatagtagatgttgcaagctatagatagccctaaatccttcagtaagatagcaataagcagttaatgcacctaggcttgaattttactctcttattccattaggacaacttcaccccacccctaaatatttctaaaaacagaaatatgaaaagggttttcgaaatgagtatcatctcgcatagtttgttggactgaggcatgccaagaaaagtataggcattcctctttctacttcctgctacaaacattttagtcagtaagatagcacttatattggctggaggatccacaaaggactgcttatctttatttatgaaatattttcttttattaaaaaataatacggccaggcacggtggctcatgcctataatcctagcactttgggaggccaaggcgggtggatcgcctgagctcaggagtttgagaccagcctgggaaacacggtgaaaccctttctctactaaaatacaaaaaattagccaggcgtggcagcatgcgcctgtagtcccagctacttgggagcctgaggcaggagaattgctagaacacgggagacggaggttgcagtgagctgagatagcaccactgcactccagcctggacaacagagcgagactctgtctctaaaaaaataaataaaataaaaaaaataatatgcctactcagggctgggcacagtgtggtggctcacacctgtaatcccagcacttggagagctgaggcagatggatcacttgagatcaggagtttgagaccagccgggccaacatggtgaaactccatctctactaaaaatgcaaaaattagctgggtgtgctggagcatgcctgtaatccaagctactcgggaggctgaggcaggagaatgcttgaacttgggaagcagaggttgcagtgagccaagattgcaccactgcaccccagcctgggcgacagagtgagactctgtctcaaaaaaacaaaaaaaacactcagttacccaggaagataacatttataatctgtatataaggtcaccatgttttctgaatgaaaagccaagcacctaatctaataaaggatttcatatttatgtaaagttttttgataatgtaaaccctaaaaaattaattatgtttaagtatgttttgttgcctttgtagaaaaaaaaaattattggccgagcgcggtggctcatgcctataatcccagcactttggaaggctgaggagggtggatcacatgaggttaggaattcaagacaagcttgggcaacatggtgaaaccccatctctacaaaaaaatacaaaagttagctgggcaaggtagcatgcatctgtagtcccagctgcttgggaggctgaggtgaggggatcccttgagcccaggaggtggaggttgcagtgagccgagatcatgccactgcactccatcctaggcaacagagtgagactctgtctcaaaaaataataattattggaatgcctttcaaatatttcagactgtaagactgctataaaattagagatatatcctcatattttaaaaaccttttcctgtgcgagttgattcttgcttgcctctgtaaatcaatatatactattcttctccttcctcttgtatttcagctacacagacctctctgtgttttcttgtcaggccaagctgtttctatccaagggccttagatgtatcttctccttttcccccagttaccatgcgggtggcttcttttcattcggaccctagttaaataataatgtatcttcagagaggcctttcttgattacccattctataatagccatctagccattttgttttgttaccctgttttaattctctgcatgtcccttgttactttccaatacttatttattgtctgttcctccaaaccagcacataaattccatgagagtaaagacctgatctgacttgtccacttgtgaattccccttgtgcctagtgcctggcacataataggtatttattgaataaataaatgaaagtagagcatatttagaaccaggcagagtatctgagtaatttcctttttttctgcttaaagaatttaaatgactcataaaatttgtatttcttaccaaaaattctagaaatgcattttttagaatggagaaatgttaatttaaaaattttgtcctttggtgaagctatttatacatgtatatcttagggttctgtttttaagtatatttttttctttgacttatctcacagcaaagaagtagaaggaaccagttaccatgaatcattgtacaatgctctacaatctctaagagacagagaattctctacattttatgaaagtctcaaatatgccaggtattatgaaaagacaaagttactgtattttaacatttaatgtcatggcttcttttctgaaaacttgagaaacaattttaatgtaaggatttgcattgatgaagagataaagacttggtggctgtgatcagatgtttccttgtaattctctgccctccttcaaaacaaattgtttctgggattccaggttcattctttaccctgacccttcaagaaagttttggtgattccctctttgttctcttcctatacaagtatcctgagaattatatcttgtctcttttggtaattgtatggcatttagtgttctaatttataaaattgtaactcacggttaatacttacaaacttgttttgaggcacaaatgtgatgaggcatgaggaaataattataatggggtaaacaaatgcagcatttttaaagccgtagtgacttaataaatcctatgtttatcacagaaataaaatttactatcatttaagtgcctatgatatgctagccactgttagactcttttcatatgtattctctaatcatgacaataactatggatgtgaaaaaaggcttagagaagtccagtaacatgcccaaagttacacagctataagtgacagaactgcaatttagatctaggtctgtgtgattccaaggtttacagttgatccttgaaccacttggaggttaggagtgctgagcccctcctcctcacacatttgaaaatgtgagtattactttgactcctcaaaagcttaactactaatagcttactgttaaccagaagccttaccaataacataagcagtagattaacacatattttgtataagtattataataccatattcttacaataaagtaagctagagaaaagaaaatgttattgaaaattataaggaagagaacatatatttactagtaagtggaagtgggtcatcataaaggtcttcatccttgccaccttcatgttgagtaggataaggaggaagggttggtcttgctatctcaggggtggcaaggtgggagaaactctgagtgtaagtggaccatgcatttaaatttgtgttgttcaagggtcagttgtattttgtttccactgctattttgtattcactgttgcttgttagtattattagatcagtagcaaagcctatgatgagaactctttaacaacaaatttaaacatttatttccctgaaaacctcttctttattttcagagtgtcttttcttttttgctactagagtaaaagaagtggaagagatgtgtaagcgcagccttgagtctgtgtattcgctctatcccacacttagcaggttgcaggccattggagagctggaaagcattggggagcttttctcaaggtatgtaattcgtatgactttgttatcctaaagtgcagcttttctgttaccaatagtgactttaaaaaataaaaactataggccgggcacggtggctcatgcctgtaatcctagcactttagaaggctgaagtgggtggatcacttgaggtcaggagttcaagaccagcctggccaacatggtgaaaccctatctctactaaaaatacaaaaattagccaggtatggtggtgggcgcctgtaatctcagctattcaggaggctgaggcaggaaaattgcttgaacccagcacaacaggcagaggttgtggtgagccgagattgcgccatggattccagcctgggcaacagagcgagactctgtctcaaaaaaaaaaaaaactatgtagagaccaaatgtgtgtgtttctttccttttatcaagatataagttgattagccctagtgaattgtgcttttattaaacattttccaaaatagtcattgtaaaaatttaagttttaaaaattcagcttaagtgtgcttttctctttataactttttccctggcctaccaagataaaattgtttcctcatgtttttgcatagcatgataacactccattcagttttagcactacattgtattactgtcattttatctctgccttgctaaactagaagctcccttaaaagtgggaaccattctattgtttattgttgtatacctagtgtttttgttttgttttcttttttttctttttatgtttttttgagaccaagtctcgctctgttgcccaggctggagtgtcatggtataatctcagctcactgcagtctccacctcccaggttcaagcgattctcctgcctcagcctcccgagtagctgggattataggtgccccgacaatgcctggctaatttttctacttttaatagagacggggtttcgccttgttggtcagcctggcctcgaactcctgacctcaggtgatccacccgcttcagcctcccaaagtgctgggattgcaggcgttagccaccatgcccggcccccaatgttttctcttctggtgactgataattatgtttagtaaacattcagtggatagtggatgtcagttaatttgtaaaaggtgttcagaaggaattgcttcttataatggtgagagggaaatgatccagggattttggaagatgaaatagtatagttactcaggatgctgtagatctaaattctttccttttatcaagatataagttgattagccctagagaattgtgcttttattaaacattttccaaaatagtcactgtaaaaattcaagtttaaaaaattcagcttaaaagtgcttttctctttataactttttccctggcccacccagataaaattgtttcctcatgtttttgcacagcatgttacactccattcggttttagcactgcattgcattactgtcattttatctctgccttgctactagataaaagaagtggaagagttgtgtaagggcagccttgagtctggcaggatgacaaagtaaagtgttttgggtcctcagtttcctcatttctaaagtcagggatttgtattcgatggtctctaaagccccttttagccctgctattttgaattactattattattatacgagggaagaaagaggatataaatgactaaggtcactctacctttatgcaaaaataaaatttggaatatgttttggaagtagaaaagagaaggaaattttagagtcagaagaaaataataatagttttttcaaaatgacatagcagaagacatacatattaatgtggcttaggaggaaaataaaggaacaaaagtcttttctgctttcattcataagtacattggcagtacttactgccagaaatcaagaaatttttcctctgaatgaaagattatcctgctgaaaagagtacagaattctttaagaaacagtgaatagaatggtagtaaccagaggcagggaagggtgttgtggagggagaggatgaagaggggctggttaatgagtgaaaaaacacaggtaaatagaagaaataagatctagtgtttgatagcacaatagggcaactgtagttaacagtaatttactgtatatttttaaatagctacaaaagaagatttggaatgtttccaacacaaatgataaatgtttgagatcatggatatctcaattacccaaatttgatcattacacattgtatgcttgtatcaaaatatcacacgtacctcataaatatgtacaactattatgtatccataaaaattaaaaataaattttaaaaagaaacacctaaagaataatctggctgtttctttggtagagaaataggaagaagagaagcagagggaaggttggatgaactggtgcacaaatgcttatgctctcagattacattccattcatatacatcaaccaaaacattaaataataacaaactaaatgcagaagcagagataagaattcatctcgttctgttaatccagacattaaagagatttgcaaaaatgcaaaacagtgccatgctcactaagttttgttttgttttgggaagtatacagttgaaattctttatctacaggtttccatctatggattcaaccaaccgcagatcaaaaatatttgaaaaaaaattttaaagaatagggtataacacttatttacatagcatttacattatagtaggtataatatgtaattagagatttatgtataacctgtgcacattctcctattacacgtaatctagaggttatgtgtaatactttttggaaatgtttaataaaagcacaatctagaggttacgtgtaataggaaaatgccctgccattttaaataagggactttgaacatcagcattatcaaggtgtcttggaaccaattttctgcagatacagagaaactactgtagttatttttcctaaaaattgttatttatgatatatagtagatttattatttttgaataaattaatacattttagatttttctcagtctttctaatatgatatcatatctaatatcagtagatatggtccaacgatcgaaagttctttggggtcttcaataatttgtttgattgtaaaggagttccgcaaaaagtttgagacctgctgtggtagggtcatttagagaggaattgaagttttggttcctagcatttttgttactgttccttccctatcaagcaactaaaagagctttcatttcttagtcatcactttgtcatcttactctccctgcttcctctttcttatttctttcaataaatgtccctgaaggattgggtagtatttcatagttcagttatttgggaaggatactattcatataaactaattgtgcaatatgccttttctgttcctttaataatgttggtaaatgaaacctttgccagatgccagcttttccttcactggattgtgatttttttgacagctataattatgcatcaagtcatccccagtagggggtccctcatttccttgctgacatgtcctcattactacaggcagtattgaagcaggactaaagatggaggcattctttatgataggtctgatgaatatgttcttgtttcagaagagtatttagaagggctgctttttgtaatgtcagagtattaaaaattttttttgatgtttgtcatctgtgacctctctgctaataactcttaagagctctgaccgcatagcattttgtagttttctaaattttgatccatatgtaggattatttacaagttctagtcttgtcactacaaaagttcctttgtattattataatattatatcgtaagttccagaacttacatagttttttttttttttttttcatttctcttgcttacatgaactctatgtcgtggcattcagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcaggtaaatacaatttaaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtcattttcatttcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcggtttgttttttttattggctggattagtgttttactgttatttaaaaaaacacaaatgtactttaaaatatttttaataacaattttattagagccttgaaattagtaatttattaacaagatattgtaaaactagtcttgaaaattaatttgtaaatgaagtttagaaactttttcctatatatcacaattctatcagtccatcatgtggtcgattcatttaatatatcccagtattaagcctttaacttcctatagaattcaagaaaggtatgtgggaaatgaatgaaatagctactctaaatttgaaatgacaagtgaaaaaagggaagaggaaatgaatgagagaactaaattagaaaataaaagcaagttgggacaattaggttgtcaatccaaatgctttgaaaatatcacatctaatattttatctaacattacctgttggtttttgcaaacttatgttgctacttcagctgtaaacccagcatacacactggataaagtagaggcattggtgtccccaaggtttgtctacagtggtgtcccacagacatgtacctgcttagtgaatatcagctcactgtgctttattatttatttatttatttattttttgagacggagtcttgctctgtcacccaggctggagtgcagtggtacgacatcggctcaccgcaacctccacctccctggttcaagcaattcccctgcctcagcctcccttgtagctgggattacaggcacatgccaccatgcccagctaatttttttgtatttttagtagagatggggtttcaccatgttggcaagactggtctcgaactcctgagctcaggcaatctacccgccttgtcctctgaaagtgctgggattacaggcgtgagccaccacgcccggcctttactgtactttttgatgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctatctagaaaaggtaagatttttggagcaacccttaagatagttacttagcatgaatatgcttcatcttttcatcaagatcaatatatttccaaagcaaataaaagtatggttttatttttctatatattattactgttgtagctctgtatagtctctagggtggagtgaaacattgttacaaaacaaagcagccaattttgaaagtaagcccaagtatagtatctcttcttcctccttcctacctccactaccagctaccctttcagcaggttgcttctgatcatttcttcatttatgcatctacaaaaataactgattaagaataggcaagtcagcccttgctcttcattagcccagccacccacaagtaaaggcttcaatatactagcccctttgactttcctgtttctccctcttattcctttagattcactaattttggaaatagttacctcactaaataagtgtaacatgaaacacatgatgcgattgtctttcttttcttttcttttctttgagatgaagtctctctctgtcgcccaagctggagtgcagtggcgcaatctcggctcactgcaacctctgcctcctgggttcaagcgattctcctgcctcagcttcccaagtagctgggactacaggagtgtgccaccacacccggctaatattttttatttttagtagagacggtttcgccacattggccagtctggtctcgaactcctgacctcaagtgatccacctgcctcggcctcccaaagtgctggcattacaggcttgagccaccacacccagcctgattgtctttaaattttataaagttctctgtttttgcagagttctttacaagtattagctgtctgggttatttctacactgtcaaagttgttttgaaaagtcaagaaaataccatagttcagggctgtccaatcttttggcttccctgggccacattgcaagaagaattgccttgggccacacataaaatatactaacattaatgatagctaatgagcttaaaaaaaatcacaaaagaaatctcataatgttttaagaaaatgtacgaatttgtgttgggccacattcaaagccgtcctgggccacatgcggcccatgggccgtgggttggacaagtttgcaatagttcatataatttagctagcttttatatgtatataagttaaattttagtgtattaccttaatttgagtgattctttagatgtatttagtatttgtaaatataatttaaattggttgtgttttcttgaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtttttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtcttggtcctactgtagttaatcacaaattagtatgtaagatattgacgtgttcttttgtgaataattcatgctctgcttctaagttcattgtggagaatatagatattagctttctgttttgcttttttggtttgtttgttggtatcatagtggaaaaggagatagatattgaaattaattacaaaagttacctattttgatgtaattaaatccctttatttaagcctgtcttgaatctgtatattttagtgtaagcagaggtgtaagttagctaaatagcttggggagagtcccctttgtcctttgatgcttaggaaggtgtgtgaattgcacagttaagacaaaagtaagtttattccctttataatccttagaagtttgcttttttccctgggataaaaacccaacttttttcattaaatgttgtatatcatgtgtgattttgtagttctgttaaagttcatggcttttgtgttttaccttaattattctatgcaagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaaggcaagtgttactcagcccaatattctaccctgtgcttgaaaaacttagacataagccccttgatgtcaggaatcgtgtatacctctttgtattcctagcacttggtccagtgctctacacataagtagcattttgtagttttctaaactttgatccatatttaggattatttacaagttctagtcttgtttctacaaaagttcctttgtattatataagctgacaagctgtaaatgatgcaagtttgtgtggaggtgatagaatttagcttggtcctatgtctttgcagttaccataggagagggtctagaatggggcattagattggaggatttagaaagcagttaaagatgatgtgatcacaggtgggttttccccctgctgcagaaatatgggatttttacaataaattacttttgtaagtagagaaaatatatttttcagaaaatgtcaagacagcagtattgtataagtttttctttgaaaaccttagattatagtgatgacacctaatattaaatttaagttgacaagctatatattgttagtcaatttgaaggttagagataaaatgtttctcctgcaggaaaataataagactcataatagatacagtcaatctctgctgtagtatacactaaatattacttttggcctatggggaaaagcaattacttcattttattgtacactgacttctcaggaatcaagatcacagtcacactcagatcacatttgtcttccttagattttttggaatataaacagtaccaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcaacattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataattacaagctgctatataatctttggttttgtgactagtctctaagtatgcttctaagtatctccccatactttaataattgtatttttttctattcagaatcatatcttcaagtttaaattcttattacttgaaaacgaatgggacttcacatattgtttctctaagcaaacagaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgtttatacttttattaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaaggtgagccttcccttctctggcttagcccttagagttttagtgatgaaaatttttagttcatattttctttctgctttatttgggattttgtctttattttgaatacttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtatttattaatgttaattatagttaggtgtttcttatagtcaactgaagtattttttccttttttttctactcaacaatatgtcacagaaatctttctcattttttaacagctgcattgtgtgtatgtatgtagttttttatacaagtccttatcgatgggcatttgtgttgttttcagtcttttgctgctacaaacaacgctgtattgtagtgaataaccttgaacatacaaatttcatacatgcgcaggcaaatttgtagcatggatttccaaaagttggattgctgggttagaggatacatgcatctgtaatctggtacatattgccaaattactctcaatgggagtgtacccacttacatttcctctagctatttgcctgagaagacaatcctcagtcacattctatgagctgatcatctttgactcttatattaattattcatttaaccagtttagaaataacaataaatccttattttgaagggcctattttccataggtttgtcttttgtgatttcattcctgtacctcatttttaaactttctccttctataaatgttgtaacagggactatgggtgacatgtgcttttttatatatttctagttttccactatgaacgtgttttatttttaaaataatggctaaattaaaagccctaaataggggagtgaagaagaataaattagatctaccctccaaaatgctgcttgagttaggctattgtaataaaaagcagaacttggttttgagcttcttaactgctttcagagactaaatataaaacttattggttgggagaggggcatactgttcattaaggaaagcacaattttttccgtagccttcaagtttgtgagaaatttgtgacatggaaccttctgcaataataactaacataatagatgttttccattagcagtttaaaaagctaattaatcctcgatgaatgcaaaaagcaaaagttgctctataaaggctactctgtagagggatttctttgatgtggttaagatcattggtactcaagctttagcagacatcatagtcacttagagagtttgttaaaaacacagatttctgatccccattcttagaatttctaattcagcaagattagggtagaacctgtgaatgtgcgtttctagcaagataccagttatgttgatgctgcactggtccagggacaacactttgagacccaccagtctacttgttctaccatctattgacctgacttcattttagaacaaagttgatgatctattagctatctcctatctgacagataatgtagagattgctaagaagtttttagagactagatattctgtaatgtgaatgaaaggaaattgtttatgctctaaataccaaacttttagatgacaaagataataggtgaagaattgggttacaaaagtatgggctataggagcacctcctgaactctcagaaagtagctaagatttccaagcagatacacaattgaacctccaaagttcattgctgtaaagcacaaaaaagcaaatgcctgacctagaatatcttgaaagcagaaattactgaactttcatctctaccttatgactttttcaacagctagttttcacacaaaactattttaccatataagttattccattaagatttctagccgggcatggtggcccacgcctgtaatcccagtacttcaggaggccgaggtgggcggatcacttgaggccaggagtttgagaccagcctggccaacatggccaaaccccatctctactaaaaatacaaaaaaattagccaggcgtggtggcacatgcctctagtctcagctacttgggaggctgaggtgagagaatcacttaaacccggatggcagaggttgcagttgagccgagatcacaccactgcactccagcctgggtgacagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacacagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggacaacagagcaagaacttgtcttaaaaaaaaaaaagtggggttggggggtaacccagataattaattatttaatgttatacatctcaatattaaagtaaaacctgtaaacacaacagtttaggtttgactatttcttagaattacgacaataagccagtaatgttattttgagattactccaagaatgtgaaagttgtgtcatcattatgttaaactaagtgttcttgcctttagttaaggttccctagactacagcgaagtagtctacccagtccagtcatctgtagagtcattcccaatcctgagattcaggtcttctgtggtcattgtgtcaacaagagcatacattgactacctggaactagatcttggtatacaaaccttgtgtcattgtgcaacctcaaaaggagagacttgtatattgaggcatgccagatatctcttgtcagagagaatcagatggaaatgaagacagttcttattgtgtatgttgatagctcagacatagcccttaacattaaccagaattagggtggctggccccatttttctccaccaaaactatgcattgttacaaagtatactgaacaagtctaaaatcttaggtgtcagaggatttgttttctaaaaggcaagtctctaataaacaatatttaagtgctgaaaggagctttgcacttaacctgatcatcctgccttgtgccaataaataatttttattccttgtcatgcatatttcagagcatctatctcagtcatggttctggggagagaagccataatatcttaagacattcactgaatataatgaattaacttcatttctgtgtatctaggatgatatcagctgtgtactttcagagaactgagaaaatagtcatcagtccttttttgtggtattcacacaaaatacccagatacccagttgaaatcttccagagagtctttagtaccagagaaaacactgtcatttgctttttgaaattcaaattcagctctttctccaacaaccaacatcacagttgagactctaagctgaggtagaaaaaagccaacccattcctttctgtatcaatctctcaacaaaaaataagggtttgattccccctccccgccccagagctagatattgatagagagtaatcaatgtaaaagagactttagacagagtacactacactgcaagaatgttaatgtgatcaagcatcaggggtcacagctaactcaaagacagcaggggagagggcatgtagaatacttattaggcaggaagggaaatcagaaaggccatgagatcattcatttgtttattcaataaatgtgaatttatatacctacgttgggttagatactctactgagtgctaggtctatagaagtagtaaaacattgccctagtccttaaggtgttcacattctaatagggaaaataaacataataaacataattataatgcaaagtgtattgttagagatggtaccaccttcacttggttgctcagactgaaacctagaggctttattttctttttacttttattattatggaaaatttcaaacatacaaaaggagacaataacatcatgaacccccttgtacttgtcactcagtttcagcagttaccaactcatggacaattttgttccatttctctttccaccaacttccttccaatattattttaaagcaagatgtcatatcatttcatctgtaaacatttcagtgtgtagatctgtaagataatgtctgttttaaaaaaccattctcacaatactgtcatcactcctaaaacaattcacaaaaattcctaaatgtcaccaagtaatgggagtcattttaaactcttgtttctctcttctcaagtcttgtctattccatcagcaagtcctattggtcaacttccaggcaggtcactttaccacccctgctattaccaccctacttctgcagtcacatctctgtagatactagagtttaaaccaacagtttacttctgctcttggttttccaaagctagttttattaataactgttagagtgatccttttaaaattgtctaagacagagtactcttattcggtatctgtgggggattgtttccagagccccctgtggatactaaaatcaagtcccttatatacagtggtgtatgaagcatttgcctataacctatgaacctcctcccatgtactgtaaatcatctctgggttacttaaaataccttatatagtgtaaatgctgtgtaaatagttgtactgtattggtttttaaaatttttattttttattgtattgtttttattgaggtttttttggtgaatatttttgatccacagttggttgaatctgcagatgcagagggccagctgtattccattttcctgttcagaaccccacatgagttcacattatccctgaatgacaattctctaagttaagtgatctgcctctgctgttctccctccagccttatctaccactctcctcacactcctctcactttctgcttgtatagatgagtcatctccacctgacttacctggtcttttgcaattgcttagacacaccaatttgtttctgcctcagggcttttctgcttctgcctgcaatgcttttccctcagatcttcacaccagtcactcccttacttcattcaggcttctgctgcagtgttaccctcagaaaggcctccgaccatgttgccattacccactttctctcttttttaaacttaagttttgttctcttatacttattatctaatattatgaaatgtttattaggatatatgttcctcaccagaatgaaactttatgagggcatagtcttcatctgcctttttcccactctgttctcagtgccctagccctgtgtgtaacatgtaatacgcccccaacaaataaatgttaataaattaatcaaatgcttccttaagacacaaaacagttcaacatatgtgagaaacttaaaatttaaaaatgtatagaactaaagacaccataaggacgagtgaccagctgagaaaacgaatataataatgttaattagaacaaaaaggatcattttaatataaagaacaagggatttatatgaagaatacaatgatattcaacttttctagtaatctggaaaatacaaattaaaaccacagtgaaatactattaccctcagattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctgggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatggaaatgtggaaacaatgtaaatgttaatatgcagattggataactgttgtatttatgtagtatatagctgttaaaatgaatgatgtagagttaaatatgctcacatagttaggataaaatagtattgaataaaaaaccaaattacagaaatatacatatagtatcctaatttttttacttaatacttacaactatttgtgtacatatagctttgaaataaaaatataccaaaaaatacaagaacatgataaaccagctaacagtcatcttgatggtgggagggacttagggtcagtgaagcacacaagggggagcttcatctcttccccagcaaatgtgagaaaatcctagatttgataaagctgtttaatggataaaagggtatctgttaatatcattttctatactttatgtatgtttataatataattttaaaaaactttcctagtaaagttgcttattttatatttaggagtacattttctctctgtgaagataataagactaaagcaagagtacatgtaatttcaataatgaagttacactaaaattgagaccacattcatgggtaataatttccaagtgaaactccccaaatttaattgatactaaaattttaaggaaagcagttaattcctctcctaactggacaaactaagtatggattaatgacagatgacggtgagtatagttaacaggagtgacctctcagagaatcgtggggattgagtgatgggcaggctctcaaacatctaggcagcaggctggaaaattatattctttgagcttaagtttatttccgattggtttcctccaaggagctttgtcttctatggacagagaaatattaatacaacttgaaaaaaaatgctttgcactgactctgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatagaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggccagcctgggcaacagagcaagaccccatctctaaaaaacaaacacagtaaacaacaacaacaacaagattatgaagtaattttttatgaaactgatatagaaaaccttctgagacatttacaatgtcacattggccatctagtctgatattcattcgctgaatcagcaacatttattgtatgttttctgtctaccaggtactgtgctgacttaagacttcacaaatatcaaatattacgactaatcatcataatccttatcctcattttaaaatgagaagttcagagaacttgcccaaggccagtgagctaataaacagagcaaggatttgagccttgtctaaatccaaaatccatttattgttcattttattgtgctttctgtgacatgttttttaaaatgtgtgataagtgctataggtgttgtgatggaagtctgtacagggcacacagggtacagtgtaggtatggaggaggaagtgcttagttctgcctggggtggggagaatagacagaagtagatccaagaaatgcttcacagaggaaaaggtgtgtgagccgagttttgtaaatgagttgtttttccaggcagaaggagcatataagcaaaggagaggagacatgagcaggaaaagacaacataagcataggcttagtgtttgaggaagaaaagatgagattggagcagtaattgttggtcaaaagatggagtgttgctttatgaaatgcaaaggagtttgcaccttatgctataggcctcataagaccctaaaggatagtaatatcagacttgcattttagaaagaaattccgacggcactgtgggttctatttttgagaatgcaaactggaggcatgagatggtctgaactgagatgaacagcagtaggaagggagaatcgtgggtagagatgagaaatatgaaggaggcagaattcataggatttgattgctgattaaaaataaggttggggggcgggtgtggtagcgcatgcctgtaatcccagcacttaaggataccaaggcaggaggattgcttgagcccaggagtttaagaccagcctgggaaacatagtgagaccacatctctacaaaaaataaaaagtcagccaggtaatggtggcacatgcctgtaatcccagctactcaagaggctgaggtgagaggattgcttgagcccaggggccaaaattgcagtgagctgtgatcacacccctgcactccagtccaggtgacagagaccctgtcaccctgtctccaaaaaaaaaaaatgttggagaaaaggagtagccagtgcctcccagttttctgtttggggcagctgggtagatggtgaagctctttactgcattgaagaatagaagaggtgactaaagtttgccagagatgaagtatttgaatttggaagtgatccaagtgaagatgctgaatgggcagcttgagaagcacattaagctaaagcttaataaagatatctgggccaaacagatttagaaatcatcagcacatagatggaagggagttgaagtcggtaagctttgcttcaggtagtattttatggcaagaagatgttggaggatagagatctgagtcatatcagctgccatctatgagggattcttctgttctttctcttttcctgttttctattgcaacccaatgctgtgatgccacctgaggttatctggaactacttaggcatttctgtgtttatttctgcttaagagtacaggattattcaaattagaatttaatcaaaacaagtaacagtcactgtaggtgtgcttcctcccccaacaattaatatggaaatcctaaagggattatcacttgtaattaattgcttccctgtccagactgttagcttcttgtaggtaatgtatcctgttcatctttattgcccctatatctgtcatatttttatataaaaatgtgtatattagtttaattgaacacaatattgaaaaataattatatatattctctatttaaaggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattggtaatcttcttgtacatatagtagattgagcactttgttgtttggcaggttttatttttgtttgattcagcactttttctacattctgagttgcagggggatgatagtgatgatgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatcactaatctgatacaactagtttataaacaagaaagtaggcctagttaatgacagagcaagccagacacccagtcattctgattccctacccagtgtgtttttttgtaatgccatgtgatttctcccattagtgcatgtcatcatctgtcttaaatacagaaatgcagttttttggggggatacacacctggtgaaatgaattaatgattaatttgtgttaaatataattcatcaaggagaagaaagtttcactgaagagtgaagagtttatccatagacttctcattttataagtatgttcaataaaaatttgagtacatataatgcacagctttgacccaggtaaataatgggtctcaactttagccacaataattttttaagtactaatattttaaaatgtgtgcctattagtaaagagaaaatttttttagcaaatcatctaggatttgtaaaatgcaatatgcattaaaatagctggcaagatttgagttaaactcaacatggccggttatgcacatcatttaagtaggctaaaaatcctaaactacttaaagattataccaagtcagtggtcttaattgaaattatggctatatattagaaagagatggaatcagtgatttcagattgtttgtttcttttttctccagttggttacatacttggacttggtgatagacatgtacagaatatcttgataaatgagcagtcagcagaacttgtacatatagatctaggtaagtaataaaatctatgtatctattctttttagtaaatatttggtcatcatggaatgttgtttgcctaccaagatattacaaatataagagacagataaattgaagcagtaaatattgggtttttttgttttcagcataaacagttgtcctagaagaaacagttaactctgcctggggtactgagtgaaacttaatagatgaggtgtcttttgagcctggtcttcaagaaagaaagaaagcataattcagacagaagatagagcagattcaaaagaaggaatcagggctattccaccaaaacaaggagtaattttaagatgtagcatgttgtgggagtggtgagacattaaatgtgtctggagtgaagtaagcctgtagttgagtcgcttgagagagagattggtactagactgtaaaaagccaggctaaggagtttcaacttcattgcattaaactataggaaataaatgaaggacatgataatattttattttcagaaatataatttcaggagcactttggggagtggtattggcagcaggaagaaaaattaagggatattgtaatagtttagatgagaaatgatgaagatttatactaaagttgtagaaaccagaatattggatttgagggacatttttgtagtaaactgtaccagtgatattagatgaggaaatagtgggggagtggggcccccagataactgaagcttctaactaaggaatatatcaagttttgtaaatagtaagaaagtgatgaatttagttttgctcattattttgaagtattaatggaatttctaggtggaatagacagtttaatatataagaaagaaagaatatatagcttctatgtatatatatagacagtttaatataaaagaaagagaatatatatagctaaggaatatatcaagttttgtaaataataagaaagtgatgaatttagttttgctcattattttgaagtattaatgggatttctaggtggaatagacagtttaatatataagaaagaaagaatatgtagcttctatgtatatatatagacagtttaatatataagaaagaaagaatatatatagctaagaaatatatcaagttttgtaaataataagaaagtgatgaatttagttttgctcattattttgaagtattaatgggatttctaggtggaatagacagtttaatatataagaaagaagtgtgaatgtaatgtaaagaagtgtgaatgtaatgacaaacttctattaaacagtattaatcactaggtgataatttttagaggttatatgcaaaagaacaaaaataattaaaggaaataagttatcacaggtttcattattttccaaagaaattctcagaaaataatatattgagaggagagaaaatatgccatattcactataaaacaaagaagaaaaccctgtctttttattatttattgaagtaggagaattctcttctgcataagttataaaaaggtagatgctaagaatcaggatgaatatgaaacatatgatttaataatgaagctggtttggttactaaccacatcatcactattatccccctgcaactcagaatgtagaaaaagaagtgtgaatgtaatgacggagatccagaatcttcagcaaatagatttcagttgaagtcactgggctggaggaggttctgatctcacacatcatccgtgataaagagacctaaagatgaaatcataagggaagtgagccttggaaaggctgagccagaaaaaaactgagaagtactcaaaggaagtcaggatcttggaaggcaagaggggaaaatcttttatgaaagaagtagtgctcaatagtatctgatacagaaaggtcagagaggatgaatgctgaaaatagacctttgaatttaacaagtaatcaatcctagaggccttggaagtcccctttggatagaatggaggaaaccatactgtaaaaaggcaaggactgaatggaagttaaggatgtgtagattaagaatgtggaatctgccaggcgcggtggatcacacctgtaatcccaacactttgggaggccaaggcaggtggatcacgaggtcaggagattgagaccatcctggccaacatggtgaaaccccatctctactaaaatacaaaaaattagccgggcgaggtggtgggcacctgtagtcccagctacttgggaggctgaggcaggagaatcacttgaacccaggaagcagaggttgcagtgagctaagatcatgccactgcacttcagcctgggcggcagagcaagactgtctcaaaaaaaaagaatgtggaatcttcctacaagaagtttagaagggaagggaaggatggcagagaaatttgctgcaggaatgagagacacatttggtccttgcttttttaagataggagaggtttaaacctgttagatattgaagatacaggagaaaaacaaaagataattgaaatagcaagggaaatcataaagtacgtgagtctgatagcattggctttagattggaggcatgttagcttttctgctgagagagaaggaaaagtgatgccaataggaaagtcttaagctggagaggaaggagtatgagggaattatatttgctattgtgtttttgctgagaaatagaaagcatgctcatttgctaagaattggagggatggtaactggccttaaaagaacaaataaaattctaaaatttaccatggaaatgagaccaagacctgactagaaagggataaataaataagacatgccaagcagtttaaggggcactttcaatcctaaatttgtagtggagccaatagggttgttgtatgattttccagcagtcctcaacatccttggagcttaagttgtagtttaaaatgggagatgtggtggagggacaaggggacaaggagatttgaagcactgatgagagtaatcaaacttattgtctctacccctgggctgagttagggaaagaagagggctaataaactagaaatctcagtcaaatttgaagactgtttagtaagaataaggggtagaaggagaagaggttttgattagaatgtacaatttacaatgtctaagaagcagttttagcagactcatttctggagtacaacccatatgagtggttcattaagatagaatgaaattgaattccattagaacagagacagtcacggatattatatggttttccccagaatgaattctagagttgggacagaggggaagattgtgagctaggtccatgccaacattcagcgaatgtgagagaaaaccttacaggtttacagagtaaacgtgaagatggaagggatttgttagagctagaaggtggggatctcaacagaggagccagactttatctgagaatgaaaggagagtggtctggaagacgcaaattagaggtaggagtatgccaacctgagtccattcaggtcgtgctaaaagcatctataaatgagaagggtaaattggtacaacccctttggaatattgtttggcattatccactaaagctgactttatgtatatcctgtgacccatcaattccactccaacacaaatgcatacatatgtataaaaatgtttatagtagcattattcataatagcccctaactggaaacaatccagatatccatcataggtagaatggatgaacaaattgtcgtatatttatattctctttgtatataatgagattgaatgaataataacacacaatatagaagactctcacaaatataatgctaagtgaaagattccaacataaaagagtacacatgtataattccatttacataaaattcaaaagctgataaaattaatgtatagtgttagaaatcaggatagtggtgaccctttgaaagaggtgattagtgactggtaggagggactgaaagggggcctctggaatgctggtagagttctgttaacgtggatttgttcactttgcagaaatcccagtgagtcacacttgggtgatttgtatactattctgtgtatgtctgtttggttacctgttgctgcataacaaaccaccccaaaatttagtagcttaaaatcacaatttatttattattatctctcatagtctgttgactgggctcagctggacagttttcacttaggatctctcatgcagctgcagttagcatctggggctggagttatcttaagactcagctgggccagagttcatgattgcttcttcacttacatgtctgatgcttcagcactcccatgtggcctctctgtccacaatagtgtcctggacctactcagcatcttggggctccaaggggaaggaagtggaagttaagggctaggcctgcaacttgcacagtatcacttccatcacattatgtcatcacatagtcatgtcatagggtccatcctggttcttccctgtttctgggactccagtaaccctatgttaggcctttgcaatgtatcatttatactgttacctgctagtctatattttctaacctttttttccttttttctgactcactccttggtgtcagtggacatatccggggaacctggactttcagccctactcagctatagcaagccctttccctattgagtgtcagtggaggccaattggggaatctagtcttctgcccttacctagcagtaacaaggtggtgactcccaaaggcattaaaggcagaagtttaaggaagatcctgagtctcgtaataactaaaaggtgtaggtgtcaattgaaaatcattaggcatacctggaaccaggaaaatctcaactttaatgaaaaatggccacctgtaggtgccaacactgagatgacaatgatgttggaattatctaagattttaaagcagccatcataaaaacactgaaggaacaattacaaacatgcttgaaacaaattaaaatatagtaagtctcagcacagaaataagtagtctcagtatagaagtagatataaaggagaaccagatggaaattttagaacagaaaaatatagtaaataaaataaaaaatttcaactgcagaatgaggagacagaagaaattatcagtgaatagaagacagagccgtagaaattacccaagctgagcaacagaggaagaaaattaagaggaaaccttcagcatctagggctaaacagagttcctagacttgataccaaaagaacaatctttaagaactctcaaaacttaacaacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcataagggatgatcttttctgtatgatttcttacaactcgaagtgaacatataattatctcataaaatgtcattaattttttttttttgatggagtttcactcttgtcgcccaggctggagtgcaatggcacgatctcagctccatgtatccttcacctcccaggttcaagtgattctcctgtctcagcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagacagtgacaaagatgaggaaggcagccagagcagaagtaaactactgtacatactagtgttcatagaacgtaggtaacatgtggtttcttgcctttgtaaagttcacattctaactggaaagaaagtaaattagctgtcaaacctcctaacttcactgtattctttactttaggtgttgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctactcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaaatgccttcagcccccttgagtttcttggaatgttagagcattgtaagtagtctctagttttcaattcataaatcaattctttgacatttagatattccatatggtattattattttcagaatggtttccattagggtttaagaaaaatcagaaatttatatctcctttttccctgctcaggttcagaactaattagtcagacaaatggagatcaaattgtcagcatcattactagaggaacatggcttaggaatgagggccagactagtttactgctggtgctacctcagtacctctctgctgtcttaactttgggacagctcacctgaatagggtttgggcctgcagagcaaacacatgtaatcaggatcactgccttgtcttgatccagggcagaaaaaaggaagtcaaacaaatttcagtgtctgtgctgttagtacctatgccagtcattcaccaatctggtaagggtatgtgagacaagaaatcaggagtgtggcctccccagggaagcatggcaggtagagtgcagtatgggcttgccacttttccactactcagcttttcttcctttaacctgatttatgttggactggctgcatgttagtattacttttactgcatttaaaaaacattgatgctgatcaaattcaaaccaggtttctagagatggggcaggaatatgtgcatttttaaaaatctctcctactgttcaactaggatatgagaactgtcttaattcattggcattaaccattaagcctgtggtcaataagggtggggctttatcccttggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtttggccaacatggtgaaaccccgtctctaataaaaatgcaaaaattagctgggcgtgatggcgggcacctgtaatcccagctactcaggaggctgaggcaggagaatcgcttgaacccaggaggtggaggttgtagtgagctgaaattgcaccattgccctccagcctgggcgacaagagcaagactctgtctgtcttaaaaaaaaaaaaaaaaaaaagcccaaacttttcaaattaaagagtcaaagcagcttaacatattctttagtattttactctacctagtttcagtcagaagggatttttatgctaaggtggatttgggagtttcttccagtacttgtatcctacctaacactcaccagaagaaggtagttcttttagggcctcagaaatcttactagtttaatgccaaactgcttatggacttcactttttagagtagtaggagatcaaatgagagaagtgacagtggccagatcctttgccattgtaaggactttggatttcctttgagtgagggttttgagtctgaaaagtgatttgcatctccacctacaataactgtcacctttaaacacaccctccgggaggaggagccaagatggccgaataggaacagctccggtatacagctcccagcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggcttggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcacgcagctggagatcggacaacaggcagactgcctcctcaagtgggtccctgacccctgacccccgagcagcctaactgggaggcaccccccagcaggggcacactgacacctcacacggcagggtactccaacagacctgcagctgagggtcttgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaacgcagagcacctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaataagttgaaaactttgaaaaaaatttagaagaatgtataactagaataaccaatacagagaagtgcttaaaggagctgatggagctgaaaatcaaggctcgagaactatgtgaagaatgcagaagcctcaggagccgatgcgatcaactggaagaaagggtatcagcgatggaagatgaaatgaatgaaatgaagcgagaagggaagttcagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactctttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcatcagtgaagtagaaataaaatactttacagacaagcaaatgctgagagattttgtcaccaccaggcctgccctaaaagagctcctgaaggaagcactaaacatggaaaggaacaaccggtaccagccactgcaaaatcatgccaaaatgtaaagaccatcgagactaggaagaaactgcatcaactaacgaacaaaatcaccagctaacatcataatgacaggatcaaactcccacataacaaaattaactttaaatgtatatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagaaacaaagaaggccattacataatggtaaagggatcaattcaacaagaagagctaactatcctaaatatatatgcacccaatacaggagcacccagattcataaagcaagtcctgagtgacctacaaagagacttagaatcccacacattaataatgggagactttaacaccccactgtcaacattagacagatcaacgagataaaaagtcaacaaggatacccaggaattgaactcagctctgcaccaagcggacctaatagacatctacagaactctccaccccaaatcaacagaatatacatttttttcagcaccacaccacacctattccaaaattgaccccatagttggaagtaaagctctcctcagcaaatgtaaaagaacagagattataacaaactatctctcagaccacagtgacatcaaactagaactcaggattaagaatctcactcaaaaccgctcaactacatggaaaccaaacaacctgctcctgaatgactactggatacataacgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaactgacaccctaacatcacaattaaaagagctagaaaaggaagagcaaacacattcaaaagttagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccagttaacaggagctgaaattgtggcaataatcaatagtttaccaaacaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatccagtgggcttcatccctgggattcaaggctggttcaatatatgcaaatcaataaatgtaatccagcatataaacagaaccaaagacaaaaaccacatgattatctcaatagatgcagaaaaagcctttgacaaaattcaaaaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttttacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttctttacagaattggaaaaaactactttaaagttcatatggaaccaaaaaagagcccgcatcggcaagtcaatcctaagccaaaagaacaaagctggaggcatcacactacctgacttcaaactatactacaaggctacagtaaccaaaacaacatggtactggtaccaaaacagagatatagatcaatggaacagaacagagccgttcgaataacgccgcatgtctacaactatctgatctttgacaaacctgagaaacacaagcaatggggaaaggattccctatttaataaatggtgctgggaaaactggttagccatatgtagaaagctgaaactggatcccttccttacacctgatacaaaaattaactcaagatggattaaagacttaaacgttagacctaataccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacccttttacactgttggtgggactgtaaactagttcaaccattgtggaagtcagtgtggcgattcctcagggatctagaattagaaataccatttgacccagccatcccattactgggtatataaccaaaggactataaatcatgctgctataaagacacatgcacacgtatgtttattgcggcattattcacaatagcaaagacttggaaccaacccaaatgtccaacaatgatagactggattaagaaaatgtagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaatatcacactctggggactgtggtggggtggggggcggggggagggatagcattgggagatatacctaatgctagatgacgagttagtgggtgcagcgcaccagcatggcatatgtatacatatgtaactaacctgcacaatgtgcacatgtaccctaaaacataaaagtataatttaaaaaaaactaaaaaaacaaacaacaaaacaaacaaacaaaaaaaacacaccctccaatgctttgtgtattttacactcatctacctaatcttccctccgtaaatctgtccgaatttccccaaatcatttggtgtgattgttccaatcttcaagaataattttcccagtgatcttaccacagtaagaccctttctgccttcagctttaggagggtgcttctcaattagcatcctggttcccagtcctctgggacatcatttctttcctctcttggattcatttcttttcttctcttagatttcattgaggcacagtcactatttctgaactgatctccccgcttcctaagcccctccttcagagcactttaacctgggtgtatttcccttttcttttcagtgtatttgtctctcctggccttcaagattttattttcttcctaatggaccattctctcctctaagattttatgtgttatgctaaggaaatatatctctccctctaactcagtgatgcttagccaagagcagttttgtcccctagaggacagttggcaatgtctggaggcatttttattgtcacaattggggatgggagatgaggatagtattggcatctactgggtagaggccagggatgctgctgaacacctcagaatgtacaagttagcccccacagcaaagaaataccccatccaaaatgacaatagtgctgagactgagaaaccctgctctagcttaatcagtctgtattcctttactgtttccaaccacttctgtcttgtcagactgaaacataattttttacttattccagttcctccttaattctaatatttgcaagtatgattcctgacacaagcccttggttttgaagtaatttagatttttcttctacttcaacccaagaaaaccatctagtctgtattagaggccttcattccttttcattagttcattaataaaatatattaatatttcccttttgtgggtgaaactggtttggatctctgaaatctaaagccatgtcagtgcccaacttgaagtcacataggaaaccttgaacttaacggacaagctacatgtaatcaagctcagtttctccacagtatttaatggtcctggaggacactcaaaacagcattaaaaaatagagagattttggttctgctaatctagtacgtgtcctgaaactaaatctgctaaaggcattttatagtcccaacctgcagatttactgagaaactgtatacagatagcagcaaaaaagtgttccaaccttgtaatactggaatgccctgtagaatcattctttatattgtctccacttattactaagatttgtaagcatttgctaaagcctattttttttaaagttctgtgtttataaataccagagcagttagctgttctgaactgccaatatcagaaattcctcatgaactcactttctaaaatttacgacctaaagctacttgctctagccatgtcagttgttttggtatcctaattctacacctaatatatatctcaagattccaaacgcagcaccaaaccttgggttttgaggaggtttcaacaaattatacctttctggatccacccagatttagaactgagagaaaaagagccataggaatagggtggagatcagaatttcagatttgttactgataaaactattggagaagacggcttaggagtgaggtccaaataggcttgctggtgctctccagttcccacatcccaatctataccttgagacagcctgggctgaggaagaattgggccctacaaagcaaatacactaacccagggttaagagtagagagagaaggaaagaaagtgactaaccttttaatagattagtttcatccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtga

SEQ ID NO: 16152 - DNA, 6483 bp, Human
gctgccgggcaccgctgcaggaaccgacctaatgggagccagcgggcgcaggcggctgccctccgctttcttcaaccctcactctccaggagctgagccgctgtgctctctggctgtcagcccgggatcaccaaggcagcagggatcctgaagagaaaagtcaacacaacagacaaacagacaaagaacagacagacagacaaaaaaaaaaaaaaaaaaagaaaaaaaaaaaaaaacaggaacagaatgtatacttatttgggaaaatggatcatggttaacaacagcaaatgtgaaatgccctttcctccctgcccacccgtgaaagttctactcctctccaagtcactaattcgggaagcttcctgggatgtctccccggggcttctcctgggggatcggggagagggctctttggcacggtttcacacagtgggctggctttgcctgggccctgcccagcagagatcatgtatcgcctcctggggctgcagcccgtcctcaaggggcccagacctcacaataccgcccagtggttgccaaaggacgaccaagggctccctgctgtgcccccacgtggtaaggacagggttctgtatctagcatctctcacagccataggtgctcaggcactaagtgcagagttaaagctgttagcggggcactgccggccaccagaccacaggcaaaggatcctgaggcagctacagcctcgaaatattttaagatggcagcctaggctaagcttgcctttttcaaacagcccagcgtcactttgccagaatctgccaacttctccgaaagtcaatgtagaaaaaaagtcactatgctactttgtccaaactgaactcgtttggatcattacacctccatctgctgctggcactgtacagaacctgacctctgggagcttttaatgaaaattaattttctatccacataggggcaaatgccagttggtccctgggccaggcagcttgctggaaagaggtgctttcggctggctaccggtgcgcggggaccacactcacaaaccgcattccggtcttcccgcccgaaaatccgcgctgtgcgagggacccacaagactggcggtctaaaagggacccgcctcacttggaaacggggctgcggtagccacaaccctccggtagcggtagcgtaaccccgttcggtgatccagccgcacagcgcaacgggtacaaagaaccccactggctaaggccgacctaccagggcttgggggaggggagcggaagactgaggtcgaaacgacctgtccagcagaaaactatccccaagcatattccaaccacttctccgtagagctcattccttccgtgcatacgaagggcgccaatccttcctgtatccctcccacagataccgggtgactactgcttttgcgcccaaagcgcagtgctctggctcagctccctacagtagcgacctccaccgcagattctcatctcctcgctaccgtaagagagatgtaaagaatcagacgggttacgcgctcaggcaccctcatgaagcagaggacctgggcttaaaactcattcagtattaggaaaagagcgccgagcacgggcctattatgccaaagcttctgaaaggggcaccacgttttttgctctatggggcagatgacccctccctaatttcggttttccatccatccccaaggtaggctttggagtggcaccggagactgagctcaaatttgcaggccagggactggggagaagggcgccacactaagagacctgcacccccattctcgccctgtactctacccagagtcgtggtacccctccattttaaagcaaaatccaaaagcaagcacggcggaatcttctggaagggggctaagatggaactcaggaggcgggggtcggtatggaaagagcagatggattatttttttcctctcctggcgaatgaggagcgcccccagccacccctcctcataaacaccccccaaggcgcgcatgcgcacttaggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtaagtctgacggggtttcgggtgggagagggttcccaactcgcgcccctagaacccgcaagactgcgtcgcgattgccgcttcccggacccgtcctattccgattgccgcgatccttgcctgcccaagtgccgctgccggcaccgcgcgccccctgcccattccctgcgccgtcctcctcgcgctgaccctccctagtgcgcccgcgcctgccagggaacaaagactcggggcgcggcgggcgaccgctgcggacgatcacccaggcatttagcgacctacgcggtaagaaaaacccgctacacccggactcgaccccaggagggaggcggggcactactgtgttgaaagactttacagctcgcagagtgaaaattttccaccttaaaaaattgcgcattgcggagaaattttatttaaaaaaacatatagcgcttgcgggggtggaacaaaaaataagttagaaaaaggcacttctcagaaaaaataaaaattacttcgcaaaaaaaaaaaaccctacaacgaattagagaaaaagtagttcacaggaaaacagaaaaacgcgcattgcaggaaaaataaatcggagaaaagcacttggcagaaaaaaatgcattagattaaaaacgcactgcagaaaaaaattagacaagggagctaacggaaaaaaatggatcgggcaaaaacgctttaaagaaaaaaattagaggaaaaagcccctcgagagaaaaatagaaggggaaaaaaagcacttccaaaaaaggacaattgctttacaaaaaaaaaaataataataaaaaaaaataaaaaagaggcaaaagcgcttggtgtaaaaagagataaatcagaagaaagcgctttgcccataaaatcatttaccctaaaagctccctttgcaggaagaattccctgctaaaggaatcctttgccaaaggaatcgcatatttccttcaaggtgttcctggaatgctgcatttactgggtaggattcgcttttcgaaatcctccagggacacagcccattgcgagaagtgaggtatacctaagttgtgggtccaatcagcttgccgccatgcagctctcagcacagttggaaaagctccagctgccctgactcgtggacaagctgcgcccgcgcccgcctctccagcctacgctggatgggcgggcggggcagggggtggggcgggggtgggcacggcagcaccacagacatgctgtgggtgctctccactaagggtgggtcctgggtttctcgtcgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactttgtctcttgtgatttctttagcggcatcaacatacacttctaagactcagctgatgtgcccactgtggaacaggcacactgcttgggggagggaggaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaagtatcactttgggaaagatgagaggaggggaaaaaggtgggagtagccctccaaagaggtactagggaccaagggggtgatttcagaacacaaagccttacttcaggtctccatccaggagccccaaagaaatgagtagtgggcagggtggacagtggcttagacaatgagtatgggataagaggtgcagcgtggcgccttcttcacccagcttaatgctgcaggccccacatccaccaggaccactacaaagacaatctgcctggccttgctactctgcagggtctcctggccccacctcaccccagaaacctctctccccaatactgggtttctgcttttcccagcaccagcctccgtattcttaggaatgcttaccaggtccgtggccctgggctctcccctgccatcacgtcagggtgggcagtgctcggcctcggacttgtcttcctctcccactccccagtgagtcagggctctttctacacggggtcagctgactgtctcaccaaatggccctgccgcctgttcagccttgtctctggctttatgtgtccctgtcactacacacctgttgctgggtcaacaccaagggagggagttggagggccataaatctctcttcctgccacttcttcgaatcccttagtcacagctgtcacaaatacttctgaagcacaaagtaccttgcccccttaagcctgatcatgtttccctcccctaagcaagcccttaagtttcttagcccaatcaccagcacctctaaaggcatctaaaacttcattcggtatcagagaattataggggtggggaggtgcagatcccggttctggtcttgactttgccatcaatcagcctagggaacctggacatgtcaccttgtacccttcatctccagtttccctctcgaagagggcctttgagatgccagtgaaccctaacacgctagaaactgccatagcagtggcaatcaggactcatcaggacttgaagaggatgtgcaatctgagacttcatctttcttaggctgggtggctatagctgctaccatagcctgaaggtgaggcaggtctcctctcgccccagtgtgactcatcagcaggcaatgcccacacctcctcccttctgaaccccatatcttggcaggcctcaaaactgggagtttctgtggttttccacactaaacccacagaatcatgaacataccaacatgtgttctccatgaaggctgaccctcccttcggagcttttgaggggtatgcccatagccccactgcccttcttgatgctctaacctcagcccaagtgacaaggtagcagatttcagggaggtaggccaaagcagcatggtaagagctggctgctctggacacagcacctcttgtgcccccacttagaggacaagaggctcctggtagccccagagctttccatatcatcttggcaaagcccttttcctccatccgtccatcagcagggctgtgagtgtggcaaggtgagatgacagatttccaggcaagggctgccctggtggcctgcacctgcacgtgtgggcttcaatgtgcaatgtccactccccatttgcatcctccacccacaaaacttcatgttctggcagcaaacttaacccaccagagaagacagtgcattcactttccatccagtgcaatgccatgcaatgcctagat

SEQ ID NO: 16153 - DNA, 24070 bp, Human
ctgcctccccaaagaataatcggaacctgcctccctggtgtgtccagaattacacaatatcaataacggctgaggtgacctgtgatgcccctagcaccctacagtgtcttgtgcatttatcacaatgaccccatcgttacagatgaggaaacggcacagagagaagttaagtcacatgcctaaggttacacagctatttaggggtagagccaggatctggatgtggagagcccagctccagagcccactctcaccaccatgccataccctgtctcgctcttgctttgagagggttgaaaagactttgggagggttgaaggatatttcaggtctaggaggctcttagcacgggcctgctagagccatagcctgatgaacagtgatcagagagtgggcgccattatgatttctctttctaatgacatcctcaaaacagtgctgagatgtctgctttatccctgctttgcagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggtgagatgatggccctatcagggctcaagatgggtggggagatcccagcgaatctgggtgggagctgggaccagccagggcctgcggatggggaaatgggaggcagagggtggtggcaggactgtgggcgtcagggggagttttcaacttggtttactctgtgtttccgtctctctggacctcccaggtttctggctctgaagtcccttagctcttaaatagtcactcattcgttcagctgtttactgagcacctactgtgtgccacaccccatgctaggcactgggagcacagcagtgaacaagatgaacaaaagcccacgacagtagtcacataaccacatgaattcaaacaacaaaaacaaaacaggaccacatgttatcaaagacagacacaagtcagggggacccagtgaaaggatttggggaacacttcccaaggaggggacttttgagttgagaacggaaggaggcaccagtcaccctggtgaagtggccagggaacagcatttgggcagtgggaatggtatgtgtgaaggccctgtggctggagtgagctcccagccatctctgcttcaaacctcctgctgtatggccttggctgccacttttagcacctttccccagcgttaggcaattcccgtcagccacgtattcattcaacaaaccctcaatgagccccctccatgtgctaggtgcccgggacataggcgtggctcagatactgtccctgccaggagggagggaaacagtgactcagggggaggtgggtgggtaaggtcagggcttctgattatgaggcatttcttccgttcctggcgctggaccgaggaagccctttacggatggatgccatccttacgctcattttacagatgaagacatcgaggttttgagaggctaactctcccaaaaaggctggtgcccctgtcccccatttttttcttttctttcttttttttttgagacagagtattcctctgacgcccaggctggagtgcagtggcaggatctgagctcactgcagcctctgcctcccctgttcaagcgattctcctgcctcaccctccggagtagctgggactacaggcgcgtgccaccatgcccggctaatttttttttttttttcaagtagagcccgggtttccgcgtgttggcccggcaggtctcaaactcctgatctcaagtgatccgcccgcttcggcctcccaaagtgctgggattacaggcgtgagccaccgcgcccggccctgctgcctctccttgggcctcgttttccctatctgtggaatgggtgggagggaggccggccaaggggccccggcagccctgcctgttccagtgtcttctctctctcctgccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtcagtgcgcgggcggcgcggggtcctcgcccacctggggccacggcggggaggcggcggggctgtgtgcccggggtcgccccctctgcgcaggcccttcctctcgccaggggtagcgcccctgggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgcccctgcgccctctgctggcgctctgcggtcaccgcagccccggagagggccgttttggagagccgcggcggtgccccagacactccacgcagacttcactccttcactcagacccgttcactctccccacaggcacacgctgggccacacacacggctacacccccgccagggacacgcacacatgcggggtggaggcagggtcacagacacccgcagacacatccccaacgcagatgtacccagatacaaactcacatgcacaggtgacctcacacttgtagctgaagacacacgcacatgccgtcagaagcgcattcagagacacacgctcagctggaaatcacaatctcaccatcgtggccgcccaggagacagatacacacaggtgcatcgagaacatgagaacactcagagacacacggacaggcgtggacccttcagacgcagacgcacgcccaagcgagagaaacagacccacagacacaccattcatttgttcaataagtatatgtggagctcctactacaggccagggctcctctgctgcccgggccccagcggtgcagacagaacccacctgggggaaggaagcaaagggcagctcgtggagggtgttagaaggggcgctgctgcgaaggcgcaaaacaggcagggagggagggctgggggatgtgaggaggtggaggctgtagcttaaaatggtggaagggggtacgggggcctttctgagggggcagttacttggagccaaatcttcctggacaccaggagcgcccagagtgacacactttatagagagagagcgagcctcctgggggagtgttcttcattcaccgcttccttcagcctatagctctttcttgagcacctactatgtgcctggctctggaaacaaaacaaagatgctggttattggcgacttctgctcctagagcaagacaggcaccaaacagataagccagcacccagcactgcccaaagccccggggacggacgcggacaggaagggatgctcccgctcccacacgcccttgcagggatgcgcagatacacggatgcagtggacacgtgcacaggcccatcttcactgaacctgactgtgtctttgggctgagcacttgcgtgtgggagacaaatccactcctcctgggtacagggccatcctgcccatgccttccctggctgtggccccactgttctgacacaccccacccctctctgcaggtggagtgaccacctttgtggccctctatgactatgagtctaggacggagacagacctgtccttcaagaaaggcgagcggctccagattgtcaacaacacgtgagtgcccccttccctattgcccctcagggctgggtggtgggacttcaaagcgggcaggggctcatgcaggatctggcatcagggcagcacagtgcagagcccagggcagtgcgaagcccagggcagtgtggaggcaggcgcctgctgcactctcgccctgggcagcacctgctgttgctcccccagccatggggaactcctcccaatccctggctctcgcttgctccctccagccctctctcagcttctccctctctctgcttctctctcgctggcccttaggaggaaggtggatgtcaggtgtgtacatgctccgtgggcggcgggctgggcggggtgcttcgcggggggtgggggctgctgtctgcatgtgcttccactccctgcctgtgatctctggctctcttggctgctcctcacctcccagcttctcccctcccccctccaccaatttgattaggtcctggaccttaacgcaggctgcgatcaggggcccttccattgcactctcctgcacatctcctccccatccaccttcctactcactcaccctcccattctgccccgtcagcccacccaagtatctgctgcatgcaggacccagtgctgtgatggggatagcctgggtggagaaggccttggccacgtccccctggagccagcatgtggccagggagacagcacatggccccagcccaggccaagagtcaggcagtgggcgagcccagagtcggctcctggagcccctgctgtggacctgcctccggtgatgaccacagggactgagagggtcaagggcctcgaaggaaagccagtgaagttatctggcaggtggaggtggtggaagggcagcttgcgggagggtgccggactggagggggctgacgccttcacgggtgtggaaggcaggaaggttctagaaggcagaggagaatcgatccctgggtgtcctcgaaggcctggctaaggaagttgggggtttccactgccccgagcgtgtctggcttgctcatgccccacttgccttgcgcatgctcttccctttgcctgaaatgccctttctccagtgtctgcctggggaactcctgttcatcgctcaagatcagtgcaggactgccttctcagaggggcaaaggggaacagaggtgccagttgccatgccagtcgtctccacctgtgtccttgtattgactcctctctgcagtctagccagggctgaagtgatcggggagggggctgtctccattttgcagatgaggaaactgaggctcagcgatgtgaaggcccttgtccaaggtcacacagctgccaagtagcaaagccaggattggaaccgaagcagcaactttctgccctcctcaacctgctcttggcgggggggtgggagggggggctctcccggctccgcctccccccttgcatggccgagtcctggtgcgaagctacagtttccttattgtcaccagctgtttgtgtctgcttcccccctaaactgggagctgctggagggtggctctctggtgcacctcacttctgggtccccatagcacctgtaactcagcacagtggcgggtgcccagcaggtgatggtgaacaggatgaatgaacagcagtgacaatgtcaccatttcttgtgctctctgtgtgagctgggccctgtgctgagtgcttgaagttgcgttattttatttacgcatcaccatagcctcgagaaatgggaagtcttacttgcaccattttacagatgaggaaactgaggcccaaagaggtgaaataacttacccaaggtcacatggctagtagtggcagagctggaagactaggctggccctccgacccatgatcctttcaggaaggctcagtggaggtgcagcagaggccacaggagggagaggcccgtgcaggggaggggcgtcagcaggatggctctgaagtcctggtggagtctctaccaagcgtctcagactggggtgacagctggggcagagctgtggaggcaggaagggctgggagaactttggttctgcctttttcacctggattcagagagtagccccatgcttgcctttttccagccctttccctccactcttcttgtcttccagggagggtgggctgggggaggtttggccaggaggctggggctgccaggaggcctggaagtgatggaatctcattcagggaagaccctggggtagctgattgggagatgggggtgggtggattgggagcccctcctcatgtcacaatgctccaatgctccttcgcttagacgtcagagatggtggctgagcgcggtggctcacgcctgtaatcccagcactttgggaggctgaggcaggaggatcgcttgaacccagaagtttgagaccagcctgggaaacatagggagacctggcctctacaaaatataaaaataaattagctaggtgtggtggcgcatgccagtggtcccagctactcaggaggctgaggcaggaggatcgctggaaccaggagttgaaggctgcagtgagccatgatcgtgctactgcactccagcctgggtgacagagcaagactctgtctcaaaaaaaagaagtgaaggagggaggtgtaggtggggggctggtattagtagaagaggagagggaaagggatttggggggcggggcttggtaggagatgggccaccggaatttaaggtgtttgagtctcacacctcatcccggggacccgcctgcatgcacgtccttcctccatcagtgctcagggcctattactgtgcagtgcctcccccaccctgtaagagtggggggctttctgaatctagcatggggcccaggcacgtgtggaggctgggctggctgtcagggcagtagagagctagaggaggaacccgtctgtggatggggtctggccaagtgggggtcctcgcagtagcagacccagagatcccgcgccatggatcttgctgccacatggccctgggtcctggtattctgggtattgtgtggccctgggtgtgaggaagccctctggggctgaggtctgactgcctcaagctccctcatctgacatcctagtctcaggagtcagggcccctcctgggtctgactctgggttgctccctgaactgccccttcctcccacccaaattccaggagcttcttttgggagttttctggcaggcgcttctgggcaacagcgcctcagctggcctctgcctccttgcccccggcatggcggcagggggcacctcgggagtctagagcctcggggtcctgccttcatgctctcctccagagacctgtgctggcttcacccctgcctcgctcctccctcaccccacagaccatgtgctccaggtcttggggcttggcaattgacctcctggccactgcccacctggccagcctcagctgtggtgcaccagctcagcggccatccccagagtgccctcccaaccagtcccagcagcccaagggagcgaatgtcagtgcccacgctggcacatgtcccaggttccaaagctgccgtgcccctgagccacacgccaccctggctggccccaaggattagggccccaaaagaggatcctgaggctcagagaggtgaagtcagttgcttgaggtcacacagctggtgaccagcagttgtgaaaaatcatggctctgggactcttggcccttcttctagccatgggtgggaaggcttcccttccttccctgcttgctgcccacctgatgaggaccaggcccgggggaaggtgctggatgccgtagaattcctctccctgatggcttgatgctgctgtgactggtgaccgcagccaccggaggcagctttgagcctcccaagcccttgacatgggaagatggggattgatatctccatttcacaggtgggcaaactgaggctcagatgatcatcacagtcgtcatctcagtttactctgagcccagcatgacgctcactgtttacacactttgcctgcaagggagattctgtgaatgttgtctgctttttacatatgaggaaactaagactcagagagggcagggtacttgcccaagatcacacagcaaatccttgttggagactgggactgtgctgctttggtttttaaaaagggtcactgtggaaataccaatttagttgtttttatttttattttttagctaaatccagatctaacagctgatgcatgttgtgctgggctctgatctggctttttttttttttttttttttttttttgagaccggatcttgctctgtggcccaggctggagtgcagtggtgcgatcttggcttactgcaatctctaccttctgggttcaagtgattctcctgcctcagcttcccagcttcccaagtagctgagattacaggcacgcaccaccatgcccagctaatttttatatttttattagagacggggtttcgccatgttgctgggctggtctcgaactcctgacctcaagagatccatccaccttggcctcccgaagtgttgggatcacaggcgtgagccaccgtgcgctgtctgttctggcatttgatatcctgggagggagacatgctgaccctgcagatgaggaaactgagactggcgagtgtggtatggaggggccaaggtcagacagccagcaagtggtgagctgggatggtgtctagggcagtgcagcactggagcccattccctcagacccctctaaatcaggggccaggctgagactggatcttgggtccttcagtaaaattggagtgcatctcatctctctccctgccccttgtgaaatgaaacctccagactagaccatgaaaccccaggctcacaggtgggctgactctggggagctgggagccctgctcgctgaagtcgggtagcatcggctgcactcctctcgctcttgggccctgcttggctggcctccgagcacaggcctcctgccagccttccactctgggtggctggagactccccagaggccggccagcctgcggactgcagctttgtcaaacggcctcaatttttagcgtctggtcttagaccttggccccttcccgctgtggcctgtcctctgaccccgccctgcagcctcctctttcatctgccacaggctttcccaaaggtctcagcctctctggggcctggggaggccctactgtgcctggctgtggacagtcaggggccctgcttctcactcttgctctgccattggttgaccatgtggctttgggcaaatcactggcctgtctgtgtctcattttcccccactggtaaatggaggctttgaactgaaagatctcagagagctgttttctgtgatttgagtccttgctttgtagctttgggcaagtcgctgcacctctctgtccctcagtttccccaactctctaaagaaagtgctggccaggcgcggtggctcactcctgtaatcccagcactttgggaggccgaggtgggcagatcacttgaggtcaggagttcgagaccaccctggccaacatggtgaaaccccgtctctactaaaaatacaaaaattagctgggcatggtggggcttgcctgtaatcccaactactcaggaggctgaggcaggagaatcgcttgaacctgggaggtgaagtttgcagtgagccgagatcgcgctgttgcactccagcctgggtgatagagcaagactccatctcaaaaaaataaataaataaataaagtgctgggctactctgacctgggtgctgtgtgtccctgcgctgatcgcttgacatttctgagccagtttcttcatctggggcctggagccctgccttcctcccttgcagggtggccttgggggtcagtgggagagacaagtgtggacaccccgggtgggtgtacaacaaggaggtgggtggggatttggggcatccaaaggcttcttttcttgaggtgggtcttgcctccttactcccgggccctccctccagtgaccccatatggcttgcccccctgcccgagtgtgtgtgtagccatcacagagccaagacaggccacacagccccagtcacacccccttgcctcactccatcaggaggggacacaacaccctctggctcacttcgagccatccggctgaaccccagtgtctcaggtgctcacctgtcctccgacaggtccctggagagctccccaagccctgctccctcctggcctcaacttctccatcttctatatgggctgaagaatatggccaggggcagctcagaagaagtgggagccagggatccaggttcatgttcagattgtgtgactgtaggcaagggcctttctctctctgggccctggcggtgggtgggggccaccctgcctgccgtgtgtcttctcagggtcctggtgaagtacaaaagtggccttggattgagaagagcccagcaagctgtcaagccctgctgcaacctgcagggggtgctcctatctgggagtcaggagcctgggcctggctgtgtgaccttgagcaaagaggcctttgcttctctggcctcagtcttcccagctgtacagtgggaatgagaggggctggaccctagttcccaggtctccctgcccattgacctctcctcactccctgtggaccccgtccctgtccccttggttgctttggatgtgaggcctctgtggctgccccctcgtcccctgtccccagcaccgcctggctctcccgctctctcccctgctctttctgccactctccgcctctcaccacccccatctctgcctcttctctcctgttgggctctcgctctctcctccctcctctgtgtctctggacccccgctccagccagacctggttcacattcagatggctgcaaaggtacttccgcccctccccgctcccgcccaggcccaggggacccgaccacgccgggagctcttcctgccccatccccatcacaccccccactccttctcctcactttcgcatagaagtgccctgggcattggggctctgccacctcaccccctctgacagggctcactgtgtgactttgggcaagtcccagccccctctggcctcagtttccccctgcagatgggtaggctggaggaggaggcctgtagttttcagccgaggagccctttaggtgtgacccgtgatttgggacagaggcaagccttgctctagtttgcagggttggggcctggatggtcactgggtcccagcagggcccctgcttgcctccacccaggtctcaccagctcccaggagcgggcttccaaatctcagagcatggggacactttgtaggtctcacttgactttctctcagccaggaatctcttctattacaaccttacttgcccgcagagacagggggttccctccctccctcccaaggcagctctcggcatcttgagatgtcttggtacatctgaaaggaagtgaatttcttcctgtcccgggactcctcccctatggatttgagcctcagatgaccaaggccagtcctgccctggtccaagacaaagtccatctgatccagctttggcaaaaaggcgtctgcgccagggaggggaggagttccaggccagctggacctggcatgctgtggggactcacgctggccccaccacctccctgggcctccctcagccactagagccctgagcacagcacctaggaggatggtgggcaccgggcttgtggctgacggctcccttctcctttcctccctccttctgtccctgctcagagagggagactggtggctggcccactcgctcagcacaggacagacaggctacatccccagcaactacgtggcgccctccgactccatccaggctgaggagtgagtaccgtctctggctgcctctacccgtcgtccctggacactgccggtgcagagtgcctctcctgggctggggtgggaggtctggctgtccagcgccccagccatatccagggagaagcactgtgagtgggcagaagcctggacagtcagcaccatcctccgtcctcccacccccaggtggtattttggcaagatcaccagacgggagtcagagcggttactgctcaatgcagagaacccgagagggaccttcctcgtgcgagaaagtgagaccacgaaaggtacgagcgctcttgctggccaacggatactgagtcttctgtgagtggtttgagctgggtgttgtggaatgagcaggagtttggtttgtggagtagggagggaagaaccttccgggtggaggtaatggcaggatcaaagtcagggaggtgcatttgaggaacactgagtaatccgcggtggccagatgtccagagaaagatgaggcttagtctctctggcctcagttttctcagataaaagatgaacataggttgtctggaggtctgagtgtcacacagtaacaggctcgttcccagggtaggtgctgctacaatgagccccgcttcttcctcttccccaggggtccctgggctgcactggatgctggaggctggttttgccctcccccaactgcagtcctggtccctgcccctctcctgtccctcccctgagccagagaatgaagaccatcccctttctctccagcccctctgaaagtgggttgcaggcgcccgtcaccatggcagccaagctgagctgcttcctgtgggcctggggctcagcgggagatgggaagcagagcatccatgtcgagccgtgcatttacgagcagtcgtgcagccatgtgcgggtgtgcatgctgtgtgtacatctgggcgtgtgtgtgtgtgcatgtggggtggaattgtctgtgtgttgctgtgtgggaatggactgctgtggtttgtctggtgcctgagggcctagggagcgtgtacttgtgtgagcgtgtggctactgggcatgggcatgcctgtgcgtgtatggacatgtggctggggttggcttcagcctcaggcctgtggcttccacatgcaccctcccgggccatcagtagaaaatcatggttgcctaaggcaggctttgagtccccggatgtgggtttgagccccagccctgtctctggtttgctgggtgaccccaggctggccacttccctctctggacctcatttcttctgtacgctgggattgtaatctcctgaagatcgcagagggggaggtctgtgggctaggatggctgggcttcccccatgcccatgcactgcctggccaggctcctgagaaggcctgtccctggctgctggagcctctgcccctgcctccggggctcagccttgttccctgatgccatttgggcgtctcttggcctctggtcctacccaggcctgctggatgggaggaaacttttccggccaaaagcttttctatgctcaagggaaagaggggaggcaccagggctggccccgtttgacccaggcagccttcaggccacacccagcccgtggtctcctgcccacgacggccaaagcctctgccaaccaccccctcccgcctgagcctgggcctgtcttcagcaaggaggttggggggacatggacagtgcccccgcaagctgacccagagagggaaagcagttaggccagggccacacagccacagggagccactcacaggctcccagcagttattgagtgcccagtgtgtgccgggcccttctatatgtggttgcatggaatctccccagcagccctgggagcacccgcattgtgcagaggaggaaactgaggcccagatagggccagcaacccctccaagtctcatagctaggatgtgcacctgggatatggaggtcttgctggggccaagggtgcgtggcaggacgtactaatcaagtgtctcttgggtcccttggccctgcctctgtggctgccccggggctggctgttgagagacagggtgggcctggggccccgcctgggcctcccttccctccaatgtcaggcaggcacagaacggtgtccagagcagcggcctgcggggggagagggcatggcggtcacggctcccctcggtgccccgcaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccagtgagccagcctcggagggcggagggcgggcgggcaaagcctcagctgcagactctggggaggggccttggagcctagaagggtggggacttctgttatcctgcttctctccccacttccccctcccccctcccttcctctctcctcccttttccctcctttccttgtctccttcttcttcctcttctttcccccagcccccctcctccctgtccccctctctccctgctccacgcagtgtcccactgcccgcctttctctgcagctggctggtatggagggggctgccctgaggagccccagagtaagctggaagggaggggacagaggctggtgtcatttgtctctgtagccctaggaccggtctgaaccggttgctgggagaggaggagggggcggccagatcgattgcagcaaagagggaagagagcggcagagggagctcgcggggcttgcgtgctgggtgagggctcgggcgtgggcgcagtgctgtagcccacccacctgggcatccggagctgactgcagtgtcgggcctgtgggtgcctgtgtgcccgtgtgtctgtggcacacatggcctctgtgcacaggtgttggtccactccccaccccgagcctcctcctcctctcagcttggcctcctgacttcctctgggatcacccgccactctctgtctcttcggccaccgctgtgtagctcattctgaacccctttccctcagatcagaactctccaggggctgtcttggaatcttgggataaagacccccaccggcccctgagtggtctaatcctaactgcctccccacctccgcctggtgccacccttccccacctgctccctgcgcccctttgtcctccgcttctccagccctgcagctgttctttcctcagagcctttgctctggctgtgcccctgcctggagggctcttccctacttaacccctcaccgtcctgcacatccaagctcagttgctgcttcctccaggaagccttccaggccactcctgctgttgcgcgaacagctctccagtcacattcacatctgtggtcctgggaggtgattagggaagtggggctcctccctggactctgagttcctgagggcaggttccctggacatgttccctccccgcagggttcctggcaccccctactgtctgctgaatgactgactgaatgactgactcagcagatgcataaagcactgtgggcctgtgtgggggtggggctgtgtgcacacagatgtagatgcctggctttgagggcaccctgcgtgtcccctgaaatctgtgtgcatctggcatgtagggcgacacacactgaggggcagggaggccccagggcagaagacccgcctaactgctcctcctgcctcctcctcagaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatgggtaaggcctggcccctgccctcgggagaggcatccaccccccaccccgtgtggcagctccgggctcccttggtccctttgcctttagctgcctctgctggatgacggggccctgttgtaaatctggagctccccagcggtggctggcaccgagttgggttgtggccacccaagcactgtgccccggaccgtgcaaaccatagtgcctgattccaagatccgcacagggctgggcattgcacagacctgctgtgtaggctgggcccggtggcctcactcagagcctcagtcttcccgactgtgaatggggctggtgacagtgggacctatgggagactgtggagaccctgacccagtgcgtgtccacacactagctgttcgccatggagagagaagcccggctcgcaggagggagtgctgggaagcttaggtctggcatggtctgggcctgttagcgatttcccgtctgaccctggagaaacagcaaagcatgagcaccgtgcagccctgacaaaacccaggcccctcttccaccggatgctttctgctcacacggagggaccggaggccagggtggaggagagacggcggttgtaaccccgtaagcccatggtgctagcggggatcacggtgcgctgttttcaaggtggtttcatctgagccgcatctccactcactcccactgcctccacgttccgccctccagagggctgatggaggagagcagagcggcctcctgggtggaaggcactgcagggacagaggcctggaggctggaggtcaggctgtccgggaaggggaggcgtgggctttgagctggtgagaggggagaggggtgagaagccagggtgtgggcacagccacaaagtgaggacttgagcaacacctgggtgaatgcacagcgtcagccattatggtggctgcaaaactcatttctggcttgggtgagaggtgctgtccctgggaagggcctcacttcctccctgggtgctccaggtcgactcatgaagtgccacatgcagatggcctgagccagcagggccacagagattggcctgagccccaaccctcggacggaggcccagcgactgggaggaacgggcccaaggtcacacatcaaaggaacctcgaggcccactgggacaagaacctggattaaacatgctggtctagaatgcagcttcccccagagccccacagttagaaaagcagatagtagtgaaatgataaccacattacttactgagccctcacggtggggctggcccagtggttaaaatctcattcaatcctcaaacagctccacgggtaggcactatggaatccccattttccagatgagataactgaggcttagagaggggaactgactctcccatggtctctccgctggcaggaggcggaggtgagaggctctggccagcctgacccccaagccctcatgcttaggacagtgtctcattttggggggcgggtgggctccagaggtgacctcttgttctggcaacagccttagaaatccctgggccagctccacatcacccctggcttccaccagtacacattgcatttgctaacacatgaggcacgttcaaagtcctgctcagagggaacatgactaacccagaagtgacaccggttgagttggaaccttggtcccctatctgtctaggctaataagctgctttttaggactttttttttttttttagacaggatctcactctgtcacccaggctggagtgcagtggcacagtttcggctcactgcaacctctgcctcccaggctcaaaccattctcctgcctcagcctcccgagtatccagtattacaggcacgcaccactaccacctagctaatttttgtatttttagtggagacagggtttcaccatgttggccaggctggtcttgaactcctgacctcaaatgatccacccgcctcggccccctaaagtgctgggattacaggcgtgagccaccacgcccagcctggacattcttaataatcacagtcccgacaacagctactggttcttgagcatttaatcctagtaacagtgccatgaggagcaccctgtcattgtacccattgtacagatggggagactgaggctcagaaagggcccaggctttgactgggtttgtcacatggctgtggaggccacagctgacactggcgcccaggtgggcagatcctggatccctgtgtggtaggagttggggggctccactgagtcagcctgcatccctcctcaacagggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaagggtgagtcctgggcggccggggcagggggcaggggcactccggacagggcagggagcatgagcctcatttcctctcatgtctagaatgggcatcttcaaaggtggaatgcagtagagccaaattctctgttgcctgggccggagtgtggtggtgcaatcatagctcacttcagcctcaaccttccaggctcaagcagttctcccacctcagccacccaagtagctgggaccacaggtgtgtgtcaccaggcccagctaattttttattttttgtagagatgggaccctatgttgcccaggctggtctcgaactcttgggctcaaggagtcctcccacttccacctcccaaagtgctgggattacaggtgtgagccacagtaatttttaaactaattagttatttttcaaaattccactttttggaggtatagtttacatatgataaaatacaccccttttaagtgttcagttcagtgggttttaacaactggatttactgtgtacccctaaccataatgaagatatataacatctccatcacccagaaagttcctcatgccctttgcagacagtaccctccagccccaaacccaagcacccactgatttgctttctgtcattataaatttgttttgtttattctagaatttcatacatggaatcttttacatctgggatgcattgtttttttactttttacatttcaattttttattttttgagatgaggtcttgctatgttgcccaggctggagtgcagtggcgtgatcatagctcactgcagccttgacctcccaggctcaattgatcttctcatctcagcctctcaagtagctgggactacaggtgcacaacatcctgcccagctacttttttttttcgtattttttgtacagacagagacttactgtgtagctcaggctggtctcaaactattgggctcaagcgatcttcccacctcggcctcccacagtgctgggattgcaggcaggagccactgctcccggcctgagatgcatccttgttgcatctcccagcagtttgttcctgttgttgctgagcgggactccgctgtctgcattagcacagtttacctgttcacctggaggtggacttctgcttgtttcccatcctgcttgccttttgagtgacaagcactgagtgagactttattcagagatgagtttacgtaaaatctgctgtgctggttaaagcaaggccagccacctgggaggatgggttttgggaatcactgcatcctggcagagggacagggcaggagctggagctgggtctctctctgcccagggagtttgctggactttctcaagggggagacaggcaagtacctgcggctgcctcagctggtggacatggctgctcaggtgagtcagcccctcccgcctccccacacccttggtcctcaagcacccagacccatctggtgcagccagttctggcctcttgagtgccccctccaagaagcctgccttgattgcctccacactcactgatcttgccgcacgtatttaccaggtctgcttacaggtgccctgaggggtgattctgggcagcagaaggcccttacctgggcatcaggggtcactgacttactgtgggacctcgggcctcagttgtcgtctctgtaaaggtcatttagtcgcttagcagacgtgttcatgcttgctgtaggcagtggtcaacaagcctttttttttttcatttaatcctcatcacgaccaggagtgacgaggattggctgttattcccattggacggatgagaaaactgaggctcagagaggggacttgggcagcaggcaggacctggcactcatctgtgtctgggtccgctggggcctctttccctggtcacctcgctttcctggctgcatcggatctcgtgcctcccctttgacctttgccttctgccctctgctctgtgccctgtgctccctactcccgcagagcactgctcctgctttcgatgccaacagcatttactgtgaactgacctcacttgcctgaagaagtgtggggagggtggggaaggggtggttggctctccagccccagagtgctctgtggccctgggagggcatgggtggcacctgagccaggctcccacggttccgcctgcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgggcaggggctgtgtggtatgtcgcgcttggcctgggacaggtcacgtcccgctctgagccccagttttttcctcagctgtcattcctcatggtgcttatctagcagagcggtcatgacaggaggtcagagctgccctgacctttctcgttcctgcaggtgccaaattccccatcaagtggacggctccagaagctgccctctatggccgcttcaccatcaagtcggacgtgtggtccttcgggatcctgctgactgagctcaccacaaagggacgggtgccctaccctggtaagaaggtcctcatggcctgtctgtggtccctgaatccctctgccctggtggccttgggcaagtcatgactcctgctgggcctgtttccccacccgtaaaacaaagaagttgagcgtctgatgttaggctctctcgatggtccatgctctcagcttcggggacaggacttatctatggtcactcccaacctgtcctaggcaggaagccctcgctgccctccccatcagcttcccccaccccactttcctcaccggagccgggctccccatgcctcgctctgcccacagggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactggacatttttctgttcagtattattttcacaagccaaacacatcatagtgtccaggtcagggtggcatctgggtggcatctggagatcgcagggggcgggtgtgtgtgtgtgtgtgtgtgggtgtgggtgtgcgtgtgtcttaggagtagagatggagttctggatgtgagg

SEQ ID NO: 16154 - DNA, 22339 bp, Human; identical to SEQ ID NO: 12411
  misc_feature (1)...(22339): n = A,T,C or G

SEQ ID NO: 16155 - DNA, 10321 bp, Human
  misc_feature (1)...(10321): n = A,T,C or G
tgagccaccatgcccgtccaggttttatttttaatttttcaaaattttcatatttcttcaggatatagggtctctctgtgtcccccaggctggagtggtttgaccatggctcactgcagcctcgagctcctaggctcaagggatcctcctgcctcagcctcccaagtagctgggtctatagaagtgagccactgtggccaggccaccggtggctcacacctgtaatcccagcacttcgggaggccaaagtgggcagatcacgaggtcaggagattgagaccatcctggctaacatggtgaaaccctgtctctactaaaaatattaaaaattagctgggcgtggtggtgggagcctgtaatcccagctactcaggaggccgaggcaggagaatcacttgaactcaggaggcagaggttgcagtgagccgagatcaggccactgcactccagcctgggcaacagagcgagactcagtctcaaaaatgaaataataaaataagaagtgagccactgcacctagctaattttttctattttttgtagagatggggggtctcactatgttgtccaggctggtcttgaactcctggcctcaagtgatcctcctgcctcagcctcccaaagcgctgtttgagagccactgctcccggccgagttatgggtttttatttatttatttatttatttgaaacagaatctcgctctgtcgcccaggctctagtgcggtggcgtgatctcggctcactgcaagctccgcctcccgggttcacgccattctcctgcctcagcctcccaagtagctgggattacaggtacatgccaccacgcccggctaatttttttgtatttttagtagagtcggggtttcaccatgttagcaaggatggtctcgatctcctgaccttgtgatccacctgcctcagcctcccaaagtgctgggattacaggcatgagccaccacaccaggcctgagttatgggtttttaaaggtgcagaggcagaggtcacaggcaagtcataaatcagtacatggaggttgtacactggttttgccataaatagcaaggagatcttgaagccagggaccacgggtcataggtggattcaaaggttttctgatttggtgcagaagcgaatctttgtctaaaactttgggatccgcaggaaagaatgttagctctgggttgtgggcatggcctcctccaggcccctcaggaagaaatttaggtaagagaagggtggtcagaggccagtcctcagctcccgctcatgtgaggtctgtgtgccagcacgcccctttggtgggagtccctgtttctggaaaacaactgaggagcacctgctaagatggcatggtttgcttctgtggagactctcgggactctggcttccatctgttgttctaagctcctgtgaccttcttgtgaccttcctgtggatcggctgctcatttccttctctgggctggctgggggcctggcttgcccttgaaggaactcaacattgtccttgcttctgtgcttgggaagacccacaggcccctaagggcggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgagcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttggtgagtagtggccaaccccgctgtctttcctggcagccacttcccccagtgagtcagtgggggtctgctcatcacccaaggggcagagggagctgacaggcttttaccaccgtggctgaggtctgggtctgcagatgcctacccgccaccctgttattcagaggggactcccagccaacctcctcctctgctcccccatggtaaccagtgcttccaccatccccaggccagtgatggtctgggaacctcaggccacgtgggctcagctgacctgagtggacgccagtcacaggctgggtcgggccagggcagcgcaggcagcggtttccacatggatggcatctgatggttggagctccatcagggcccagagctgcccaggacagcccatgtcccagggctggagaagcagctggacggggcctgtgctatctaggatatgaggattgggtgccatgggatctgagcagctgggaccaccgggctcctgagtgctggttttgcacaggctggtgctggtcccagtcccggggacagaggctgaaccttagtgagggaaggtgccatggcagggtccaccccaatcccaggtgcccagcaccccttgcagagcccgcgtccccgaaatgggccacctgcccttgctttctgatcactctcacgcctgaagctcggcaaacagctggtagtagcccagggctggagtcaggaatcccagccaaaaagaccaggggcaggaaaggggaccccaagaggtggtccctggggcatccagtgcgggcaagcagcccctcctgtctgtgtcatgtgcctccttccagaactttccggcagcatgtgcagctgacagcagctcgatgggagattaggaattcccctctgctgttaataggcttaggggaagctgaactgcccttggcccaggtcactggggcttagggcatctggggagaggctgtagggagaggaggaggagaggccaccctgtgcagcagtgcagggacactgatctcgtccagagcggccgaggcccttcagccacgccacgccacgccaggcgggtgaccctgctccccgagctgactccagacacagagagggcctggtgattcccccagcagggggaacacatgcccggcaccctccgtccccaagccccagcttgtccctctatgaagtggggttggggaacgcagggcttcacagctcagcaccaagtctctgagacaggcccctttcccaggggcgccgtgcctggggaccctgccccccattttgtgggtcattctccatcagcactgcggggtgcccgtcatggtgctgaggggctcagggatgcctccgtgagtgggtgaagggaactgacagcaccccaactgcaaagcacagacaagaggcagaaagcaataaacccatcaataagaatcagaggggttggccgggcgcagtggctcacgcctgtaatcccagcactttgggaggccaaggtgggtggatcacgaggtcaggagatcgagaccatcctggctaacatggtgaaactccatctctactaaaaaatacaaaaaaaaaaataaattagccgggcgtggtgtcgggcgcctgtagtcccagctactggggaggctgaggcaggagaatgacgtgaacccaggaggtggagcttgcagtgagctgagatcgtgccactgcactctagcctgggcaacagagcgagactccgtctaaaaaaaaaaaaaggtgagattccagccacagctctggaataggatcctagggggctactttggcaggtattaaaacttttttaggccgggcgcggtggctcacgcctgtaatccctgcactttgggaggccgaggcgggtggatcacaaggtcaggagtttgagaccagcctgaccaagatggtgaaaccccatctgtactaaaaacacaaagaaaaattagctgggtgtggtggcgcatgcctgtaatctgagctactccggaggctgaggcaggagaattacttgaacccgggaggcagaagttgcagtgagccaagatctcgccactgcactccaacctgggtgacagagcaagactctgtctcaaaaaaaaaaaaaaaaaagaatcagagggcaacagcccgggagacgcccaccagcctggaatcagggctaactcgacgcgtgatgagaagcggcaaatcagaacctaaggacacagtggctgcagggcgggggttcaggggagacctccctgagcgggaacttgagatggaggcagcccactaaccatcaggaagggcagctcagaggcaggctcctctgctgggcctggcaggcccattcccagcaggagccacagaggactttcatcagagtagcagctgggccgggtgcggtggctcacgcctgtaataccagcactttgggaggctgaggcgggtggatcatgaggtcaggagttcgagacaacctcgtcaacatggtgaaaccccgtctctactaaaaatgcaaaaatgcaaagattagccgggcatggtggcagacgccggtaatcccagctgctggggaggctgaggcaggagaatcacttgaacccgggaggcggaggttgcagtgagccgagatagtgccactgcactccagcccaggcaacaagagcaaaactctgtctcaaaaacaaaacaaaacaaaaaaaaacccagagtagcagttaaatgccgacgggagtcacgcttccctggggtggggaacgcaggggaaggggcaggaagttgtcagtggtcacccacagggaggtggtgaggactccaggctcaggacctgccacaggttgggaggctaggtttgctgtggattgtgggccggggcgagggaggccaggacaggggggagtccggagctgtgtgtggccagcgttgcaggggggcatccactaggcaaggggaatgggagcgtgcgggtggacccaagcaaagctggcaggctggttaccccagggcggattgcaggggctgctgtctggatgacgctggagctggcggggctgggtctcagcccctccaccggtgggttgagacccccacaagggttggaagcaggagggctgactgggacccgggcctggtctgcccccagaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtaagcagagctgggggatggggcctctgaaagggaggaggcggtcctgaggctgcacaggaaggggagggcggggcagagcctggggccacttcactgggtgagtggtcccagcctcacagctggggaaggtagggcggtgcctgagggcctgagcagggatggaggagggggaaggggaattgggggctcctgtcacccgctccagatgctactgccaaccatgcttgaaaatacagccactgccggccaggcgcggtggctcagcgctttgggaggctgaggtgggcagatcacctgaggtcgcgcccggcctaaaaaaaagttttaatacctgccaaagtagccccctaggatcgcgagtttgagaccagcctgacaaacatggagaaacctgtctctactaaaaatacaaatttagccaggcgtggtggtgcacgcctgtaatcccagctactcaggaggctgaggcaggagaatcgcttgaatccaggaggcagaggttgtggtgagctgagatcgcgccattgcactccaggctgggcaacaagaagaacaaaactccgtctcaaaaaaacaaaacggccgggggcggtggctcatgcctgtaatcccagcactttgggaggccgaggcgggcggatcacgaggtcaggagatcgagaccattctggctaagaaggtgaaaccctgtctctactaaaaaatacaaaaaattagccgggcgtggtggcgggcgcctgtagtcccagctactcgggaggctgaggcaggagaatggcgtgaacccgggaggcagagcttgcggtgagccgagatcacgccactgcactccagcctgggcgacagagtgagactccgtctcaaataaataaaaaaaatacaaccactgccacccagggacagccatggcacaatgcaccgaggagtgtccactcacacatgcgcacacacgggcatctcactcccatcagtgcaccgaggagtgtccactcactcgtgtgcgcacacaggcaccgcgctcccatcaacgcaccgaggagtgtccactcacacgtgtgcgcacacacgggcatgacactcttatgcacaaacacgctcacacctccacatatgcacgtgaggcacactcacagacaagccaccttcacaaatctacactcagaccatgcaccaaccacgcacccccccgtactcccccagggcacgcacctgcccagcatcctgggacttgcacctccttttctaggcctcagccccatgatgctctgggcagcagactcaccctgggtctgtgagggaagcctcctcagatgcgccaagccctgggaggttggggaggaggcgggtctctgcccactgggctcccagccaaacacctcatctcctaggaaggctagagatgacctcgggcctcaggctgactgagccaggactgggcccggccatgtccctgagtgctctgtccttgcaggtttggggacgacatccctggaatggaaggcctgggaacaggtatgacggctgccagtaccaacccgaggtctgcccaggtccccccaggcacacccagcacgcccggggcccattgcagcccacctcggcccccacctcccctgcttttcacttagggacccccagcctgtccatcacttcttcccccaacactgagctccagatccactggatctagagggtggggctgtccccatttgggacacttgcaccaggtgaggggaggggtttgggaaagaacagaacccctcgctgcctcctccccttcagcaagccccaccctcctctggttccctcccctggacctgctgcacccaccctccttcccccacagccagtgtgtccccagaggagggccccactccagcgtccgcacgtccccgctcagcacactgtagggctacacctgggctgtgggaaacagggccacaggggatgggggggtccctaggccgtgggatcctctctgatccgtggcccgtttctcccacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcctgtctgtggcatatttgtgcatgggacagggcctgtggtggggtcacttgagttgagccggagcacatgggggaaggggtgggcagtggggcaggaggggctggcctgcttgagtgggaagacagcccttgggctcacactctcactgagccttgctggtggccccaagacacgcaatgtcaggccatggctgggtcaaggcagaaggctttggtgcacacccaggggccatagtcaacgaagcnnnnnnnnnnnnnnnnnnnngctgggtgcggtggctcacgcctataatcccagcactttgggaggctgaggcaggcagatcacgaggtcaggagatcgagaccatcctggataacgcggtgaaaccccgtctctactaaaaatccaaaaaaaaaaaaaaaaaaaaaatagccaggcgtggcggcaggcgcctgtagtcccagctacttgggaagctgaggcaggagaatggcgtgaacccaggagacggagtttgcagtgagccgagatcgtgcccctgcactccagcctgggtgacagagcgagactccgtctcaaaaaataaaacaaacaaacaaacaaaaaaaaagaaaataacaataatgaggctgggcaccgtggctcacacctgtaatcccagcactttgggaggccaaagtggacagatcatttgagctcaggagttcgagaccagcctgaccaacatggagaaactctgtctctactaaaaatacaaattagccaggcatggtggcccatgcctgtaatcccagctacttgggacgctaaggcaggacaatcacttgaacctgggaggcagaggttgtggtgagccaagatcgtgccattgccctccagcctgggcaacaagagcgaaactccatctcaaaaaataaaaataaaaaaaatacaaaaaattgtctgggcgtggtggcgggcccctgtagttccagctactcaggaggctaaggtgggagattgcttgagctagggaggcggaggctgcagtgagctgagaccctgccactgcacttcagcctgggtgacagagcgagaccctgtctcaaaacaaaacaacaaaaacaaacatgcccatttgtaaccaagatcccactcctgacaccacatccaggggaagcaagagctctgcaagctggcccagcagcaggggccctcacagtagccccctgttcacatggaccagtccattcgcagcaagggccagatctgactccccacagaccctctgggattccgcttatgtgaaagcccgaaacaggccccgctggccctggcaatgtagtcagtgcagggctgacttggggttgagcgcgccgccaggggctggaactccccgatcggacctgcggtggttcacggtcttcgatgggtaagaattccctacgctgcctctgaagattggtgtctttactgtatgaatgatacaccccgaataaaacatttactatctccccaaaaatgcactcgggagggagaggcctggaccttatctccaccatcacgagcccagaaggggtggcggccccaggggagggaggtgccaggaggtgggaactgtgcggctggggtgggagtgggggctcggaggtgagggtcagctccaggatttcctccggccccgcgtgctcctcccgccagtcccgtggcttcgccgggcgccctgcgttgggggctggcatgggggacgcggagcgagcgaagtgagcgagctgggtaggtcctgcggcgaagtcacccgaagcccgagcgaaatcaggcggcggcggcggcgcaggcagcgctttttagccgggcggaggcgccccctgtatccctgtgcgtggcggtctcggacctcggggcgtgcgctcagccccgggcgggcttggcagcgggcggggcgccggggctggggctctgggggccagcgcggtcctccccgcgcgctccggggccgtacgccgccccactgcgggcagcgagggccccgagtagccgggcggccagcaggagctccgcgccctgcagcagcaccaccgcgattgcgtagccgcccgaggcagccaggttcgcgcgcagccaccgccggagcggcgggccgcagccctccaggtacaccactctctgagctgcgtccgcatccaggcgcaggaccccgaagccgcactggtcgttgacagaggctccatcttcgcgggggtcgatgcagcaggaggcgggaaggctgcaggcctgcaccccg

SEQ ID NO: 16156 - DNA, 77036 bp, Human
  misc_feature (1)...(77036): n = A,T,C or G
gaaaatgtggtacatatacaccatggaatactatgcagccataaaaaagaacaagatcatgtcctttgcagggacatggatggagctggaggccattttccttagcaaactaatgcaggaacagaaaaccaaatattgcatgttctcacttataagtgggagctaaatgatgagaacacatgaacacataaaggggaacaacacacactggggcctaccagagggtgaagggtgggaggagggagaggatcaggaaaaataactaattgcttaatcctggataatgaaataatctgtacaacaaatccccatgacacaagtttacctttgtaacaaacctgcacatcctacacatgtaccccaaacttaaaagttaaagaaaatcgtgacttttgttgaaatttactggccaaaacaaaccagatggtcctagttcagtggcttactgctataacctcagcattttgggagactcaggtgagtgcatcagttgagcccaggagttcaagaccagcctgggaaatataacaagaccccatctctacaaaaaaatacaacaattagctgggcatggtggtgcgcacgtgtagtcccagctacttgggaggatcaggcaggagaattgcttgagcccaggggatcaaggctacagttagctatgatcactccactgccctccagcctgggtgacagagcaagaccctgtcttaaaaacaaacaaaaaacaaatcacatggtcacatttaacttgaaaaggagtactaatgactaacacatatggggtctctctctctctctctctctgtttttggcaatgtaattgatcattatttttcctaatattgcactacttttacattccagagataaactgtatgattatgaggtctgattgttttgatatgacacttgtttgatttgataatatttatttagatttttgcatctttgttctctggtaagattggcctggagtttccatttcttacgcttttctcagcagttcagtgtcagggttttttgttagcattataaaaggagatgagtatttttctgttttttttttctcctcagttttcagagtttacatagatttccaatatactttttgtgagtttaggacaactacaaaattagatgatacagtctccatataagactattctcacttctgacaccaactgtaagcttgggggattcccaaaaccactctcaggtttgataattcattagaaaggctcatagcatttagtgaaagctgttgtacccatagttatgatttgttatagggaaaggattcagataaaatcagccaaaggaagagactcatagggctaagtttaggagagttccaaatgcgagcttatcttgccctctccccatgtggtcaggacacatttctctcccggcatcaatgtatgacagtatgcacgagtaccatcaaatagggaagctcacccaacctttactgttgagttttgatggagcttattcacataggtgtgattgattacttgctcacagggatttcagtctccgtgttgagtgaccccctgtgaccccaaacccgtatctcaagttgtattgttcgtcttcccagttggtgagcctctacataggattatataggtgtggacagtcccctccctgaattgcattattagccaatccagtatgacccaaggcctcccaaagacatactttttagacgtaactttctaagtgtccagagattatctactagaagccaagaagaaagaccagactgtctccttggacaaggccaaattcttcactaaacacatttgtacaatttttctcttttatgattgtcttcctgtgattcctcaataacggattaagcctgtagggattccattatggaaaactggttcatttaaatttgagcccttcatttctctagctgtctcataaaaattacaggatactttttatttaactgcatttaaattaaactcccttttatctttttttttttcaagaataaaggttctcttcagtttgaagacaaatgggattttatgcgcccgattgttttgaagcttttacgccaggaatctgttacaaaacagcagtggtttgatctgttttcgtaagtaccccactaattctgtttgctagcataaaggaaattttagtgatgtctttccatacccaaatggaatgtgtaactctaagtttatctgtttacctattaaaaagtattactagttacattgagggtctccaagacctctcccaggtatgatgatttgctagggggctcacaggactgaacatacaatcatactcacagctttgagtcattacagtgaagggatccaaagcaaaatcagcaaagggaaaaggtacatggggtgaagtgcaggaaaaaacaagcacatgcttccaagaagagtcctttcccaggggagtcacacaggacacacttaatttttccagcaatgattgacagcgtgtgatatgttgtctaccagagaagcttattggagactcagtactcaggatttttatgggggctggtcacataggcagtctctctcaacatgtaccaaaatcagtgtaaaccatattgtttatataaacagtttaggtacagtgagccactgttatttcaggaaagtgtaggaaactgttgaccattcaagttctcagatgccagccaaaggctaatcttacaagcaggcatttctaggggatgcagtctcaggggtgctggtagttggtgctgttaggtatgattgtaagttcagcagtcaggttgaattaaaaggactcatggcagcttggaaagggaaccctgagagatttcctttaggaaaagggggaaagctttcaggactagttgtgaaaagcaaaaatcattaatgtcctcctcctccgctgtctcttcccagctgctgtgttttgttttttcttcctaataaaatcagtgtatccctttcagtaatgaaaatttcatgtcttctcaatcatccagacctgcatgagggacaaaagtctttttcactaaaaaacatttttagacaacttaattagaaagacatattatatttaggaattggtcaggatgaaatcctgaatttttaaaacttttcaaaatgggcttatgttatctcccaccccttttgtcctgatcatttatctagtgggtagcctagaaaacatcagttcctttctggggacagctgcatttaataaccagactgacttactgaggtgtgtgtgtaccaggaggggtgacaggaaagagagaactagagtcaggttattaaatctgttgttgcaaactgtaaccaatccagaaaggcaaacacaagtcagtagcagtgagacatctcaagaaggggtcaaaatctaatctgtaagaagtgggcgaaggggctacactctttgtgatgtgccccctcccaactacagcttttggtaggaaccaccagttgggaatactgttaatctccatatcagatacataagaccaatcagcagcttgattttggatagtcccatcagagaataagcctttttctttggttatctgtgagtggttgaggtggtccagccagaatccatgatgttttcatagtttctggctccacaggaggatatcttttaaatattcagtaatctttgacggccagacaaagtggcttacgcctgtaatcccagaactttgggaggccaagacagggtgatcgcttgagcccaggagttcaagaccagcctgggcaacatagtgtgagaccctgtctcttaaaaaaaaaaaaaaaattatctgggtgtggtggcacatgcctgtagtcccatctaattgggagctgaggtgggaggattgcttgagccctcaagcagattgcttgctgcattgaggctgcagcaagccgtgactgtgccactacactccaggctgggtgacagcaagaccttgtctcaaaaaaaaaaaaaaattgaggcaaagtcctgtttattgagtatatgcctgcttttggttcagcacagcttgtgttgaggttgaaatagcccagtagcagagtgtcaggtttcagcctagcctcagatccaggtaattgagatctgtgatttcaggattccaaaacagttagtgtcttgtctttggcagcagtaaagccaagatactgcaggctcgcagccatatttcaagtccgagtgatcagcgagactgtcctaagtcctttttaccttgtcttaggatccaacttgatctgctcaaaaatatgcacatcaggctggaaaatcatcagcttctaagggtcagacatctaatttcacaagaattcaatagcaatgaaaaactgcatttaaaattccaaaagtgtatttcttccatctggagatttcgtttgttttcatgttgtctctctttttccagggtcatcagtagttaaaaaagtcatagtaaatatcatccattgtggagatttattctgctcccaatactcagagagtttaaattccagtcccttcagcagaaaaaagcaagaaattttgtctcactaactcttcctgattgggacaatccctctagcatttatgaaatgactagcagcatattacatattatgtcagttttgattatacatctagatgcaatagctgcaaagtacaaagtcatctttcaaccccccactttactttaaatttatttatttattattgagacagagtcttgctttgttgcccaggctggaatgcagtggcacaatctcagctcactgcaacctccacctcccaggttcaagtgatactcctgccttgcctcttgagtagctgggactacaggtacccaccactgtgccaggctaatttttgtattttcattagagacaggttttcaccatgttggccgggatggtctcgaactcttgacctcaaagttacctgcccaccttggcctcccaaagtgttgggattacaggcgtgagccacggtgcccagccatccttattccttattttaaatttaatcaacccccagcagtaaattcagtgtttataagagtaacacattacagctgctgggaaatcctgactggaatgcaaggtgtagggaggaactgcaggcagcagcagctagtctgaagaaacagctggagtggttcactctccccactcctgtttctcccctagtttatctaaagctttgctccagccctgggctctgatcttgctattattttttcctatttagaggagagagcatacaaacttttaacatttttggtccacccaaaactcacctttgggaacttttgggcctcttcccacctggaggcaagaaaaaaaaaacaaaaacagagacatcatccagactctgttttttctctcttcactttagtcagcatggccagaaactgccaggggaatgaggtagccaattttcctggtttagagctatcattttcaaatttcataggtaatttttacctgtcacaacagacagaagctcagctgctgtttcatactgtgaatgattttatagccacccaagcagcaaatgtttgtcatcctactgcttcttccctcttcatgagtccaacttctaacaccagctgtgttggcaatcccaaggtcacccctaggctcagtgattgctgggagtattcatgggacttaccatgtagttgtattcatggctatgaattattacagtgaaggaagcaaagcaaaatcaacaaagggaaaaagtgtgtgtggcaaagtccaggagaaacgaaatccaaacttccaaatgtcttctcgcagaggagtcacacattaagcttaatcctccagcaactgacagtgacaacacatataaaatattgtctaccagggaagctaattaggggctcagcacccaaactttctactgggggctcgtcatgtaagcagcttctgcctggcacataccaaaattcgagactggcagaagaaaaggaagtgttcaacgtaagtcacactgtttgtgtaaacagtttggaaatgtaaaacattctcattaaggaatgatgggaatcctcccaaaaatccaaattgccacatcctagccaaaggccagtcttgcacacgggtctgtcttaggatagcagtctcagacacactattaaaatgctgtatcaatgaattatagatgtataattgcataagctgtacacattgggctattgtaatcgttttctctctttatcacttaaaatattctaatttccgaaatgatgtaggaccttgctgcatactatcaattaacttatacttcttgcctttgggaaattaaagtttagtaagaaacagctgaggccttttaaagctttattacattcatgtatacatatattttttgtaaattattcaattaaactattttatgaatgatatgttgggtgtggtggggtgttttgttgttaatgttgtttttgccagtctgtgttgataagatttattattgagaatagtgcttgttctctgagtactcctgacttagaaaaggagcatagccctactaaaggggacttcaaagtagaaatcgtcaataaccttttacttgctacagttagtggcctcaacatgatgtttttaaagatcttttggccaggtgtggtggctcacacctgtaatcccagcactttgggaggctgaggtgggtggattacctgaggtcaggagttcgagaccagcctggccaacatgtctactaaaaatacaaaaattacctgagtgcggtggtgggcctcagtaattccagctacttgggaggctgaggcaggataatcacttgaatccggcaggcagaggttgcagtgagccaagattgcaccattccactccagcctgggaaacaagagcaaaactccatctcagaaaaaaaaaaaaaaaagatctttcatctccttggagtacctaaagcagttcagtgtatcgtccttttaggtaaagggatttctgactgacaataattaaaacccttgtaaattttagccatattttggccatgttaatcgttaacatttaggttgcttatatctttctaaatcttagttactaaataatgtattgatgttaaggtacattgactgagattttccccccttttctcctaatctatattctttctctattgaagtactcttggtattttgggtggtataagagattgttctgcatgttgtgcaatatttatcacttctgtccttcactcttttttttttttctttttaaattgagatagagtttcattcttgttgcccaggctggagtgcaatggcgcaatctcggctcactgcaacctctgcctcccaggttcaagcaattctcttgcttcagcctcccaagtagctgggattacaggcatgcaccaccacacctggctaattttttgtatttagtagagatggggtttcttcatgttgatcagactggtcttgaactgctgacctcaggtgatccactcaccttggcctcccaaagtgctgggattacaggcatgagccactgtgcccggcctgtccatgcttatgaactccagtcatgaacactccttctgtgtctttctcctcacccttctgtgtctttctccccaccttgcattataaaaacaaagattctcacatgtttccagatacccttctaggggaacaataccttccttagttgagaactgctgctctagatccatttacaattttacccatttttaagtgtacaattcagtggcattaattatattcacaatgttttgcaaacatcaacacagtccattccccaaacgcttcatcatcagaaacagaagctctgtacccattaaacaataattcttcattcttcctctcctcagctccattttagtttccatctatgaatttgcttatctagataactcatataaatggaatcgtatagtatttgtcgtttggaaagacatactgttttttaatgggcttggttattcagttcaggtttaatgttatgactgatattcttgcttttgttgcttctataactttatcatggatctgatgttattgtttcttcattttccctttgtttttattaattttaaagtttatttccattagtggttgccttcgtgtttcttggtcttagttagaagcatgtgattgtcctactacttggaaacaaaatacatatcattttatcacaccagggtcacactatttcttgttctcttctacacaaggaaatcaaaacctctggaatagtttttacttcttgctgcttttcctgtcgcttctgtctgcctccttaagacttttgagaagcttctatttcctccctctcctatttcccaactcctagatttttctaataaagtttttaaaaagatttaccttatagcatgttcccttttaaaagcactttggggctggatgtgatggctcatgcctgtaatcccaacactttgggaggccgaggctggaggattgcttgaggccagagttcgagaccagcctgggaaacacagtgagattccatttctacaaaaaattagccaaggctgggtgtggtggctcatgccggtaatcccagcactttgggaggcgaaggcaggtggatcacctgaggtcaggagttcgataccaccctggtcaacatggtaaaaccctgtctttactaaaaatacaaaaatcggctgggtgtggtgttgtgcacctgtaatcccagctacttggccagctgaggcacgagaattgcctgaacttgggaagcagaggttgcagtgagccacgattgtgccactgcactccagcctggctgacagagtgagactccgtctcaaaaaaaaaaaaaaaaaaaaaaaattagccagtcgtggtggcacgtgcctgtagtcccaactactcaggaggctgaggcagaaagatccttgagcacaggagttttaagttacgagcttatcatgccactgcactccaggcagggtgacagggagagaccctgtctcaacaaaaaaaaaagtacattgagaacattcttccctgatacagcaaggcagagaagtaactggtgattgagaaaagagagctggagaagatgtaccaaatcccttctaaatttgactcttcttttgataagatttctagggaattatctaactccacccccttttaccacaccattccctgttatcctatgagactcaagtcctgtttgaacctttctgacatatatgcaaaagtgatttgagtacggcagggttacaaaggtaggtttgtttttgggatgcacaggtctcctctgatgggtgactttggctccagaattcttcaacagccttaccaacctttcttagaactgtgctgattcttactgctcaagcttcctttcttgtctcctctacagggatcacacctacacccagctttctgtagcccattttccttcacaggtgttcccttagtaaatctcttatattaataatctcattagcttcttttgtttctgttttttcttttttttttttttgagacggagtctctgttgcccaggctggagtgcagtggcatgatctcggctcattgcaacctctgcctcccaggctcaagcgattctcctgcctcagcctcccaagtagctgggattataggtgcctgccaccgtgctggccaatttttgtatttttggtagagacggggtttcactatgttgaccagactggtcgcgaactcctgacctcaggtgatccacccacctcagcatcccaaaatgctgggattacaggtagagccaccatgcccacacccggcctggttttttctttcttttttcttttttagacaaagttttgctcttgttgcctaggctggagtgcagtagcgtgatctcggctcactgcaacctctgcctcctgagttcaagcgattctcctgcctcagcctcccaagtatctgggattacaggcacctgccatcaagcctggctaatttttcgtatttttagtggagatggggtttcatcatgttggccaggctggtctcgaactcctaacctcaggtgatccacctgcctcggcctcccaaagtgctgggattataggcgtgaaccaccgcaccaggccccatcagcttcttaaaaggcttcttaaactaacaccagtcaatgtggaatgtctggcacatagtaagcagttaatacatgttacttttgttatagtaaactaaataaaagatgatggggactatcatggtaatgggagggaaacgtccacattagagagacatttgcatgataaatataataggactgtgattgaatataagggataaaagggggttagtttgcccaatttttttcttatcacttcacattttcacattttactttacagggtagccacattgatgtgcttatagtccactgcagttaccttagtcatccacaattctttttttttttttttttttgagacagagtcttgctctgttgtccaggctgcagcgcagtggtgcagtctcggctcactgcaacctccacccccgggttcaagcaattctcatgcctcagcctcccaaattgctgggacaacaggcgtgcctcaccacaccaggctaatttttgtattttttttagtagagacggggtttcaccatgttgtctaggctggtcctgaacacctggcctccagtgatccaccaactttggcttccctaagagctgggattgcaagcttgagccactgcacctggcccacaattctatatactgtcgattttttttgataaaatatcctctctcctatttttgtacacctttgcctggcaaactcctatttttggagattaagctcaggaaccaactattccaggaagcctttccttttcctctctacctctcactcacccttaccctgtccttgagttcctaaaccatcttttgtttatatgcataaaatagttgtaaacatattataatcaatttttctatcagtttctttttttttcttttttgagacagagtcttgccctgttgcccaggctggagtgcagaagtgcagtcttcgctcactgcaacctccgcttccagggttcaagcgattcccttgccttagcctcttgagtacctgggactacaggagcgcaccaccacgcctggctaatttttgtatttttagtagagatggagtttcgctatgttggccaggttggttgcgaactcctggcctcaagtgatgtgtccacctcggcctcccaaaatgctaggattaaaggcatgagccgccatgcccggcctgtttcttttttaaaaaaattgtttttagaggcagggcattactctgtcgctcaggctggagtgcagtggcacaattgtagctcattgtaaccttgaacttctgagttcaagtgatcttccctcagcctcctgaaaagctaggactacaggcatgtgccaccatgcccaactaattattttattttatttttgtatagatgtggtcttgccatgtggcctaggctaatctcgaacttctggcctcaaatgatcctcctgccttggcctccaagagtgctaggattacagacatgagccaatatgcctggcccagtctcttcttttagactctagattcttttagtcattagatgagactgtataggtatgcaggagtcatttaatcattttgtaatttattctaagagtattgggaaaccattagaggatttaagtatggggtaatatgatgtgacttgagttttgtaaagatcactttagcttcttgtttaatagattggagggtttcaagagtagatttggtttagtgtgagttctggagcctgatttcctggctccaccataaacttaactgtataatcttggattgtttttccttcaatttccccatctgtaaaataaggataaaatagtagtactttagaattgctatgaagataaaataagttaaaagaacttagaatagtatctggctggtgcctcatgcctgtaatccagcactttgggaggccaaggcaggtggatcacctgaggtcaggagttcgagaccagcctgaccaacatggcaaaactccatttctactgaaaataaaaaaattagccagtggtgcatgcctgtaatcccagctacttgggaggctgaggcaggagaatcatttgaacccaggaggcggaggttgcagtgagccaaggtggcgccattgcacttcagcctgggcaacaagagtgaaactccatctctaaataaataaataaatagtatctggcacatgataagcagtcaggtgttaccttttatattgttatttaacaaatatttgtgtgcttatagcatcctaggcactggaccagataccattatcaagctgaattgaaccagtgaaaaaagcattcaaattaatatggagacaaaactttgggctctactagtgtctctaaaaattggaatataggccaaccccagtggctcatgcctatatgctggccctttgtgaggctgaggcgggtggatcacttgagttcaggggttcatgatcagtccagacaacatagggagaccgtgtctctacaaaaaataaaaaattagccagacatggtggcacatacctgtggtcccagctagtcgggaggctgaggcagggttgagcccaggaggttgaggctgcagtgagctgtgttcatgccactacacctcagactgggcaacagagtgagacagtgtctcaaaaaaaaaaaaattagaatataaaacaatttgattattgacatgttgtaattctggagttgttttatttggatttctttgactttttttaatactagaggctccattatgaattgaatgaatcactggggaacattttttgaatgaatgattcttcactatgaccctgtcctttcgttgtttctctgatttacaacttggtcatttgatttacaacttggtaatttttttacttttttttttatattttaatttattattattatttttttgagacacagtttcactctgttgcccaggctggagttcattggtgccatcttggctcactgcaacctccgcctcccgggttcaagtgattctcatgcttcagcctcccaagtagctgggattacaggtgcacaccaccacgcctggctaatttttgtattattagtagagatgggggttttaccatgttggccaggctggtcttgaactcctgacctcaagtgatctgcccacctcagcctccccagtgcttggattacaggcttgagccactgcccctggcctacaactaggtaattaagaaattaattttctgaacatgctgtactagtattaaatatatttctataatgaagaacttttttgtaaactatgtcagctttataagttctgagtttttgtatatcaatttatgatagcttttgtttttgtttttttgtttaaaggagaaacagtaattgatgtgtaaatgggtaatatatggggaagctaggagatatgctttattgtgatttaagtgactaatttttttaaaaagacaaaataggctggcccacaatcccaccattttgggaggctgaggcaggagaattgcttgaggatttgagttcaagcccagactgggcaacatagcaaaaccccatctctaccaaaaatttaaaaaactagacaggtgcatgcttgtagtcccagctactcaggaggctgaggcagggggatcccttgagcacaggagtttgagactgcagtgagctatggttgtggcactgcactccagcctgggtgacagagtatataacaaagctgggcatggtggctaacacttttaattccagcactttggagactgaggcaggaggatcccttgaaacaaggagttcaagaccagcctggacaacatagcaagactgtttctacaacaaaatttaaaaaaaaattaggcgtggtggcatgctcctatagtaccagctcttagaaggctgaggagggaggatcgcctcaacccaggaggtcaaggctgcagtgagccgtgattgtgccagtgcacactagcctgggcaacatagtgagaccctgtctctaaaaaataaaaataaaaaaatttttaaaaataattaaaaaggacaaaatagtatacatctattgtgttaaagaattaaaaggatttgtagttgtttttgcacaggaaaatattaatagcagttaactttgggcagtgacattgggagatggagacatgctttcataactaaattttatgtggtaagtagcagagaattaaagaggaaaacaatggctaaagaaaataaaaatagaaacaaatgtgtatgtgaggcaattacaagcgtacttggtttatatgagtgaattcagacaccatttacttggttctaatatggcccatggaaactgtactgaaatagaatttaagatgttttgttcagttcttgtttcattattaatgtttgtttacctactttatattcacagggatgtgcatgcagtctgtctttgggatgataaaggcccagcaaaaattcatcaggctttaaaagaagatattcttgagtttattaagcaagcacaggcagtaagttctacatgcttattttagacttgttttaaaactactcagataatatcatattttattattttgaaagtagaacttcttgaagtaatttcaaaatattgcattgacttttgacacatttgttaaataaatttattaatgaaatgatcgtcattagttggattatttttttcccacagtgatacttctgtcaagagagtacatattatatttaattaaaagatgctatagcgaattcagttttttatattttttgggagtccccaccaccattattttttggctacacatcagtccacacagatctttttttttctctcatgactaatacctcttctcaagttgacagtaatttcttcaattccagatccttctccaattgtaatttatttagactgtcctttgtattgctgttgctgagctgaaattcagcactcttacattgctgttatgtataaatcaaaaattttgatcaaaaatcaaaagctcatttaggcattagatcagtaatgcaagagttagttttgttttgttttttttctgtgacaccttgtaatgttgtttcaaatcagccacggcctctcttatgaataaatcccttatcattttgaggaggaccctaaggacgtgagattattttcctttctataacatgaggtctgggacagggcacagtagctcaggcctgtaatcccagcactttgggaggctgaggcaggcaaattgcttgagtcaaagagtttgataccagcctgggaaacatggtgagaccttgcctctatacaaaataaaaaattacccaagcatgatggtgcacacctgtggttgcagccactcgagaggctgaggcaggagaattgtgtgagcctggaagattgaggctgccgtgagccgtgatcatgccattgcactcagcttgggcagcagagtgagaccctgtctcaaaaaaaggcaaaaaaacaaaaaggtctggtctgatggctagaaggctaggctagaatttcttattttttagttggatcattccattaatgtcttgtacaacattagtaaaagttgtttgttaaatcgtgttattaaatactaaaaggtgcttagcagttgaaaattaaaactgagttttttctatgtatgacttaagatattgaaatcaagtatatgattggcatatattttaattttgctagtagccactaccatgatggagtaagactaatctattggatattacttaagaaattaagtgttttattgatagtttcttgacaaattttttaaattgtagttttataggaagttatcttttaatgaaaatctgttttcaagcacttagaaaattaaatgtttcagtatcaatttaaaactattttcttagaactaatttagagatacagtttctacttgcattgggaaatgtaccacgttttctttttatgacttgataaagataaattatgtttatttcagatagatagagctttattcttcagtttctggaaataaacttatgaagaattaccttggatgttcttaacagatgttaaaaaatatgctgaacactggcaaaaaaaagtaggggagggtttcacggtaacatgactgaataaagtctggaaatgtagacctcagcaagaacccaagaatgggatttagcaccactaattctgagcagttaataggagtagcaatgccagacatgggtcttaaaaagacccatcttaaaaagatttttaaacgcttaagaaatttttttttttttttcatgaatcattttacttaggcaatcttcagttgaacataccttgttaggaaggaccaaatctcccagatggttgaaaggcaatatgcattgaaatgtttataacattttttaaagaacaaaaaaaaaagtaaaaataataaacataggtggagtcttttttgtttaacctagattaacacaactgttttatttgttcacaattctgtggcttagcaatttgggctggtctcagctgaatttgcctaagcttattaatgcagcagcagtgggctgttggacatggtggtctaagagagcattaaaactcatatatggtttttgatgtggctttcttttcactgtgtggtttgtcattctcaaggagaccagcctttgagatgaaagtggaatctacaatacctattcatggatagactgagaaatctttcactgttacatcggtggcattctgttggtcaaagtaaatcacaggaccagcccaaactctaatagtggggaaatagactccaccacctttttttttttttttttttgaggtggattctcactttgtcgcccaggctgcagtgcagtagcgcgatctcggctcactacaacctccgcctcctggattcaagcgattctcctgcctcagcctcccgagcagctgagattacaggcgcatgccaccatgcctggctaatttttgtatttttagtagagatggggtttcaccatgttggtcaagctggtctcaaactcatgacctcgtgatctgcccgccttagcctcccaaagtgctgggattacaggcatgagccaccgcacctgccgtgactccaccaccttttaaaaacttgagatataattaatataccataaaatttactctcttaaaggatatgattcagtgggttgtagtatatttcataaaattgtgcaaccatcacccaataatcccagaatattttcatcaccctaaaaagaaatcctatacctatgaacagtcactcccttctcccaacccactaaatcactaatctgttgtccctatggatatgtctatatttgacattttctgtaattggaatcataatatgtggccttttgtgactagttttctttcacaatatttgtttctctttatggctgaataatatctattgtttggatataccatatattgtggggttttttggtttcttttttcatttgtttagttttttttcaagccagggtattgctctgtcgcccaggccagagtgcagtggtgcaatcatggctcactgtagcctcaactgctggggctcaagcaatcctcccacctcaacctcctaagtagctgggaccacaggcacgcaccaacacacccagctaattttttgtattatttgtggagatgaggtcttgctatgttgcccaggttggtctcaaattcctgagctcaagcaatcctcccgcctcagcctcccaaagtgctgggactactgtatgagccaccacgcctggcccatatattgtttatccgtatttcagctaatggatatttgggttgtttctattttttatctattttgaataatgctgctgtgaacattcgtgtacaagtttttttgtgaacatgttttaatttcttttggatataagagcttgtacaataatttaaaaattatgtacaatttaaattttggcatgaatatgttcttaatttttcaaagcaactgcatttatttcaaattggtacacctctttttttcagcgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaaggtaagactatttttctccttgttttcctaatattcttcagaaagagggtaatttggaagcatttgaaagtaatttgaacttttaagtgggtttttctacttcacatgtcaattgcttttcagctcttaactagattttattgaataatattcttttttgtctttagcttcaatcttctttcatctttttatgtggtcttaagctatagatctgcatcttcaaccattatctcctttacttttcctttttactttctccttctcctggtattcagtattttatttctctattctttctttgtactctttttttttttttaaactggagtgtcactctgtcgcctaggctggagtgtgcagtggcgcagtctgctcactgcaacctccgcctcctgtgttcaagcaattctcctgcctcagcctcctgagtagctgggactacaggcacgtgctaccacacccggctattttattgtatttttagtggagaccaggtttcaccatgttggccaggctcgtctcgaactcctgacctcaggtgatctgcctgcctcagcctccgaaactgttggaattacaggcgtgagccactgcacccaacctatacccttactagaaattaaattacttttctccctgtctcaaaaatccccttttattaggttaccttctgatatctttatgtttaattgtggctaaactgctatctttataatttcccttttacttaactcttctattataaattcagtatatactgtgcttattttctatttaaaaattgtgtcaagtaaccagtcatgatttaatggaaagaactcagtgctgaatatgaagggtcctaggtttccctttcagctcttcaaactccgtcctcattttccatatatctttccacttgtaagaataaaatgggaccgtagatttgaaaagtaaaaaatgccatttgaactttagtcaatttactgtttactgtgatggttacagtaaaacactcaggcattacaatagtgtaacctgggcattgttgccccatcccagccttaaaatttgatctgatgttgacagggatactgtaaatttagatacccagtggttcttcagtgatagaaatcactgcaatatgggaaatttgtgccaagggaaaaaaaaaagtgaaaaacacttctggctgcgatttaatttgtagtctcataatcttgtcctctttttttggccattctattggttgtgggaagcagcatccacttagtgattaagtgtatcaattctggggccacagtttttggattcaaatctcagtgttgccactgatgaggtgcataaatgtggaaagttagctttgctatctgtaccccaggtttcacatatctaaaggggggataatcatagtacctatatcaagattatgaggattaaatgagttacatgcagacaatacatagagcagtcccaggtatagaatgagtgttataaaactgttaactcttgttgttattgttgctgtcattaatgtatctcctacatctgaccaagtttcttggagtactgatataatcaccaatgtttatataccatttttatcattttaatggaacatctaaacagtagatttgcagaccttttataaggtccagtatcagattttcagttggtcctttttacattttttatgtgtctttacaaacatatgcatatgtctatttcaaacacaccaatatatctgaaattcaaccatggaactataggagaataaacattttccatgtattatcatagttaatttttacaaccactgaaatttgcactattattttgaccattttatacataagaaagcagataaataagtaacagctgggattcaaatccagttggattctgaaacacttgttctttatttacttttgttttgtttgaaatgggctcttgctgtgttgcccaggctagagtggaatagtgtgatcttggcttgctgcagccttgccctcctggacttaagtgatcctcccacctcagcctcccaagtagctgggactacaggcacatgccagcatgcctagcaaatttttgtattttttgttgttgttgagatgggtcttactgtgttgccgaggctggtctcaaactcctggcctcaagtgatcctcccaccttggcctcccaaggttttgggattagaccacgcgcagtcgacccttctttaccattatgctaaatatactgcttccccgaagtattcaagtgaatgcaacctaagttattttgagacagggtcttactctgtcacccaggctggagggcagtggcgtggtctcggctcactgggactacaggcgtgcaccaccacactgggctattttttttgtatttttttgtagagacaggattttgccctgctgcccaggctggtcttgaactcatagactccagcgatccacctgcctcggcctcccaaattgttgggactacaggcgtgagccactgcacctggcccaggcctacaaatttgatttccttttttggtgtttgtacatgatactttgtatattaataattgaaaattatgttacaatttgttcttgttttcctagcttatgcttgatacatggaatgagtcaatcttttcaaacataaaaaacagactccaagatagtgcaatgaagctggtacatgctgagagattgggagaagcttttgattctcagctggttattggagtaagagaatcctatggtatgttctgaacttttatgatcataatttctgtttcatggaaattgtagaacaattatggaatagcacaatcaaagttaagtttattggcatacaaagttacatctactttttgtactagatactttttttgagagtaagcaaatgataattctgcttaaaagaatgtataaaaattcatattaatgtggttaatattttcttcatgccattaatttcttggcaagtcgttttagtgaactaaattagatatataaatttgaatgtgtagctcataaaaggtaactagttcattaaaaggttaggtatttatgttttcaggaagtaagttacttccatgaaaaggagagcatgtaggagtacattctctcttacttctaatttgtttcctgtgacttagagtatgcttcttccccacgcttcatcctcctcctggaggcctttcttaattcccagagtaagttaacttctctcatttagtgcttcacagtacctgtgcctccttggcatagtacttttgtttaattgtgttgttagcaccatgtctttactgaacatagaatgcatggcacaaaatcactctaggtaggtatttattgagttaatgaacctatagagttacttttgactggcttttcttcatggcccccatattcttttagttatcaagcctttagattttcattagcagtgctcctgaaatttgtttttaattgaactgccaccagacattaaacttcacatgcagagttttgaaatagtcgtcttataatcatcttattgctgttgtttaacccatatggtgttcataagattaatgtttaagcactattttattggtattttttctacttaccccttaagtggtataccatgctttttttttttttttttaagagatggggttttgctctgttgcccaagctggagtgcagtggcgtgatcatggctcattgagcctccacctctcaggcttaagcagtcctcctatctcagtgtcctgagtagctgggactgcaggcatgcaccaccacacctggctaatttgtttctttttttttctttttttgagacagagtctcactctgtcacccaggctgaagtgcagtggcatgctcgctgcaacctccacttcccaagttcaagcaattttcatacctcagcctccagaatagctgagattacaggtgtgtgccatcactcccagctaatgtttgtatttttagtagagacggggttttgccatagtggccaggctggtcttgaactcctgacctcaagtaatctgcccaccttggcctcccgcagtgctgggattacaagtgtgagccattgtgtgcaggcttaatttttctgtagacacatgattttactatgttgcccagggcatcttcacaaccatttgtaatttaccattctaccttaccttctattaaccttgcaatccacttagacaacctagtcatattttcttgtgcttttctgcttctgaatatttacttaccttactaatctccgtttatgcaaattctagtttattctttaagattcagtttaaatcccattgcttctgtgaatgttttcttgattattcagttagaagtcagtttcttacctatgcaaaaatagtctatattatctgtattatttatttgttactttactgctttatgctgttatctttataagtttcttatggagaaggattttgtcttatataattatatgttctcttgagcattgttaccttgcacataatgactcctcaatatttatttcatttattatactcaaaatactgattttgatcataattggagtaatactttattttctgtttttcagttaacctttgttctaatcctgaggataaacttcaaatttatagggacaattttgagaaggcatacttggattcaacagagagattttatagaacacaagcaccctcgtatttacaacaaaatggtgtacagaattatatgaaatatgtaagttagaacttagtatatgtgataatttgagcaattcccttgatattcttaaaatgattgctattttgcttctggacaggcagatgctaaattaaaagaagaagaaaaacgagcactacgttatttagaaacaagacgagaatgtaactccgttgaagcagtaagtaattttgtaattgtacattttatgggattatttgaaatacggaagcataggaatggcaaataaacaacataaataatattatttaacaaccaacattgttaattgattttagttctttttgcctatgagccatagcacaactttgtaggaggtatcttgtttagaacacattgtcctttggagctggtatgcaagatcaaatctatttgccatacctgttctagactttatttaatataattaatttttggtaagttttcttttattatgttttatgcatatctaaagttagccattttgtgattttcatgttgcaagtaatatatgctcccttagggatacagttgactctctttttttgtaccggttatgttctctgaagtggctgcaaacaccaaattagtgaataatgaatcatttattcctaggggatatttcttctccttctgggaagatgtttcaaacttcatttgtcatgaggtaaaaatattaattattattatttttagaaacaaagtcttgctctgttgcctagggtggagtgcagtggtgcaattatacctcactgtaactcctgggcataagggcccctcctgcctcagcctcctaagtagctgggactacaggcacacgtcaccctgcctgactaataaatatatatatatatatactttatcttttttttttgagacaagggctctctctgttgcccaggctggagtgcagtggtgcaatctcggctcactgcaacctctgcctctcaggctcaagcagttctcctgcctcagcctcccaagtagctgggactacaagcgcatgccaccatgcctggctaatttttttatttttagtagagatggggtttcaccttgctgcccaggctgatcttgaacgcctaagctcaggtgatccacctgccttggcctcccagagtgttgggattacaggcgtgagccactgcacccggccacctggctaatttttttattttatttttcatagagagcaggtcttgctatgtagcccaggctggttttgaactcctggcctcaagcaatccttcttgctcagcctcccaaaatgctgggattatgggcatgagccacaatacctggcctcaaaatattaaaaaacaaaaaactagtcagtgacagtaccatggtaggtgttttcttttacgtggaggactgaccttagggtgcttcagtataaggaaagttagaatctagttgggacagtcttggaattgttgaaacacaacaatagtatttcctctggttcctttcagtctttggagccttgatttagatttgcattctcaggaataacattctagcttgcccataatcaaatatttttcaactctgaatgggatttaaaatttttttttacttttgacttttctttggctttgtccatcttaagtggtagtcgtgtttattttattctttgttcagaaatcacaccgagttggatgtcttttccctttggttcttttagtttttgttttgcttgtccttgatttgcagtatgtatcctctttggttgaaatagttttgatattggcaaaaggaaggataatttagtggttatttatagaagttctttatagtgatataaattcaggtttgggctacattcagaaggccgggaaggctgttgactttttttttaaacaggtgggccacagagttgtcccttaggaagattaatctggtgacaggaaagatggaagactggaatggggaggagctgggaataagaagtagaaagcatttgcagtaattcaggcaaggtattaggcagaccaagtagagttacagaagtgggaatggaaaagacaagggaagagagaaacttcttagaggtggaacattgtatcacatggatggggctagatatcacagagaatcaagccaataatgttctgaggtttcagccaaggagaactgtgctgctactgagagattaggtataaaaataagtcttagtgagggagaaaggatgagttcattttggaggatttgggtatttgttgtagattgacgtacatttagcacctggatgggaatgttacagttttataaggtgaaattgttctgatctcctactgcaatttgtatgttagtcatatcatagccacattaaacttatgaactttcaactgtaaaaggccaactaaaagaataagtccagagtagctgggactacaggtacgtgccactacacctggctaattttttattttttgagatcacgtctcactatgttggtaaggcttgtctcaaactcctgggctcgagcagttctcccacctcgacctcccagagtgctaggattacaggcacgagccacggcacttggcagtaacggtcaaaagtttgaaatgaaataggatatttgcatagtttcaaagtatcgtccccaagatatttactaaaggagaagcctgaagacaccatcttaattaagtgatcaaggtgaacatcaccagtagtaggacatgctgacataccccgtgatatgatgcactaagaagaatacaatattatttctgttttactcttgccaaaaatgtgtaatcttactgtaataatgaggaaagattaaacaatcgcaaattgatagcctacaaaatgactaatattcttcaaggtgtcaagactgtaacagactgaaggacaaaggaactgccacagattgtatgagagtaggagaaattacaactatatgcaacatgggcttgtggataggatcctggaataggagaaggatattagtggaaaaactggtgaaatgaataagacctagagttaaattgatagtatcgtaccaatactattttcctggttttgatagttgtactatagttatgtaagatgttaatgttgggagaagtgaggtgctatttttctgctaacttttctgtaatcattaatcaaagaagttgaaaaaataaagaatattggctgggtgcagtggctcacgcctgtaatcccagcactttgggaggccaaggcaggcagatcatgtggtcaggagttcaagaccagcctgacctacatggtgaaaccctgtctctactaaaaatacaaaaattagccggacgtggtggcgtgcacctgtaatcccagctactcaggaggctgaggcaggagaatctcttgaacctgggaggcagaggttgcagtgagccgagattgcgccaccacactccagcctgggcgatagagcaagactctgtctcaaaaaaaaaaaaaaaaagaatattatgaagagtgccttttttttttttttttttttggaacatagccctgatgtgtcacccaggctagagtgcagtagtgccagtctccgctcactgcaacctctgcttcccaggttcatgtgattctcatgcctcagcctcccgagtagctgggactacaggtgcccaccaccacacccggctaattttttgtatttttagtagagacagggtttcaccgtgttagccaggatggtcttgatctcctgacttcgtgatctgcccgcggcggcctcccaaagtgctgggattacagacgtgagcccctgcacccggccaaaagtgatttttttttttttaaatgaagtaagagtaatactatagagtgtattggtggtggtaatgcttctcctgctgcttttactttatggaatatggtcagaaaagatctctgagggaatgatattggagttaagacctgaatgatagggaactagccttgtgaagatctgagacagttaagtgttgcattagatgtctgaagccctactcttacagttttatttttacttataggagagccacttagaccctacttagatctgattttacatacaattctaataagcttgattatcactcgctgggcctatagcagatgaacagaaatgtattgaatgtatttaatgtaaaacaaggtaagaggcttccgagctgtgctgctgaacaggcatgttgacagcaaaaagtaacacaaccataagaaaagagcaagaaaaaaaattaagccaaatgccttttgtgttttaagaggcagagtctcgctatgttgcccaggctggagtgcagtggctgttcacaggtttgatcatagtgcactgcattctcgaattcctggccttcagcagtcttcccacctcagcctcctgagttgctgggacagtaggcgcatgcaaccacacccagctttaagccaaaatgacttaaaatttgtgtttggtttttagtttttaggtgatagtcctgcataccttagtatttcctggggaaattcaattagtatttattatatacccacagtgtgtcaggcattatgctagttggggataataagatagacctagtccctatcctcaggatgacactagaataaaatggattgtttatacaatagaggaatagaaaagtgaattggtagtgtaagtcttgatcacttcagaatgaccagggcaccgatagggagggagtgtattacagtggttagggtcatacatgttggaattagatgaggatttgaatcccacagatgttattttaccagctgtctgcgttttggcaagttattcaacctttgtagtctctcttttcctaactataaaatggaataggccgggcgcggtggctcacgcctgcaatcccagcacttagggaggccgagatgggtggatcatgaggtcaggagttcaagaccagcctggccaacacggtgaaaccctgtctctactaaaaaaaaaatacaaaaaaattagttgggcgtggtggcacgcacctgtaatctcagctactcgggaggctgaggcaggagaatcgcttgaacccaggaggcggaggttgcagtaaggagagatcacaccattgcgctccagcctgggtgacagagcgagactctgtctaaaaaaaaaaaaaaaattgaataatacccttttgtattagcagaattaaatgaaatatgttacattaagcatttgagcactgtgcctggcatgatagcttttactgttaggcactggttcagagaaaactgcttactaattctaagacaagtaaaaactattttaccatctgtgcaaaactgatttaaaaagctgaataagcaactaggtcacaagttataaattattaacattaaaataagcacttattaaccttcagtattttggtatttcaggcatggtatcctctccacagaggaggtctaaaattaaaaaaaaaaattaagcttggtgttcaaaaagacaaggtgatccagacttttgtagtgccactaatgatagtagtacagaaagaatcttagtcaaactagaaaggccaggaaattaattattgaatacattacagatatccttgtatggttaagggcctgataatgatagagtagaatcataaagtgggggaacttaagataatttttagttcaactcttacgttgtagctgaggcaaagcaaactattccttatacagagctatataactaatgaaaatcagaaatgcttttttttttaaacgaaatttgagcgaggtagaaataattatgcaaattgaataccactaaaagaagaatctggctggatgccgtggcccacgcctctaatcccagcactttaggaggccgaggcgggtggatcacctgaggtcaggagttcaagaccagcctggctaacatggtaaagccctgtttctactaaaaatacaaaaaattacccgggcatggtggtgcgtgcctgtaatctcagctactcgggaggctgaggcaggagaatcgcttgaacccgggaggcggaggttgcagtgagatcgcgccattgcactccagcttgggcaacgagtgaaactgtctcaaaaaaaaaaagaataagaatctaccatgtctcgtagcctacctgtctcacctttcattttccagacctatgaattcattcattcaacaggtacttattggagtgcctgctgtgttttatagcaggcattatttttgaagagtttatagtcttgctgtagaggaggttaaaacatcaagcacattgatagttaaagtgtttcaccttgcagacctctggggagagattgctatggatttagaagttgtgctcatctcaggcaaacatacaggagttgatggcatatggcaaaaagtttttttcttcacggaatctagcaaaaggagacagaaagggaatacaaggtgagagagatggcttatcactatactttccattcaagatgtattttcaaataacaagttatatatttaggatcaactatgtatatagtaatttggtaaatgggaagaaatacaaaagaggaataacatgatctctgtcctcaagaaactgactctcttaggacaagactcatttgaaataaggagagaattctatctagcaatctccctactttttgcctaggtaaaataattttctggaggattttttaatatatagaaatctataccataattgttctcttcattttttaaaaaagctttgtaatgaaagttttaaaatatttacacaagtagagaaaatactataatgaacgctacccccatacccagtcttccagattcaacagttatcattattttgtcatgcttgttttgttgatccttctgtttgttttcctttcttttccattccttcctctctatttccctccccgttttgcctcccttccctcctgcattcctatatttaaaaataaatttatgatgttgctcatttttactccacacacattgtattagtccattttcacactgctataaagataactacctgagactgagtaatttgtaaaggaaagaggtttagttgaaccagttccacatggcctgggagtcctcaggaaacttaaaatcatggcagaaggcaaaggggaggcaaggcacatcttatgtggcagcaggagagagagagagagagagagaatgtgcaggagaaactgccacttttaaaaccatcagattttgagaattccctgtcacaagaacagcatgggggaaaccttgctgatccaatcacctcccaccaggtccctgtctcaacacgtgggaattacaattcgagatgaaatttggctggggatacagagccaaagcatatcacaatctatattataatgtaacctatatgcactgtagtattactaaccagttctctaatgatgaccattttcattgtttatagtttatttcttataaatagtgctttctggaatatccttaaatacctctatctttttaacatccttgtgtatacatcttttctcacacttggcttcctcttggaatagaatctcctggaaattagatagctgaggtaaaagtccctgaaccttttacaaattgctacacaataaataccaaactgactttcaggaatgtagtcccatcaacagtgtgcttgtttatccatatcgttgctgatctgagttttgtcagtctattgattcctaccaatctgccagtatcatagattttaaaatattttttgtgtgcatttaaaaattaatgaatattaataattgtaaatattaaatataattataaatatataaaattataaataattaaatatttattttataaatataaaatattttgtgcatacatacatggtgtatgtagttgtatgtatttatgggttacatgagacattttgatacaggcatgcaacgcatgataatcacatcagggcaaatggtatcaatcacctcaggcatttatcctttgtgttacagacaatccaattatattcttttattatttttaaacataaaattaaattattttttactgtagtcaccctgttatgttatcaaatactatgttttattcattctgtttttgtttttgtttttgttttgttttgagacggagttttgctcttgttgcccacccaggctggagtgctgtggcgggatctcagctcaccgcaacctccgcctcctgggttcaagtgattcttctgcctcagcctcccaagtagctgggattacaggcatgcaccaccacgcccggctaattttgtatttttagtagagatggggtttctccatgttggtcaggctggtctcgaactcctgacctcaggcaatccacctggctcagcctcccaaagtgctgggattacaggtgtgagccactgcacccgactattcattctggtttttttgtacccattaaccatccctatttctcccccaccacctcactaccctacccagcatctggcaactatcctttactctctatttccatgagttcaattgttttaatttttagcttccacaaatgagtgagatcgtgtgaagttcgtctttctgttcctggcttatttcacctaacacagtgttctccagtttcatccatgttgttgcaaatggcaggatctcattctttttttatggctgaatagtactccattgtgtttatgtacattttcattatccattcatttgttggtggacagtaaggttccttccaaatcttgattataagtagtgctgcaatacatgtatacatatgtaacaaacctgcacgttgtgcacatgtaccctaaaacttaaagtataataataataaaatttaatgttaattttataataataataaaatttaaagtataatgataataaaatttaataaataataaaattaataaaattaaaaaaaataaataaataaatagtgctgcagtaaacgtggaagtgcatctatctcttcctttcttcctatgctcatttccattctttttggtatatagccagcagtgggattgctggatcataaggtagctctgtattagttttttgaggaacctccaaactgctccatagtgcttgtactaatattacattcccaccatcattatacgagggttcctttttctacacattctcaccaatatttgttattgcctgtcttatagataaaagctactttaactgggatgagatgatgtctcgttgtaggtaatatcatctgcaaacaagcgtagtttgacatcttcctttccaatttggatgctctttctttctcttgtctgattcctctaactacaacttccagtattattttgaataaaagtggtgacagtgggcatccttgtcatgtttgagatcttagaagaaagatttttagtttttctccattcagtatgatactagctacgggtctctcatgtggcttttattatgttgaggtatgttcgttctatacccagtgttttgatggtttgtatcatgcaggaatgttgaattttatcagatgctttttcagcatcaattgaaatgaacatacggattttgtctgccattctgttgatgtgatgtatcatttgatcaatttgtgtatgttgaaccatccttgcatccacggataaatcccacttggtcatgatgaatgatttctttaaggtgttggtaaatttggtttgctagtctgggctcagtggctcacgcctgtaatcccagcacattaggaggccaaggcaggtggatcacttgaggtcagaagtttgagaccagcctggccaacatggtgaaaccccatctctactaaaaaaaatacaaaaattagcgggcgaggtgtcaggtgcccgtaatcccagctactcgggaggctaaggcaggagagttgcttgaacttgggaggtggagcttgcagtgagccaagatcatgccactgcattgcagcctgggcaacagagtgatactctgtctcaaaaaacaaaaacaaaacaaaacaaaaatttggtttgctagtattttgttgaggatttttgcatcaatattcatcagtgatattggcctgtagttttctttttaaaatgtgtctttgtctgcttttggtattagggcaatactggcctcatagaatgagtttggaagtattccctcctcctctatttttcagacagtttgagtagaattgatattagttctacttgaaatatttggtaggattcagcagtgaagccatcaggtgccaggcttttctttgttgggagaaattttatttcattttatttatttaattaattaattaatttttttttgagacggagtcttgctctgtcacccaggctggagtgcagtggcatgatctcggctcactgcaagctccgcctcctgggttcacaccattttcctgcctcagcctcccaagtagctgggactacaggcgcccgccaccacacccggctaattttttgtatttttagtagagatggggtttcaccatgttagccaggatggtctctctcctgacctcatgatctgcccacctctgcctggcaaagtgctgggattacaggcatgagccactgcacctgttgggagaaattttattatggcttctatctcattatttgttattgcttgcctagaagttacagtccttgtggcctagactgcctttcaagtttatttggagccccagagtactttagcttatagtgcgaggcttgctagaactcaagtccttaccactggaatgggcgattcccctctgtctagggctggtctaaatgctccctccatgggcatgtgtcagctgagttcatcctacttttgctttctgctgtgaaagggtggtggtgagttcaatgcagtatctcacagttgctgctctctccctctcccaagcacacagattctccatgccatacagctgctgctgggggatgagggaggggtaacattggcgattcaagactatctttcctaccctcttcagtgcctcttgcagtgacatgaagttaaaaccaggtactatgagtgcccacctgatttttggttcttatgaaggtgtttttttgtgtgtagatagttgttaaatttggtgttcctgcaggaggaatgatcggtggaagcttctatttggccatcttgctccactcctctattttttattattttttttagaaacagggtctcactatgttgtccagcctggtctgcatatttattcttattcctgaccatttgtatttattcttttgtgaattcaggataatctttcataaacatcacttttattgttttacttttctattcaaaaactagagtactggctggccgtggtggctcacgcctctaatcccagcactttgggaggctgaggcaggcagatcacaaggtcaggagatcaagaccatcctggctaacacggtgaaaccctgtttctactaaaaatacaaaaacaaacttagccaggcgtggtggtggatgcctgctgtcccagtactcaggaggctgaggcgggagaaatggtgtgaacccaggaggcagagcttgcagtgagccaagatcacgccactgcactccagcctgggcgacagagcgagactctgtctcaaaaaaaaaaccagagtatcattatttcatacccctgatttttaagacccttcataatttgaccctaacctatttttctaacttaatattgtccagcaagagtcactctactccaataagaaatatttttttattcatacaactcactctgttacttttttttttggattcattttagcagtgttttcttctgcctacccaaaatcttgcaaggattcttttaactcaccttgtaataaaattgtaataaagtagctcagatcatctagccttcatcagtttcttcctatttgaattcccgtggtaactattgtttctaccactaggtttaggagcaaattatagactgccttgtatttcttatcaagcaccagctgtgtgccaggacacagcacagtctttatagctgtggacagagcacaatctttgtccttaagtttatagtatagtaatgatgcattttccagttatttgcttattagtgaagatcttcttttcatacacatctgtacatatgaaccatacacatgtttttaggtatatagtttatgggtttccaactggattgtaagatcattgagggcatgaaccatgtttatacttctctattccttaaaacacgtaactcagttctgagcatgtagccatcactaagtatgtacatgctctacttctgtagtaagaaaagttggaggctatggagatacatacctggcctcaaattataactcaagaccttatgaaccaactgtgcaacatttggaagttatgtggctactctcagtctatgtcctcataaagtaagtatctgcctcatgaggttgccatgtgggttaaatgagatctatatgtaaagcatttagcataatgcctggtacaaagtaagtgcccattaaaggatacctgttataataatttgtttaacctctcaagctagaaatggattcaacatccttttatttccctaatccctttcatttaagcatttaccaaattcttctcagtttactttaattatgttgtcaatttagctctccttttaatcctcgttgtaacccaccataagaaatacattttatattgtggcttagaatatactgtttatttgtacatatctgaaacaaaagtcttatgaaataatattcattgttacaatatgtgatacactctgatattttttgttctgtcctatgtacattttttttttttttaaacctggtcacagccattaaaactgatttcacaacatacagtctgaaacacactggtctggatttttagaatctgcaaaatttcaactaccactgaacaggataatgttcaagtgaaagttttcaatgaaatagaaaacacagagcttagagtttattaggattccactttgtctttgttctctattagttatatattgttagatttacctatgctcaatctggtttcactgcttaaggtggaagtgtttagttgggcctattccagtgatgttatagaataagattactcagcagttggggcagagatttccaccttgcaaggaaagagtttcttaaccattttatatgtgtagtcttttctttatttttcttttttttttccttttttgagacggagttttgctcttgttgcccaggctggagtgcaatggcacgatctcggctcactgcaatctctgcctcccaggtttaagcaattctcctgcctcagcctcccgagtagctgggattacaggcacccaccatgcccggctaatttttagtagagatggggtttctctgtgttggtcaggctggtcttgaactcctgacctcaggtgatccgcccgccttagcctcccaaagtgctgggattataggctatgagccaccacgcccagccatgtgtattattttcttaggacagaaatatacatggatatatgcatttaaaagtcatcagcatcattcttgtagaggagcctgaaaaaacctttttttttgttttgttttgttttgttttgtgacagtcttgctctgtcgcccagactacactgcagtgacatgatcaaggcttactgcagccttgacctcctgagcttaactgaccctcccacctcagccccccaactcgcagggaccacagaaaattctttattcggaaaattttaagcatttttacaatgtaggaagaacagtataatgaatccccattacctaaattcagctttagtagttaccaacattatgtcaattccaaaggaatttttaataaaaaatttttaagggacacataattgcctcccttaatttacagatagatgatttgtttttcagaagaaatatatcagccttattgtacttaactttagtcctcacaacctattaatttcatctgatccccaaaagagaagtaaataattacatgacacgagggagcagagatgacatgatatcttctgcctcatttagattttcctgatggcctcctagagcactagacccttgctatcttacctgaaatagttcaacagcctcgttaccatatcccaaccacccactccttaccacctgccttactaccattatactgatctttaataatgacttgaggagaggagaatctcattacatttatcctctgtttaaaacttccttggggccaggcctgatggttcacacctgtaatcccacactttgggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcctaggagttcaaggctgtagtgaggtatgatagtagctatgtagtaatgccactgtactccagcttgggcagcagagcaagactctgtctcttaaacaaacaaaaaaaccttcctttgttcttccttccctacctatgaaataaaaccccaaatcatagattttcattcataatctggttgcagcctatctttctagccttctcttccactgtctgtttcttctctaccattttaagcttcctggtattcctagaatacgtaacctattttagggcttgtacttactttacaggatcccatttagataccaacttgtggatgaggccattttaactaccctagaaaaaagtagtttctaagtttttttttattttgtgtgtgtttgtgtatgtgtgtgatgccacttaactgagttatatttagttagcagtgtaggtttactgccctcctcactctcaattagacagtgatctcttcgagagcaggaattatatcttattcttgtctcttaaatacttccttagtgcctgcacgtagtaggcatccaataatggtttgttgaatgaatgtattcacacttctagaattttataacctaattttaaaacaggttctctccagacaggaagagttaatcaaagtttggttttgtatatttttctctcccctccttgaggacttttgttaaaatttctaaagagagtctagttctatagtttttttccttaggggaaaatacactttggtaaactagtatagcatatccatcttcaataatcctatagttaaggtaagtgaaatctactttcagtataattttttttttgttgaacaatattgttttattttgtgagttagaatagatttgtgctatacagcttatagtagccttgactaatttttgatatatttcagctcatggaatgctgtgtaaatgccctggtgacatcatttaaagagactatcttagctgagtgccaaggcatgatcaagagaaatgaaactgaaagtaggtaaaacatcacataaagttatcataatcttctaagagggtatctttgaaacaaatcacttactaagttgctcttagttaattcttttccacataggtatatgtggaactgttagagtgaactatacttaaggaaatagataaaatatttaacacagaggcactgctaagagtatataaacttaaattttaagcattttccctcttagctatcaacatctgtgtatgtgtatggtgaatttctacttttttctcaaaagcaagacactgcttttaaaggccagtttaaactggaaacatatgttatagattagaaccaggtatttgacttttgtgtggaaccttgtgatgaatctttttagaatgtaataaaacactccctgttaatagtcatctctgtccccaaaaatactttataagatttctaaaggattttttttattacttcaatgttttcttaaaaagatgtgttttgagaggtagcaagtatataacaaactaaaaaaaaaaattgtacatatacctactaccccagtaaaactgcttttaacatttttttgcttttgttttttaaataacgtacttctactgagtttccaggttttattatatctaactgcaaggtcctgtttaatctctagttgcatttaaagtgcatatttcaattcacttaagttcatacactttttaggagtaattcagtagtaaaaagcaagctgctttattggcgtaaacaaaatacttgtattctgtgtgccagtctaattagagttatgtctgatctatgttgcactcttttcaaaaggatttatttagtggtaatcagtaccgtgaggtagggtttttgtgaaggtcaataaaatggcataacatgaaaaagtgctttgtaaattgaaaaattatttatgaatacagttttatattctaatctctaatatagttgctttcgtaattattactcatgttttttaccttttgatgatatggctgtatatgtagtattacaactaccttatgaaataaactaatcttgtgtgtaaataaatattcctttgcattgaaaaccaaatgactcaccttttcttttgagactgggtctcgctgtgttgcccaacctggaattcgatggcacgatcacaattcactgtagccttgacctcctgggctcaagcgatcctcccacctcccagcccactgagtagctgggactacagccgtgtaccaccatgcctggctaatttttgtattttttgtagaggcagagccccaccttgttgcccaggctgatctccactgcttctggccaaatgactgaccttttaaagaaaggagttgggttttgcagtatttgatcactttttttatttttattttttgagaccgtcttgccctgtcacccaggctgagtgcaatggtgcaatcacggctcactgcagcctcagcctcctgggcttaggcattcctcacacttcagcctcccaagtatctgggaccaaagacatgcaccaccacacccagctaattttgtttgtttgtttttgtgtaacgatgggttttgccatgttgccctgactggtctttttaactcctgggctcaaatgatcctcccaccttggcctcccaaagtgctggagttacaagcgtgaaccaccacacccagcctgatcacttttaattcgatttttttttaaacataatttttagactaagtacagtggctcatacctatgatcccagcactttgagagaccaaggcgagaggattgtgtgagccccgaagtttgagaccagcttgggcaacattgggagaccctgtctctacaaaattacaaaaaacattagccaggcatggtgacatgtgcctgtggtcccagctactcaggaggctgagatgggaggattgcttgcgcccaagaggtcaaggctgcagtgagccgtgatcgagccactgtactccagcttgggtgacagactgggaccctgtctcaaaaacaaaaaaacaacaacaaaaaaacgaacaactactcctaatggcattgtatccacagaatactattaacattacaaacttaactaatgtttctctaaactcttactctagtaaatgaaatgattacatgaatgtgttctctccttccagaattacatttaatgttttcattgatggacaaagttcctaatggtatagagccaatgttgaaagacttggaggaacatatcattagtgctggcctggcagatatggtagcagctgctgaaactattactactgtaagttttttttcaatggcaatgatagatatatatcaaggctattttttaaatgtaggattattgaaaatagtgagcggttaccagaggctgggggttgggggagcagaagaggttggttagtggggtataaagttatagttcaataggaagaataagttttggtgttctattacccattagggcggatatagcaagtaacaatgtagtgtatatttcaagatagaagagattttttatgttgttaccacaaagaaattataaatgtttgaagtgatggatatagtagttaccccaatttgatcattatagtatatacatgcattgaaatataacattgtaccccataatatgtaccattatgtgttgattacaaataaaaacattaaatttttaaaaatacagaattgaaaattgaaaatagtaattgaaattactattttctctgtaaaacagggagctgggcaaggtggctcacgcctgtaatcccagcactttgggaggccgaggtgggcagatcacaaggtcaggagatcgagactatcctggctaacatggtgaaacccctctctactaaaaatacaaaaaaaatagccaggcggggtggcgggcgcctatagtcccagctacttgggagggtgaggcaggagaatggcgtgaacccaggaagtggagcttgcagtgagccgagaaggtgccactgcactccagcctgggcgacagatcgagactccgtctcaaaaaaaaaaaaaggaagaaagaaaaaagaagtggcaaaacagtaatattggaacaccttttagttttatttttaagaaaaaatatccccagttttaaatgagttttattaaaattatgtttattttctcatttttttgtgttattctttttcttttaaaaacttaatgtaaaaccttttgtttctaggactctgagaaatacgttgagcagttacttacactatttaatagatttagtaaactcgtcaaagaagcttttcaagatgatccacgatttcttactgcaagagataaggtatatattcctatatatataaaaaacacttttaaaagttttattctcataatttacttctaataatcaatttgcattatttttctattaattataaacttaaaaacctagcaactgttatttttcatcagtggagaacaactatattcgttttgtcttggctgtaagcatttgttaaacattagatagccttgtgaattagaatttagttagaaagttgcttttttctcatttttccaagaatgtttttctgtttttgaatattactgatctattgaattcctattcatccttccattaagacccagctcaaagaatacttcccctggagcttccttgatgtcctgcctccctccacagctcatcaccagcagagttgattcctccatcctccgtcctttcatgggactccttcgggagttatgttatacttatccttgtttcccagggaagcatttgtattgcataccatctttttccatcctcactagtataggataatgataataaaacaccatactgtccttagcattgtatcttttttagtgtaataaacctataacaagaaattgctgttagttttttctcttctttgactacctttcgttacttcccaagtttgaatgattctaaaaagacaactttctccattctccagtaggatttttttctcactctttttgtctattttaatttttttttttttttttttttgagactgagtttcgctcttgttgcccaggcttgagtgcaatggcatgatcttggctcactgcaacttctgcctcccaggttcaagcgattctcctgcctcagcctctcgagtagctgggattacagggaccaaccaccatgcccggctaatttttgtatttttactacagacggggtttcactgtgttggccaggctggtctcgaactcctgacctcaggtgatgggcccgcctcggcctcccaaagtgctgggattacaggcctgagctactgtgcccagactctttttgtctattttaaaacaagtaaataggccaggtgcagtggctcacgcctgtaaccagcactttgggaggccagggcgggtggatcacctgaggtcgggagttcgagatcagcctgatcaacatggagaaaccccatctctactaaaaatacgaaaaattagctggacgtggtggtacatgcgtgtaattccagctacttaggagactgaggcaggagaattgcttgaacccaggaggtggaggttgtggtgagctgagatcgtgccattgcactccagcctgggcaacaagagcgaaactctgtctcaaaaaataaataaataaaaataaaacaaataagtaggtaaagtaggaaaggagttaagggagtatagacatggtgggcgtggtgtgaagtcttaaattgagtagcctgcaaaggcttcataggaagccagatcatgtaagactctgagccatgggaaggagttagtttttactgtgagtaggatgggaagtcatttaaaaattttaaacagaatggtagaatgtgatttatgtattaacaggatcattctggctgttgtaaaaaatatactgaagggaagaaggaagaaagaataccagttaagaacttatttaaataattcaattaagtgatgatggaggcttgtcccagagtgatggtagaggtggtcaaaagtagttcgataattttttttttttttaatgcaagtagcttatttgggaaatgcagggacgatagcgtggcgtattagtaagtcagatctacagtgagctacttgaacttaattctgcaaggaaacttatttaaaaccctgctcaaaattacctcacctatcaagtgttgagttcttgaagtttcctgcctgccacttgcataggcaacacatatttctgcagttttaggaaaaaacagctctttgggtgcatgtgcagatactaatagtgggaaaagtataagggatgtgggaaggtttgacagcatttgttacaccaggtatgtggcttggaattggaaaataaaaatgacagcaggctctagaagtgacttgtcagggaagttcgctgtgtcgcccagtctggagtgcagtggtgcaatcatagctgactgcagccttgaactcctgggctcaagcaatcctcccgcctcagccacctgagtttctgggactgtgagcacataccaccacacctggctaggtttttaaagtttttctatagagacaacatctagctatgttgtttgggctggtcttgaactcctgccttagccttccaaagttctgggattatagacgtgagccaccacccctggccccctttccctttaaatcatgttctttgagaactcttcacccgcactgatgttgtctcagccctgtcatctcactggtgaaggaaataaagatatccaccatctgacatagttactcattttcttgttttgttttgtttttgtggcaagagcacccaaagtctacttagcatgaatccaatatacagtataatttgaatttgttttgttttatttatttatttattttgagacagagtcttgctctgtcacccaggctggagagagtgcagtggcacaacatggctcactggagcttcgacccctctgggctcaggtgatcttcccacctcagcctcccgagtagctgggactacaggcatgcaccactatgtttggctaatttgtaattttttttgtagagatgagttctcagtatgttgcccaggctgttcttgaactcctgggctcaagcgatccatccaccacagcctcccaaagtgctgggattacaggcatgagccaccatgcccagcccagtataattttactacctatagttctcatgctgtacattagctctctagactttttccatcttgtgtgtctgctactttgtatcatgtcacctacatttccttgtttctttcccacccattttgccactggtactactctttcattcctctttctgtatatttgaattttttttaggttctacctataagtgagatcatgcagtatttttcttcctgtgtctggcttatttttaaggtcttccaggcttccgtcatatatatgtaccagtttctttatccattgatggacgctgaggttgtgtccatatttttgctattgttaataatgcagtgaatgtgggagtgcagttatctttgtgaagtggtgatttcatttcctttgggtatatgcctagaagagggattgctgggattatgattacattatgaagatagactattcaggatttgctattgaatcagaagtagaatgtgatagagactagtcagggatgacactcagattcgtgttctgatcaattagaaggatatgttcactgcgatagggaagactgtaagagaaatagtttttggagagatggttgcagagagatcagaaactcggtattgaataagttaactttgaaatatctgttaaacatccatatggtaatgttgagtctggagcttaagagaaagaatggagctggaaaaatatgtttggcagcttcagcatataagtggtttttaaagcactgacacaggctctaatcaccaaagtaatgattggagatagaaaagaggacagatccaaggattggcctagggcattctgatatttcattgttagaaaaatgaggagtcgtctttcatgagaagggagaaatgatccaagagaatgttatgtgctagaagacaagtgaaaaaagtactttcaggaggagggtgtgatccgctgtttttaaatgctgataataaataagatggagataaaccattgtcttcagcaacatggaggttgccagtgactttaacaagaacagttgtgtaggctgggtgtggtggcttacgcctgtaatccagcactttgagaggctgagacaggtggatcacttgaggtcaggagtcaacatgatgaaaccctgtctctattaaaaatacaaaaattagccaggcacggtggtgcgcacctgtaattccagctactcaggaggctgaggcaggagaatcgcttgaacccaggaggtggtggttgcagtgatctgagatcagcaccactgcactgcagcctgggcaacgagtgaaactctgtctccaaaaaaaaaaaaagaaaaaaaatctcacttgaggccaggcatggtggctcacccctgtaatcccagcactttgggagaccaaggcaggcagatcacctgaggtgaggagtttgagaccagcctggccaacatggtgaaactccgtctctactaaaaatacaaaagttagcctgatgtagtggtgggcacctataatcccagctacccaggaggccagctaagacaggagaatcacttgaacccaggaggcggaggttgcagtgagtggagatcatgccactgcactccagcctggtcgacagagtgagacttcatctcaaaaaaacaaaaccaaaccaacaacaacaaaaaaacctcacttgagaatattgataattataatatgacaaagaacttgctaaagtctttgactaggcaaattctgtttggccagatataccattagaaataaaaactaacatatttttatgtgttttgggatgtataaaaatttatctgtatattttcaatattaaaaatattttattccaaattattttttgcaggcgtataaagcagttgttaatgatgctaccatatttaaacttgaattacctttgaagcagaaggggtaagttttttaaaaccatactttaaaaatacttaaattttctttagtgtaataggggttaactaggtatacaaagtaccctgttaggtttatttttgttattgttagttttgtgacttttgcagcttttggctattaaagttcatttataattttttattaaattattttacaatacaaaaattgactttattttttcaggtaaaaaaaaaatattcctaatcttttaggatctctacttgtttttccctcattagtcactaaaagtattctattacccatagaagcagagaaaatgactcaatttaccataatgttataaaaagaactcagtttaaatgtaaattttcctattaccgttttaaaaaattgttctataattggtaagatgaatatgcctgtgctaagcctagcttatagaaaatctgacaactggaatctgagctagttatagcactttcagagtagtactaaatagcaataaaggttagttaaaaaaagtcttttgatgtgcttctagctaagaattaccattttaaagaaattttatatataatgctaaaatatttgaaaaatactgaaaaataacgtttcttaagaaggaaaaataatcaggtatttttcatttagtgttttcattttgtcttttctgagcagtgtatgttgcttgagtaatattacagtggaagacatctgagtcataccatattataatattgatatattttagaagggaatatgttctcttttataaactgtgaaatatgtgaaacatatagcactgcatcttggccatctcttcacatgagtagatagatcttcttctctttcaccctagcattttttgtattatttattaattttaatttatttatttattcgagacagggtctcactctgtcacccaggctggagtgcagtggtacgacctcagctcactgcaacctttacctcccggattcaagcaattcttctgcctcagcctcccgagtagctgggattacaggcacacaccaccatgcctggctaatttttttgtatttttaatggagacggggtttcgccatattggccaggctggtcttgaactcctgacctcaagtgatccgcccacctcagcctcccaaagtgctgggattacaggcgtgagccaccgcacccagtcccaagcattttttttaatgaaaatgttcaaacttacaatagagttactatggttgctttatcaaatatgttatctccttatatacattcgtcagtcaactttttaagtgtatttctaaagaagttgcaggcatcagtaacctttagtccctaaacacttcagcatacagtcatttattgaatttaatgtttatgtttttaggcaaaatttatatactgtcccatgcataaatcttaagtgtacatttgagtcagatttgacaaatgcctatacccctattaacatgtatgatgtctttatcatcgtacaaagttacttcatgtctattcccagtcggtcccaccccacctccttccagaggcatctgctgtcctgattaattccctcaatatagattagttttgcctaatctaggactttgtataaataggatcatacactgtgtacttcttgtgtaaagcttctttcattctgcattgtgtttttgaaattcttttatgttttggcatgtaacagtagtttgctttccaaagtggttattctcttttacacttccaccaatagagtatgagagtaccagctgaccctcattctcaccaatgtttagtgttcttttaactttagtcatttgggatgtatgtagtagtatcttaatgttttaattcccgtctccctcatgactcttgatgttgagcaatttttcatcttttttttttttttttccggtattcgtatattttcctttatgaagggtgatcatagctcactgcagcctccacctcctgggcttaagcagtcctcctggttcagcctcctgagtagctgggactataagcacacaccaccatactttactaatttcttttagagatgaggtcttgctgcgttgctcaggctggtgtcgaactcctggcctcaagagatgctcctgcctcagcctcccaaagtgttgagcttacaggcatgagctaccatgcccaggccttttgcccattttttttggttgtttgagacggggccttgctctatctccaggctggagtgcagtggtctgatcttgtcttactgcaacatccacctcgtgggttcaagtgattctcttgcctcagcctcctgagtagctgggactacaggtgtgtgccaccacgcccagctaatttttgtatttttagtagagatggagtttcaccatgttgaccaggatggtctcaatctcttgacctcgtgatttgcccgcctcggcatcccaaagtgctgggattacaggcatgagccaccatgcctggcccttttggccatttttaattggattctttctctttgttgttgagttgtaagagttctttatatattctggtactggatccgtatcagatagatgatgtgctaatattttctcccattctgtaagttgtcttttcattttcttgatactatcctttgatgcacaaaagcttttaattttgattaagttcagtttacctatttttttcttttgttgcttttgcttttggtttggtttcatatttagatcatgaagatttatcattatttatttatttatttatttatttatttatttatttgagagttttatagggccgggcacagtggctcacgcctgtaatcccagcactttgggaggccaaagcgggtggatcacttgaggtcaggagttcaagaccagcctggccaagatggtgaaaccctgtctctactaaaaatacaacaaattagccaggcgtggtggctcatgcctgtgatcccagctacttgggaggctgagacaggagaatcgtcagaatctgggaggtggaggtcgcagtgagccgagatcgtgccattacactccagcctgggtgacagagtgagacttcgtctcaacaacaacaacaagaaagagttttatagttttgacttttacatttaagtcattgatccattttgagttagcttttgtatatggtgtgagatacagctctaacttcatatttttgcatgtggatacccaattgttccagcattcattgaacagtcttttctccattatcaaaaatcggttggctgccaggcgtggtggctcacacctgtaatcccagcacttagggaggccgaggcgggcagatcacaaggtcaggagatcgagaccatcctggctaacatggtgaaaccctgtctctactaaaaatacaaaaaattagccaggcgtggtggcgggcacctgtagtcccagctactcgggaggctgaggcaggagaatggtgtgaacctgggaggcagagcttgcagtgagctgagatggcgctactgcactccagcctgggtgagagtgcgagtctccgtctcaagaaaaaaatcagttggctatgatgtatgtgtttatttttgaatgcttagttcagttctattggtttatatatttgtccttatgctggtgccacatcgttgtgatttactgtagccttgcgataagctttaaaagcaagatgtgtgcatgtttcaagttggttctttttcaagatcattctggctatttgggttcccttctaattccatatgaatttgagaatcagcttttccatttttgtgaaaaagacctttggaattttgataggaaatgcattgaattgtattaatgttatgtctcccaattatgaaaatggaatttctttttatttgttttttgtttttctttcagcagtgttttacagctttcagtgtacaagtcttccacattcttggttaaatttattccttggtattttctttggatgctgttgtaaattgaattgctcttccttcctccctctttcctttcttttccttccccttccccttccctccctttcccttccccttccttcttctctctttctttctgtttttttttttttaagacagggtccactgtgtcaccgaggctggagtgcagtggcgcaatcatggctcactgcagtgttgccctcctgagctcgagtaatcctcccacctcagccacctgagtagctaggaccacaggttcaggccaccacacctggctatattattttttgtagagacagtctctcactgtgttgaccaggctggtcttgaactcctgggctcaagtggttctcccaccttagcccctcaaagtgctaggattacgggcaggagctaccatgcccagcctggaattgttttcttaattttcttctggattgttccttgctggtgtataaaaacacaactgatttttttttctgtttcttttttttcagacagggtttcactctgtcacctaggctggaatgcaatggcatgatcacagctcactgcagccttcgcctcctgggctcaagcctccaccttctgagtacctgggactaagggccataccaccatgcccggctaatttttttttttgagacagggtcttgctgtgttgcccagtctggtcttgaattcctgggttcaagtgagcctcctgcctctgcctctcaaagtgccagaattacaggcatgagctaccatgcccaaccacaaataatttttatgtgttgattttgtactttgcagctttcctcagtttatttattggctcagataccttttttgtagattctttcagcttttctgtatataagatcatgacatctgcaaatagaaatacttttacttcttcctttccagtttggttctattttcttttctctgactaattgctctgaccggaacgtctactacagtaacaaatggcaggggtgaattcaggcatccttgtcttattcctgattttagggtgctcactcttagtcttttgccattatattgttttatgttggttttccataacctcactatgctgaatagcagtttggcactctgtctggtagatatactatagcttatttaactggtcctttactgctgcattaagtagtttccgatgtgttgctattactgttagtgctacagaggataatattgtacattgaatatttgtgaatctttatctacaagatagagtcccagaagtgaggattgctgggtttctcttagttttctgattctaaggtgactatgtcctacttttagctccacattaaagtagaacatttctaggctgggtgccatggctcatgcctgtcatctcagcactttggtaagccaaggtgggaggattgtttaaggccacgagtttaagaccagtcagggcaatgtagtgagacccatctctacaaaatgttttaaaaattagacgagcatgatggtgcgtgcctgtagtcctagctattcaggaggattgtttgaacccaggaggtcaaggctgcagtgagctatgatggcaccactgtactccagtctgggcaacagagtgataccctgtctcaaagtagaaaatttctgtggagtagagtaagtatcattagctgatccaggcagtagaataggtggtgtggctattggaggtgtggaggaggtgatgttctagaacaagcttgtccaaccctgcgggctgcatgcggcccaggacggctttgaacgtggcccaacacacacatttgtaaacttccgtaaaacattatgagattttttggcgattttttttctttagctcatcatctgtcattagtgttagtgtattttatgtatggcccaagacagtccttcttccagtgtggcccagggaagccaaaagattggacacccctgctttagaagaataaactgatagtagcatccaagttatttgggagacttgcttctgaggaggagtggagtagtttgtggtagaccagtgctgctgctgagaacaactagaaaatcaggtaaatgtaaaaaatagtaatttcatgttatttaagagctatagaaacagctatgacgaaggattgaaatgtacagaaatgccagataaacctttcagaggttacttgaggatttgtaactgtgtttccctaaggagacgcagcagctgagaatgtagttttggcctaggctaagcaatactgctggggggcagtagatgttttggtggtcacacaggactggagtaacaaaacccattggacactgaattgaaagtccaggagggacatatcttcgattcagtggctaaccctggagatggactgattccctttcatagcaaaggatgaacccattcttaatgcaagataacatcatcttgttcttgtgtgattcttatatatacagtgtccagtattcagtacaacattactagtcctatgaagacagataaattaatgacttaactaaaagaaaaatcattttagaagcgatctcaggtgatcctgatgttggagttagcacataaggactttaattaattaagattaatagcttaaccacaatgagctatcacttcatacccagtaggatgactaaaataaaaaggacagatataacacgtgttggtaaggatatggaaaaattggaatcatattgttggtggcacagctgctgtgaaaacagtttggttgttcctcaagaagttcaacataggctggtccaagtgcagtggtgtttacaactaattaatcacaaccatttacagatgtagttgttccttctccactcccactgcttcacttgactagcctttcaaaacaaacaaaagaaggtcaacagagttgctgtatggcccaactgttctactctgaggtgtataccaaagagaaatgaaaacatactttcattcagaaacatgctcataaatgttcatagtagagtggcattactcttaatagtcaaaaagtgtaaacaacccaaatatccattagttgcatagataagcaaagtatgctgtatccatacagtggaatattattcagttctaagaaatgaattattattctgctatatgctacaaggtagatgaaccttgaaaacatggtgattcaaataagccagacacataaggacaaattttgcatgaatatggttgtatgaggtatcaagaacagggaaatccattgagacaaaaagtagaataaaagttaccaggggatggggaagggggggatgggaagttactgttccatgtatacaagatttctgtttgggataatgaagaagttctagaaatagatagcggtgatgtttgtacagcattgtgaatgtacttaatgccactaaattttacacttaaaaattattaaaatgataaatcttttttactcttagtaaaagatatgtgttaaaaaaggaatgaactactggtacatgctgtgacacatggatgaatcttgaaaacttgatgctaagtaaaagaagtgggtcacaaaataccacttattgtatgataacatttatctgagatacccagaatcagcacatccatagagtagactagatgttgcccaggcctgggaggtgagaggaggatagctagagaatgggatttgactgctggcaggtgtggggtttctttttggggtaatgaaagtgttctaaaattttattatggtgatgattacgcaaccctctgaatatactttaaaagcactgaattgtacattttaagtgagtgaattgtatggtttgcgaattatatatcagtaattattaataagcttagataataaatagcaatgaagatataatacatattaatggatagatggaaattgttatctgaggaaagaaagtgtctaaaaccatatataattggagtcatagagcatagaaaagagggtattaaccaatatttgaaatggtattgactaaaattttccaaaattgatttaagatttaagggtgtctgtgaatcccaagtgggataaatacaaattaaaccattcctaggtacatcatagtaaaacagcttacaactgaaaacaataataaaacttttaaaacagccacgggggaaaaataacacactaccttcaaagtaacaatataagactaatagctagcttgtaatcccagctagttgggaggctgaggaatgaagactgcttgagcccaggagttcaagaccagcctgagcaatgtatctagatgtccatatcaaaacaaaaataaaaactgatagctgtcctcttgataggttgaatgaaggagggaggtagatcactttgattgttacagtagttcacacctgagccaggcattgcaaggagagatggatggattctcattaagttagtggagtatggctacctaagggaatacagaaagacttccctagagcatgccagtatggatactttcaagggaaatccatttctaaattttcaacttccacattcactcttttctaaaattccaccctgtgatggaagtatcacagcagtttttcctttctgtttctttcacaattacccattcccagtttgcaaagaaaggcatacctctcttgattcttactgtggtgctttgcctcagaatgtagcagccttcagatggcctaagacaggaatattttgaaatactggtattgatgtacatagaattcatttttaatgagttaggtatcagatcctagtcagatagtttctacttctttgctttcagcacaattgatgttagctattatttttgtgttctctttttattttatttttttcattcctcacctaactggtagatgttagccattctttaaagatggatcattaaaaataaattttaatattagatcagtatggatttttttgttttgcaaatggctcaggaggtgttcaaataattgaatgatataataagaaaaacatattctagtctcatctacttatttatgtgaataagacttctcagggcaaagacatacatttatacaaataaaagaaattatgctgattcctggatttataattgggaggaaaaaagtttcatccaccccactaagagttgatgcatccagtaaaattttacatatgcatatattttatgtatgtgtatgcacgatgtaattgttgtttggattatttgtatacttaaaatttggatagctcaatccttggaaaacaatacttgaattttataagcacaagaaatttcaaaatcttcaatttaaatttatttacatatatttttagagaagtaggattaaaaaataaatgtaagactttcaagcatgaaaatacaatatactgctgggtgcagtggcatgcacctgtagtcccagctactcaggaggagtccagcctggacaatatagatagtgagaccttgtctgaatttaaaaaattttttaatttgtgtatgtttgtgtctcagttattttttaaaaaaacaatatgctctgtttaaattgttatcaggagccaggtgcggtggcccacgcgtataatcctagcacttttttgggaggccgaggcaggtggatcacctgaggtcagaagtttgagaccagcctggccaacatggcaaaaccccatctgtgctaaaaattcaaaaattagccgggcatggtggcgggcacctgtaatcccggctgctctggaggctgaggcaggagaatcgcttgaacccgagaggcagaggttgcagtgagccaagatggcatcattgcactccagtctgggggacaagagcaaaactccatctcaaaaaaactaaaaaaaaatttgtatcaggaaagtgaaatggagatacaaattctttattgcttaggaagaattcatttatagttttttttttaatgcatgatggtatatatatcatcattatggaatgtaggttatattggatacattttaaagagtgaaataacagttttaatatattaatcataaaaagttttaaatgttaacataaatatccaagaatttaacagtttttctaaagtattttaacagatttctgaaaaaaaattttaattatcattgccaaggtcagcactagggtgaggcaagaaggcacctagagtgcaaaattgaagaaggttcttactctcaggattctgcaagtgcagcatcagcacttaggggaacgtaaaagtgagtgcctccctaaattaggcaccctaggatgcttgcttatcctagttccaaacctgatcactagattatttaacatgagaaattcgcttgtgaatcattgactttagaaaaaaataattgcaaacattaatcatttttccatcaactgcttttaatttgttttttagggtgggattaaaaactcagcctgaatcaaaatgccctgagctgcttgccaattactgtgacatgttgctaagaaaaacaccattaagcaaaaaactaacctctgaagagattgaagcaaagcttaaagaagtggtacatgaattttttgtatttcaacttttaaaattaccttactttgaatttgtgttttgcttataggactttctgtgatagtatcaatttaaaaatgtattatctgtaaagaactaatgttacgaagatttgcagtgcaagacctctcggggggttatttttctttctgaaaatttttattctacagcttcttgaaaggaataccatttaattcctctcctttcttggttatttttaggaattaagttctagctactaatacaggacatatcattccaacaaatttggaatgatagttgacagattgggagtttttcactccttcctttttgtgagagtccaagatagatagcaagggatgaatgagagtagattaagtagttgttttcatctttgtcacccagttgttagtgtaatgatgtaagcccaggaatacaaacaagaaaaaaaataagatattgggcaagtgtagacagaaaggccgagagagatgactagtgtcagaaaaaaaagtgaaaaagataagtagaagagacactttgcagggggacattgatttttttcatgtaaagtatatcgttgcattttatacaaaatctaaaaaactgatatttagaccgactaacaatttggttatagtctcagttttgctaacctttaaagtagtgtatcaggactgggtatttctcagagatggataattcagtaggcctctatctgtatatgctcataaaagtttctgacttgtgacaattggtggatatagaaaggtctaaattcgagagatggtaagagtatataagaactgaaagtaactttatttttcatacagctcttggtacttaagtatgtacagaacaaagatgtttttatgaggtatcataaagctcatttgacacgacgtcttatattagacatctctgccgatagtgaaattgaagaaaacatggtagagtggctaagagtaagtaaatttttttaaatatttggttttctaatacattacatcatttatatgtgtgcttaagtaatacattttggagatattgttaatgtcaaagaagtaggaaacattttataagaatatagcgtcagttaggccgggcgcactggctcatacctgtaatcccagcactttgggaggccgaggcaggtggatcacctgaagtcaggagttcaagactagcctgaccaacatggcaaaaccgcgtctctactaaaaatacaaaaattagctggatgtgctggtgcactccggtaattccagctgcttgggaggctgaggcaggagaatcacttgaacccaggaggtggaggttgcagtgagccaagatcgtgccattgcactccagcctgggtaacagagtgggactccatttcaaaaaaaaaagaatataccatcaattatataaaataaagtgatatctaataaatgttcttaatactttcagtaaagtatctttgttcttgagttgtttctactgtttcactcccatttgtacctcaactctcatttaaactgaccttattaataaatagactacaggggctgggcacggtggctcacacctataatcccagcactttgggaggccaaggcaggtggatcacaaggtcaggagatcgagaccatcctggctaacacagtgaaacccagtctctattaaaaatacaaaaaaattaacgaggcgtggtggtggggggcctgtagtcccagctacttgggaggctgaggcaggagaatggcatgaaccctggggggcggagcttgcagtgagctgaaatcgagccactgaactccagcctgggtgacagagcaagactccatctcaagaaaaataaaataaataaatagactgcaggacaaattattatatctttaaggtattttcagtactaaatgcttaactttagagatgtttataaatgataacaataaatacttctgtatagcaaaaagaacctttaaatgatggcctatttagggtaatcaatgctgattataactaaattcccatataaagtattttgagttctttttttgttttaattattaaagtaaatatctttaatttctgtgtatgtatataactctctccacatatatatggagagagagagagtgcgagcaagcacacacgagagagacctacagatattttaacttatagctagcccttcgcatggaactttaggatagtaaaaattactgtgctaactgaaactgcttagtaggaaaaagaatgattattctgtgactttttaaaactattgtcaaaagactcaaaactcttactgtcacttataagtatataggaaaaaggggaaaatagcaaaactaatacatatttactacgagaaacctttagaattaaattttctttctttctttctttttttcttttttttggagatgtagtcttgctgtgttacccaggctggattgcagtggtgcaatcttgactcactgaaacctctgtctcccagattcaagcaattctcctgtctcagcctcctaagtagctgggactacaggtttgtgccatgacgcctggctaatttttgtatttttagtagagacacggttttgcatgttggccaggctggtcttgaaatcctggtcttaagtgatccgcctgcctcggcctcccaaagtactgagattacaggcgtgagccaccacacccggcctatgttatttctttgttaaaaaaaaaatatcaagacccaacagtaaaatgacaaacaaggctaggcatggtggctcacacctgtaatcccagcactttgggaggctgaggagggcagatggcttgtgctcagagtttgagatgagcctgggcaacgtggtgaaaccccatctctacaaaaatttaaaaaattagctgggtgtgatggcatgcaccttagtcccagctgcttgggaggctgaggtgggaggatcgcctgagcctgtgaggtggaggttgcattgaacagagatcttaccactgtactcctgcctgagcaacagagtcagatcctgtctctctcactcacacacacacacacacacacacacacacacacacacgacaaataattaaaagcaggcaaaggattcgaattgacatctcttcacagaagatagacagatggccaataagtgcatgcaaagatactcaacatcattagtcattagtgaaatgcaagtgaaatgctcaacatgttggctcctgcttatcccaaatattttgaaaggctgaggtgggaggattgcatgaagccaggagttagaaactaccctgggcaaaataacaatactccatgtctacaaaaaatacagaaatcagctaggcatggtgatgtgtgcctgtggttctagctactcaggaggctgagatgggatgattgcttgagcccagaagttcaaagttgtaatgagctgagattgtgccactgcactgcagcctgggcaacagagtgagaccctttctcaaaaacaaaaaaaacacaaagagatactactttattcccactagggtagctaaaataaagacagatgataacaaatgctagtaaggaagaggagaaattggaaccttcgtaagttgctagtggagacataagatggtgcagacactttggaaaactgttgggcagttccttaaaatgttgaacatagagctgacccagcaatttcactcttaggtaattcatttgaagagaaatgaaaacatgtttcatgtaaaaacttgtaaacaaatgttcatggcaagattactaataatagtcaaaaagtggaaacaacccaaaatgtcagtgagctaatgaataaaatgtgatttatccatacaatggaatattttttgtgataaaaaggaataaactaataatacatgctgcaatattaggtgaactttgaaaacataatgctgagtgaaagaagccaatcccaaagaccatatcgtatgattccactaatgtgaagtgtccagaataggcaaatccacaaattccaggagttggggccaggaggggaaatgacgagtgactgtaaatagtatggggtttctttttggggtgatgaaaatgttctaaaattagatagtggtgatggttgcacagttctgtagatatactaaacttcattacactgtatattttatttttatttttattttttatatttttttgagacagagtctcactttgttgcccaggctggagtgcagtggtgcgatcttggctcactgcaacttctgccacccaggttcaagcgattttcctgcctcagcctcctgagtagctgggattacaggcgcatgccaccatgcccagctaatttttgtatttttagcagagatgggtttcaccatgttagccaggctggtcttgaactcctgacctcaggtgatccacccgcctcagcctcccaaagtgctgggattacaggcatgagcccagccaaattgtatactttaaaatagtagattttatggtagataaattatctgacacagtaaagctgttaataaagagtagtttgaatagcttttgccttcttgtgtaacttgacagagtaagcatcttttctttgccttggagagttgtcacaccccctgtaatttggatgatcttctagcattttatcttttgggctgtcagtgtcatgaaatactgagaattcctttatagcatttttgccaggatcacttcttctagggtatcttatcttttttgtcactcaccacttttatcttttatgttggtaatttgctttcactaagttcctcaacactggcattgtcagccttactaccacagtcagctttcttctataactccatttatgttctattttattttcatttccagcattatcacttttcatttcctgtttacttttatatctttgccaattatcttgtttgattattcttttttgtaagtagtcatgtgggtttattactggaagacaaggatgcaatgaaactgcatactttgctgtctgcagtttaactgaataaacaaatgactaataggttgtgtttacattttttaaaaatttatttatttaattttttcaagcaacaggatcttctgttgcccaggctggagcgcagtgacacaatcagagcttaaactcctgggctcaagcaatccacccacctcagccttccgagtagctgggactatctcggcagtatgccgccatatcctgctaacttttaaaatttttttgtagtgatgggggtgtcactgtgttgcccaggctggtcttaaaatcctggcttcaagtgatcctcctgcttcagcctcccaaagtgctaggattacacaccatgccaactaatagattttgaaagaagtattgtggttagtcattgttacttttgtcatgatttgtggatcaaagagctagaaataaagtttttacttcatgcagttaaatttattatatagtgtcaactgaaagttgagctttgttcttggggaattggtattatttaactgtactgtggtaactgaaattcatacatactaaaaatgcgcaaagcagggaccccttgtaataccgtattttgtttctaagtagcaaatttcataggtattagacaataaaattctaataaatgagaaaaattttgtattaaaacatttaagacttagtttttctattaaaatttttcccagtaatatatcagattatgtatttattacctcttccttctttggtttatatttataggaagttggtatgccagcggattatgtaaacaagcttgctagaatgtttcaggacataaaagtatctgaagatttgaaccaagcttttaaggaaatgcacaaaaataataaattggcattaccaggtattattttataattacatatatatattttttaaacttagaagaatatctttgttttccagtaaattaaaaataaacctcagcagtaatagatcgaaagatgttatgaagtccatttccgtggagacagctatcaaagcagtgtgttagatttacagatctttatttcaaaacaaaaggacacttttaacaaaatctttatagtcttattgatttttcacccaaagttaccctgtatttattttgaattttatccattgttaatttactttatattcctgatattcttctctatagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattgtaagtagatagtgtgttagttatttcagctttcagtttggatgaaagtagcaggactccgcagaattgcttaaacaaaatagatttttgcctctctcacatgtaaaagtttgagcagaaatagtgaatttttttcatgaagttgatagggacataggcttctggttataccatcatacttaagatactgccgttgtctacagaattcaacatgatcccaactatctcagtattcctggcaacagaaagcaaaaggtgagggtagcttacacctttcattagggacaacttctagaagtttcctctgtcattttccatttgcatccgccagtactcagtcacttggccacattttgttacatggaaagctgggagatgagcgtgtattctgggcagtcattaacgtcttctaaaatgtttattactgtgaaagagtggatactggaagacagcaacctttttcatatataaattcatgtcatagatattaagagagaatcatcatgagattctttattaaaaatctgttttatctattatagataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatgggttggtttatgtttttttgtttttaagactgtatcctctcatgtagcaggaaatatatgattggcttgtaatatattagtaaattcataacagtttcagaatgtcttatcaagaaaaatagaggccgggcacagtggatcacgcctgtaatcccagcactttggaaggccgaggtgggcagatcacttgaggtcaggagttcgagaccagcctagccaacatagtgaaaccccatctctactaaaaatacaaaaattagctgggcgtggtggtgggcgcctgtaatcccagctacttgggaggctgaggcaggagaatcgcttgaattcaggaggtagaggttgcagtgagccaagattgcgccactacactccagcccaggcaacagagtgagaactccgtctgaaaaaaaaaaaaaattatgcacacacacacacacacgagatatttatggaaaaaataaattgcaaataggcaagttaccaaggcagagaaaagtgcttcaaaaaaaaggagaggctggggcagtggctcatggctgtaatcccagcactttgggaggccaaggtgggagaagaggattgcttgaactcaggagtttgagactagctaggcaacatagtgcaatcccatctctaaaaaaaaaaaaaaaaaacaaattagccagcttggtggctgtatccccagctacttggaaggctgaggtgggaagattgcttgagcccaggaggatgcagtgagccacaatcacaccactgcactccagcctgggcaacatagtgagacccatctcaaaaatttttttttttaaaaaagagaaagattgagttggtatttaagtgttacctgtgaggaatgtgaccagctatgtactttttttttttttttttttttttttttgaaacactcttgtcgctcaggctggagtgcaatggcgcaatctcagctcactgcaacctccgcctccagggtttaagcgattctcctacctcagcctcccaagtagctggaattacaggcatgtgccaccacactcagctaattttatatttttagtggagacggggtttcaccatgttggtcaggctagtctcaaactcctgacctcaggtaatttgcccgcctcggcctcccaaaatgctgggattacaggcctgagctactgtgcctcagatacatacttaatttttatactgagaatgtgttcaaagattttatgataatcaaaaatctaaaaactttggtctgtttgaggacttgtagattgtactcattagccccctgctcacaactacattttattactactccatagacctcttaaaagttccaggtttttttgttgagacagagtcttgctctgtcctccaggttggagttcagtggcacaatctcagctcactgcaacctccatctcccaggttcaagcgatcctcccacctgagccccccaagtagctgggactacaggtgcatgccccacgctggctaatttttgtattttcagtagagacggggttttgccgtgttgcccaggctggtttcagactcctgagctcaagtaatctgcctgcctcagcttcccaaagtgctggaattacaggcgtgagccactgcacttggcctgaagttccaaaattaattattacctatggaggaaatagctggtatataactggcagatggtgtttactatggtcctgtgtgaccaatcccagtttcttgtcttactgtaaagagagcatttattgctttctcataaccaactcttttcacctcttctctttcctcattatgcattcaaatgttatattcatggaagtaccacacattttaagtttgtgtttgtaatctttttcttgcctatgttgattatgtgggagaattgatcttagtattccatactgtttatagatgctaattgttttctccttattcttcatagtctttagtagctttcccaaaactcaaacggcaagttttgttgtatgaacctcaagtcaactcacccaaagactttacagaaggtaccctcttctcagtgaaccaggagttcagtttaatgtaagctcgttagttgatctaaaataaaaacaccttgtttgaattttagcactttgttttttgcaaaataattgttttccttacattatatttaaaacattatatactgtcatcactctaaacttacatcatttagttgtttatggaaaatattaatcagatgtttacttttctatatttttcattgatacatttttggtctctgacattatactgtattgcatttcatctttcaggttgatatctttttgtgctctaaagcaactttattcagagaaagcgttttttgtgttgttttgtttcgtttttgtttttgtttttgtttttgtttgttaagacccagttaggcaataacactgaatcctaacccatatatcttcaattagctagtcactttcatggcaatataaaatattaactttgtttttacagagaatgtagtcacttgttttattaacaggttagttatcatgtttaaggaaaatacatagagtttgttttaaagcaatatgtaggttatttgtcatttaacctttaaacagttctgatattttagcatatttttaaatcttttctctcagacattgttgctataataggatttttaaagtgtttttcaccataaaatacttgatgcaattctttttgtagaaaaaatgcaaaggttcagaaaaggggtaaaatcaacttgattggacgtttgcagctcactacagaaaggatgagagaagaagagaatgaaggaatagttcaactacgaatactaagaacccaggtttgtaatgttgacagaatgtctgaagtttaaaaaaactttagttttttttttttttttttaaattttgaaatcttttttgaatttaaaagcatgtaggggctaagtgcagtggcccacacataatcccaacactttgggatgctgaggcaggatttcttgggcaacaaagtgagatcttgtctcaatcaattttttaaaaatatattaaaaatttccattccagttgaaatatgaattccagtttcatattccattgtaatgtgaaattaggaaacttatttagaaccaaaaaagttctctaatattcatttcttcttttaaaaacagtttaaaactaggattaagaccttctgaatataataagtaacacctacacatgattgttttaattttagaaatagtccttttaaaaccaaatttttcaacttttactattttcatttaatactatttgaaacttctggccagtgtactttttttttttttttttgagacagggtctcactttgttgcccaggctagagtgcagtggcaccatcttaactcactgcagcctcaactccctgggctcaaaggatcctcccacctctgcctccggattagctgggaccacaggcatgcgccaccacactcagctaatttttgtatttttagtggagacagggttttgccatgttgcccaggctggtctcgaactcctgggctcaagcaatatgcctgcctcggcctcccaaagtgctgggattacaggtgtgagctaccatgcccagcccagtgtactttttaaaatataaaacaagacgaaaagattaaaaatgcatattacctatagatcatgtaataggataatgtggcagagaaaagatgaatgaataaaaaccaattgcatttctatggggcaataaataaaaggagaataaaataagaaaaatacatacacattttttaaaaagtactgtgtaggagctgtatgaaaagagtggccctttactgggagattcagaaggagagttgaataaatagaaaggttgagctctttttttgttgctaaaatttttagttgtaatttagacacaatggaatgtatctttcaaagtataattttcagtgagttgtgataaatatatatacctatgtgaacattacccaattaagatacagaacatttgtgtcacaccagtcatcttcccatgtttccaggcaggctctccgcctaccccagctgattcttattaccatcacttagttctgccagttctaggttttcatataaatggaaccagacagtatgtacttttatgtctgactttttttgctcagcatgaaaaactatattcttccattaaaggttgaataacttaaacaaaaaaaaaatttttttttttttttaatggactcaagcgatcctccttcagccttcccagtagctgggactacaggcacatgccacggcacctggcagctaggctgaataacataaaagattggtttttctgatattaatatcaagttcaaaattttaaaatttcacatgaaaattcaactaggaatatttttggaattttacaaattgttttttatcagaataaataagaatgattgagaaacttaaaaaaataaaaaaaaggtggtagtggtggaacttgccctgccaaatacgaaaatattttaaaaatctgtagtaataaaacagtatggcaagaagattaattgaagaaaataactttaggctcggcgcggtggctcacacctgtaatcccagcactttgggaggccgaggtgggcagattgcctgaggtcaggagttcaagaccagcctagccaacatgttgaagccctgtctctactaaaaatacaaaaactagccagctgtggtggcgcatgcctgtaatcccagctacttgggggtgctgaggcaggagaattgcctgaacctggcgggcagaggttgcagtgagcctagattgcgccactgcactccagcttgggcaatagagtgagactccatctcaaaaaaagcaaacaaaaacaaacaaaaaaccttactctgtaagtatagaagaatttatacaataaaggaaataatttctatgacctatggaaagaaaatgaattattcactaagtggtgttgggaaatttttctgtttggaggaaaagtaagaagatattcgtagctatgccaggataaactcctggagtaaagagttgaaatgtggccaggcgcggtggctcacgcctgtaatcccaacactttgggaggccgaggcgggtggatcacaaggccaggagatcgagaccatcctggccaacatggtgaaaccccgtctctactaaaatacaaaaaactagccaggtgtagtggtgcatgcctgtggtcccagctacccaggaggctgaggcaggggaatggcttgaacctgggaggcggaggttgcagtgagcggagatcgcgccactgcactccagcctggcaacagagcaagactccatctaaaaaaaaagagttgaaatgtataagcgggtgtagtcgtacgataagatgtgcagagaaattgaagttcttttgttttgtcttaatgtgacccataattatgtacaatccaataatctaagctgtctttaggtaatgctcagactttatttcctcctgatcctactccattcatccccattcattgctatttgcataggtggcatctggatatattgagtgtgagagggatttgcttgactggtaatgacagtaaagggagtgtcatatctatgcagttatgacagtgtcctggattcttgcttttggcagctatgaagtagttgattatctttgggaatttggctttctgttggtaactgctgctgttgtctacagcagatgaatttatggttcattctttttctagttgctaagggccccatggcctcttccctgctctctttcccctgctcttactgagctcttgaagcctctgagactccactacatcttctgtgtggctccttggcctacatggcacactgtcattgttctctgcagaataatgacaggatcaccttgccctgtcattaaaggccctgtggcaggtccattagctcgaaactcttgctgtcacacttgggaactgagggagagtcagaagtgcagattatttccctcatactgtgctactctttaagtgacctccagcatatcaaatggggaccagggccagtgtccctctgctctcttttcctcttaggttctctaactaccaccttcacctctatctaaggagaaactgggatgtttacaaatgcctctgcttttcctctgggttcctgtaatcttcaagtgcctgaaggaacacactttccttcttccttcttcctctctgaacccctgacataaaccccaatttatgatgatcaggagcctggtatctgaataccatcaagggtgagaggaattcacttgaccttctggtgtcatcatatcttttatttatttttgtttattttattttattttgagacagggtctcaccctgttgcccaggctggggtgcaatggtgtgatcttggctcactacaacctccacctcccaggttcaaatgattctcctgcctcggactcctgagtagctgggattagaggtgctcgccaccacactgagctattttttgtattttttgtatttttagtagagatgggtttcaccatgttggccgggctgatctcgaactcctgacttcgtaatccgctccccttggcctcctaaagtgctgggattacaggcgtgagccaccatgcccggcctatttttctattcttttgagacagggtctcactctgtcacccaggctggagtgcagtggtacaatctcagctcactgcaacctctgcctttcaggctcaagtgatcctcctgactcagccccctgcgtagctgggaccacaggcgcgtgccaccatacccagctaatttgtttttgtatattttgtagagatggggtttcgccatgttgcctaggctggtctcaaactccacgactcaaacgatccacccacctcaacctcccaaattgctgggattgcaggcatgagccaccctccctggctggttatcatatctatataggggaagttgaaggagtttttctcttactgaatagtgcctgactcccaagtctgttgatttgcagcaaaattatatttttaaacgttaaaagcaaatgttacttctttttctattttgacatttcttttacaacaaactctaatctgtgctaagatagatatatgccttttgttttggagacagggtctcaggctgtggtgcagtggtgtgatctcagcttactgcaacctccacctcccaggctcaagcaatcctctttcttcagcctcctgaatagcggggaccacagacacacgccaccatgcctggctaatttttgtattttttatagagatggggtttcgccatgttgcccaggctgttctcaaactcctggactcaagcaatccacccacatcaccctcccaaagtgctaagattacacacatgagccaccacacccggcatatacatgccttttgttgggtaaagagagagctggtactggaaaaggtaaaagagaaaagaatatttaatgattttctgataactcttattgtaaacttaacagtaattaaggaaatcatcaagaaaaattttgataaaatgacctagatgaaaaagatttatttctttagaaacttaaaagtgactgggcatcgtggcttacacctgtaatcctagcactttgggagaccagggcaggggagtatttgagtctgggggttcaagaccaacctggacaacatagcaaaaccttgtgtctgtatttaaagagaagaaggggaaaaaaaaaaccttaaaaacatttaattgagtcaatataaactgaagataatatttgtagcaaatataattaattaatctggtaaatatataaagagtactacttaatgacttttaaaacagaccccacctgacctgtactgctatacaaagaaataactgaatacaagggaaaaatttggtgtaaggggtttgttatattttaattaatgtttaacatgataccaggttatatacacattgttttcacaggtaagataacttttaagaatgtgaatggcatgggaaaaaaggaattgaaggaaataatattaaaacattaggtgtagttttctttcagcagagaagcagaggtaattttgcttttccttatttttcaaaatctctatagtcagattttttttaaatacatactttaagttctgggatacatatgcagaatgtgcaggtttgttacatgggtatacacgtgtcatggtcatttgctgcacccatcaacccgtcatctacatgaggtgtttctcctaatgcttatccctcccctatccccccaccccaataagcagattctcttttatggggcatgagaaaacaaaagatgtttttatttgttaagtaaaagatactagtctcaacattaatcccctagtgattattattcatttgggtagatgttggatagaggatgaatatgcataaaaagtcatttttcagtttgttgtacttaaaataatttcgtatattaatgcgcttttatttttattttttcttttaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaagagaaaattgattccccttgaggaaagaatggctcaacgtggatttttattcattgtggtgcacgtttcaaattttcttgcaaattattttatatcttatttgatgttaagtaatatttttaaagtatggtttttgaagatagtaggaaatggagtacagaaaggcatacagtattatgttacagtggagtgctttcaagagcatttcgtaggatctgtccccatccgaagaggctttgtgaactgcctgctgaatggaaggaaagcaactttaaaacatttagagttttgctgagtatagccaaatgcctgttctgaaacttataggaaattggaattttgtttaaaattttacactttaaggtagcaaatgtcaattattagaccgagcatattgtgaagaattaaactaaaattaatacgtacagttttctctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttgggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaattttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaataaaaaaaaaaaaattccaacctgaaagtggttaatatattcatcaactaagataggctatgtcataacaaaattcaaattttatagcagataaaagtaaaaaatgggccgggcttcagtggctcacgcctgtaatcccagcactttgggaggccaaggtgggtggatcacctgaggacaggagttcaagaccagcctggcaaacatggtgaaaccctgtctctactaaaaatataaaaattagccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatatatttgaaaatttgtgaaaaacttatttttgtttttatttttattttttgagacagagtctcactttgtcacccaggctggagtgcagtggcgcgatctcggctcgctgtaagctccatctcctgggttcatgccattctcctgcgtcagcctcccgagtagctgggactacaggcgcctgccaccacacctggctaattttttgcagttttagtggagacagggtttcaccatgttagccaggatggtctcaatctcctgacctcgtgatactagctgcctcggcctcccaaagtgctgggattacaggtgtgagccatcgcgtctggcctgaaatacttatttttaagctagaaatagtttggcaataaggttgtgaaactggacagataatagcaattagttactgatcaagtgaacaatttaataatcgaaaaaactcttgactataagaaacttgaatt

SEQ ID NO: 16157 - DNA, 34414 bp, Human; identical to SEQ ID NO: 12330

SEQ ID NO: 16158 - DNA, 48219 bp, Human
  misc_feature (1)...(48219): n = A,T,C or G
aaggtctaacatgttttttttttcttgtaataaaattcattttaacattgccaccaccattcaagcagtaataccaagattgactgcttggatgctgtttaattcatgtgtgtgccatgtaggtaaaaagcatgttgtgaatatgcattacctacagaatatgaaaaggatgcatgagatctagctgtgttattttttagaaccacatgtgaatctacagtgacctcaaaataggaatttaattattaaaaacataatgggatgttatatgaatattttgatgaaacactatttcctccccacactttttttttatgtttcttatttttttagtctcatttattactagttcatttgttcattcattcaataaatgattattgagcacttgatacatgcttaatttggtttagctattgaggtcaaatcaattattccaaaaccatcaccagattataattgtttgatatcacataaaggatgtcatcttattttgttatttaggagtaagttttgcagcacaagcgttttccagcttttctatgggtgcatttaagggccttggtaacattagttttaaaatattttaaaaatttcttccagggtaaaattatcatggcgatgcttcatggtgtagaactgatgggccttgattacacattcatccgcgtgtaggaacaggaaacaatttagaatcagggctctgccgtggccactcatctgtgaagagcagagtgaatttctgtgcaggcagatatcctggaggcccctgagttttcccaagaagacagcattctttctcccagttcagttttggactcacttggcaacacagaacatgctctctgaaacttttcagagcatggacctttaagctcaaggcagcctccaagctgggtgtagagaaaccacgagctgcttatggcagacagcctggagagcagtcagtcagtcctgtggttgggtgaaagttggcctctgaattagctggagcattggaggggctcttggttactctctgtcattccagtccccagaatggctttcactgaattgtgctttggcataatattaggggtgtcagcatctaatgaataaaatgtgggggtgtattcagtagctggaagtaaaatctgacattaggactgaagggggggatttggtttttattagtggaaaagttggggatggggccaaggcaataaagccacccctggctttagctgtacttcctctcctttgagcctttctggagaactccttgcagaccttttgattgtgatttgaatagtgaattgaggttgaggaacaagagtaaaacccttttctgtgctttgaactttgtagaacttgattgcatgttccagttagttatattgagtcattgaagggatttttccgtagaagtaatgttataaatgggctaggctcaggcagacttgccagagtttatttaatctagcatgtgtccgaaccatactattctggtaataatagttccttacaaaatgtagctctcactaatttattacattggttctgttggaagatgaatctctggtttctcccggggatgatgtttgttttttctgtttggctgctatggccaaagtggatgcagtagccgcaggttccaaagggtcttgggcaggaggtcagggttctttggtgattctgtgctgatcctgaactttggggaaaaagtccctaatggcagtcagtactatccaggttgctgagaaaggaaagggaatgcctcaggccctggctggagcagcctctcagatacaaaggagaatagtctcgggtggtccgtgtgtggaaatgcgtagaaacaatggtagcatgagactgttaggttgaaaaaggctaatgatatgaaatctggcatacaagtgagtagtgtcatttttgttacgactgttatttctttgtcaatagatcacaaatttagtgttaacatctcatctaatttttgtttcttgtagtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtggtgagtgtcctcaaggagaggaaaagtcatcctgagattcaaagagaaagtgagtgagtgtcctcaaggagtagaaaagtcatcctctatgaataaatcgctattgtgagttttctaggcctttttttttttttaacctgaatgatgttgagacaatgttacgagaagtcaacctttatgtattgcttttgaagttactttgaaaaccacaaagctcgactgcagaagtctcttcaagggaaagggaaactgaaaattattataataatcttacatgttgcaactcagaaaagcaaaacagaaactagatgggggaacttagacatatttagaaaaagaaaaatttcctttaccttatatagtatttttaaatacttaggctaataccttcatactaattgtaaatggaataggttggtataatcaagaacacacacacacacacacacacacacacacacacacacacatttttgagtcggagtctcgctttgctgtccaggctggagtacagcggtgtgatcttggctcactgcaacctccgcctcccaggttcaagcgattctcctgcctcagcctcccaagtgcctgggattacaggcacatgcaaccatgcccccctaattttttgtatttttagtagagacggggtttcaccttgttggctaggctggtctcgaactcctgacctcaagtgatccaccggcttcggcctcggcctcccaaagttctgggattacaggtgtagagccaccgcacctggccatatttttttttttaaaggaaattaattaatgccacattttgtttgttttgacaaagctgtaaaaacttttgtaatctaaattctgttgttgataccaggacttgtccccatatttgaccgaaatgctaaccaacagaccataggctggttgacttttgtttgttttagggaagattcattcaggaagaagatatttgtgtaggtttttcttatcctcttcaggttatggagcagctggaagttttgctagtatatctgatgtcaatcaaattagaaaacagagctagtaataacacttggcaggtacacagatttctctttctattcttgcctcgcagtatctacttaaataacatagaaaggctttgtcaacattttaaagcacaacaaaagagcctcaccattttctggcacagacctaaaagtatgtggtagaggaccactggtgtaagtcgaaaacatttattttcagctttttgctattttatatagctgagctttaaatagaaatttccctctatttaattaaacttaaatgttattttgagagtgaaagaaaatggatttcacaaaactagatattctttttctttttttcctccaggaaaaacatctcatttctaggtattacaaaatcagtttccactggagaaccacatttcagggtagcagggcttgtgtggtctggcctctgttcagagtcaccctttagaaagcaaaagcagttgcagtttacttagggacttagaaactttccattgcaaaacagtgttatttagccatagtttaggttctctgaaattttttctttctttgtggtaacaccaatagtactttcagactggacctgttctgggggaattggcaacaaactgaaatttcccattagttgtgtatggatctattgtaaaactgctgataaggtatcatcatcattattttttttttttgctgagattgttttttatcacattggatcagtgtctggcctttcaaaatggaacctgaaggcagatgtatttataagcatgtatgcatctgtaaatggtgaccaagtagataaaacaccttttcctgcttgctgtgtgcctctaatttaggaaataatacaattcctgtgcaaaagctacacaatcgttgtgttactatcttgtcaaaacgttgcatttttaataggaatgtactcatgagacacaggaaaagagaatttttttcctcctactcccttagtatctcagaaacccaaagaatatgtttgggaggaaatttggccatttgatttaccaaaacagctttcctgtgagaaaactgaaaaactgtgagagtaaaactgaaatcatgcctactttgagatacactggcaatttgcattaactatttgtcttattttaagtcagtttgggttagggaaagctggccattgatgtgaaagtaagaccccaaattttcaaatacgggtgtacctatgaagtgaatttgaaatcatgaccaccttaaaaccactgtttagagagatgtagtataataattttcccactgccattgatacgtaattgtttggtagaacagcagtactcccagtaaatttagtaacttaggagtttacttttagaaggtaaatgtgtacttgatattttaaaatttattgatatcagaaaaagctgattacttgattatttataaaagtttttttttcttttttctgggttttttttttttttttttttttttttttttttttttttttgagatggagtctcgctttgtcgcccaagctggagtgcagtggggcgatctctgctcactgcaacttccgcctccctgattcaagcgtttctcctgcctcagcctcccgagtagctgggattataggcgcgtgctaccacgcctggctgctttttgtgtttttagtagagatggggtttctccatgttggctaggattacctgatctcaggtaatccacccgccttggcctcccaaagtgctgggattacaggtgtgagccaccacgcctggtcagattatttatcaaagttaaataacccagtgtattaaaactattttcattgctgataacagaaatttaccctctactagcttaggcaaaaaagcttgctgtcagaattccctttttctttccccacctctgctctctgcttccacttctgttttctctctaatgtaaaatggccaccaatacctccaggctcacaatctgttaactcatcaatcccagtggagagagagcttcctacagaagtatcagtatttagtctccctgtcaaaggaacggacatatctctgggaccagtttctgtagctgggaaagagatatatttattggcttggataacagcccacctctactccctaaagccacaccagaaatacaggttgagtatcccttatctgaaatgcttgggaccagagcattttggatttcatttttttcattttttggaatatttacactatacttactggttgagcatcccaaatctgaaaatctgacgtctgaagtgctccagtgagcattatctttgagtgtcatgtaaatgctcaagaagtttcagatttttgagcatttttagatttcagatttttggatttgagacactcagcttgtatatgatttgaaacaggatgaatagactcccaaaagacatttgagatattcttacccaaagagtggtaagctagttcaaaagtctagtacatcgactgtttctcagagataccagtttcatttcagcatcttagtcctatattatgttcagcacaattaagccacagtgtaagaagtaagactatatggaaatgaggggttatttttaaaactgttttactagaatttcatacatcaaattagtgtcctttttaaaataatcacgttggtgggaagaatttgttccaacttggtgttctctcaaaatatttttaaaacctttgtgttgttgttgcctgaagagttcacagcatattcttttaagtattgccaatattagcataatttgatgttaggtttaatttttggaaagaccaaactccatttaaagtcacacaaagatgatacgtagtcacattgagaaatgtcatacttgatctctaaaagtaagggctgtgaagtgttaatttttctgagatagtgtatgaatagtttagagtctgaatttgcatgttaaagaagcattcttctattttcccagctacactgtttaaatggatagcctccaaaaatgaaattagttgctcagattgtcccagtttgactgttagtgtatgtccttcaagttgagttcctttgaaatgctcccatcagtttttgaacccttccttcctggtaccagaaggtgttccagaagaagctactttccctgcctcagctctggcattaattattttacgccagttccttttattgaagaatagtatttacgaacaaagatctgcttattaggcgtgctcgtaactcctgaggtatcattgcttctaggcagcccaagctggcagagccaggaaatgggtggatgtgtgcacgtgtacacacacacacacacacacacacacccctgcatctatatatgaaaatcatgagggcacacgggttcctccaattcccatccaccatcgcaggcttctttccccctccttatttataatttttttctctttcaacaggaaacatggttctgattatcgtcagtatatctgcttagttactcaatcctaggaaacacaaaatagtttcagaattgctaactcaaatctctgtgaatgtattaactactgcacaatgtttgtttggagtaacatatcaaatatgtctttagacttataatacaagtcaaaatactgtttccaaggtaaggttagttccattcttcctcacttcagtgtggttatgttattcatacataggaggtttttttgtttgtttttgttttgttttgtttgtttttctttttgagagagtttcgcttttgttgcccaggctggagtgcaatggcgtgatctcggctcactgcaacctccgcctcctgggttcaagcgattctcctgcctcagcctcccgagtagctgggattacaggcgggcgccaccatgcccagccgattttgtatttttggtagaggcggggtttcaccatgttggtcaggttggtctcgaactcttgacctcaggtgacctgcccaccttggtctcccaaagtactgggattacaagcatgagccactgcacccggcccatacataggagttttataacaagcattttgacaaaatatgttgataaggtttggatgtcccctccaagtctcatgttgaaatgtgaactccagtgttagaggtgagcctggtgggaggtgtttggatcatgggggcagatccctcatggatggcttagcaccatccacttggggatgaatgagtttttgctgagttgacaagatccaattgttttaaaagtgtgtggcacctttgtgtggcacccccagtctcttgcacctgctctcactatgtgacgtgtctgcccccacttcgcctttcaccgtgagtaaaggtttcctgagtcctccccagaaaccaagcagatgccaacgccgtgcttgtacagcctgcagaaccatgagccagttaaacctcttttctttataaattgcccagccttgtgtatttctttatagcaaacacaaaaatggcccaacgcatatgtctacctgaatttttttttgacatgatattacttatcccatcgtttcacctggttcttgggaaaatggaaccgccatcatcagtgaccaatcacagcactgattgtcacctgttacttacgtagtgatctgtgggcagaagagctgtcggtgaagttgtacttgatgcagttgctcacagctcacatactgaggttcctgaaacttgtgtgtatctgaaccgtgtgaggtgaggcctgcctgtgccataacttggaaagtgtgcaaatgtttgacaataatatttcccccattttaaatttgaaaaataattttaaaatttttatatgttgtaaaaatagatggtgaaacactttctttcaattcctggttgtccatctctccctctgccagctccatttggcttcttaggggttgggtaggggcaagtagcagtgtttctcagaggctgtagttctaggaacctcaaaactatgctaagtttgacttgagaactcagagttctggtttagtttaacttgaaggaaagactccttgaacattaagtcatactttgtttctcccatagattgatatagaaatcaacggcagtgcagtggatcttcacatgaagttgggtgataacggagaagctttctttgttgaggagactgaagaagaatatgtaagtttgcatgggttacaccctccttacacagtgtgctcaggcctctggtacgtggcccagacggaccgtttagcagttttttatggttgattgtacagaggactgttgttggcaagacaagctttagtttcatgttgaagaactaagctgtcaaaaaggaactgaagggatgaggaatttttctccatacaaagtttcagggtgcagggagcatgctgaatgcacatacttgcactttttctaagggaaggcacatcactttctagctttaatgagctttcttacttagtgttgcttctggttcacatattgacttgaatacattcagttctgcctgagtagggcatttctcttctggctatgtgtttatccacatgtgccctttggactgggactcatgtttaccattttggttgggatattacatccctcaccttgagtagtcaggtgaattaatttattatgatctcaagagagttaaattaattggcctatatccttttataagtgattacatgtttgacttcttctagcaaacgagcatgatttgttaaaatcccccctccccagcacacacattctgtatgtactgatttgaacgctagttaacgacggattcttgatggattcaatgtggatctttttatttatttatttattaataatagattttacattctcactaaagaactcagatcacgtaatgtgaatctttttaaaaattctttcaaaggcatcagtacatcattcttcataaagaataaagtctcaaatagcaaaactgataagcatcaagttattaaggatacaggactacttttttggctttgaagatgaacttacagtttgatacaataaatttacaaagaaaattattaccaaaaaatacgatagcaaaatgagattgtttatcattttttgattgagaaaccaacaacttaggtaccagtaggtaaagcagcattgaaacactatgatttatgaaggggaagcttgatcagactggtgctttttctagtttcttcattacttatctttgtaataccttgtttgcatttacttggcctaagcaacatttttccttatcagagacagaggcaaagagcagaatgaaacataataaatgacatctgtcaaaaaaaaaaaccactttttgtatgtttcttaaaattatttataattcataacactgaacttctagatcagcaggcaccgtaagcgagaggactgggttattgatgttaacctcgttttcatggcttattctgacagttccgctaaaaattatgctcagcaaggacaacttggaaaatgtcaactttccagcctttttctccctattccacatatgactacattgaccagagtttatcttgtgtagtatgcttctccttaaaataaaaaattgttaatttatccaacaaatgttggaattactactctatgccacatgctatgaatacaacatgcctctgttcctctaggggttcgtcatttagagtaggataaaaatgaccaaaaacccagtttgttgccatttatttgctttttttctctcagatttttctcatttaattatatgtcatcaacattcttttcaagtctagttctaaacctaactctgtgcttttaatagctgcacagtattccatagtatggacataccatagtttgtttaaccattttcttgctggtaggcattcaggttatcttcatcctacaaacattgctataatagaactaagaaataccaccagaaacaaaaagagctttcagtaagtaaaataaagatcattgaattaaaaatcctcaaagtcagagaccacgacctctcatctgggtttcttttggacattcagaatatcttattacaatttctctgtaagtgtgtgtttctggtgaacacagatttctcctagctaaatcaaactttagcttcagggtaatatgtttatcaaagctaagttcaaaagcttaataaaaaaataattacagaaacctatacattttcagaactattgtttaaaagcttgagtattttaaattatatgaggttaatttttttgttgtttgttttgagatggagtctcgctctgttgcccaggctggagtgcagtggcatgatctcggctcactacaacctccccctcaggtccaagcaattcttctgcctcagcctcctgagtagctgggattacaggcatgcatcaccaggcccagctaattttgtatttttagtagagacagggtttcaccatgttagccaggctggtctcaaactcctgacctcaggtgatccgcctgcctctgcctcccaaagtgctgggattgcaggcgtgagccaccacgttctgcctgaagttaatttttatctctattatgtaccttccatttcctctgatgatacaaaaaggaatgaaacaaatggctaagacatgaatttactgaacaccagacttgatcgtttatttagtattaggagtttgactgcttctaaatattgggccttattttcttcttttgaattcctacaggaaggaatatttcttatttttaaacataaatgctttatggtttaaaaatttactaatgtcatttgttacacggtattgtctctaattgcctttctccaattaatttggcaaaacataagcattggccgctctgtatcactgcatcctcgcgtcactcacctgtcctgctgccctttgtctgatgtagtgtccttaatctctgccttctgctttttcctgttctgaatgttctgtgtgagttcttgagagagtcctttgtaacacctcctgagatttttgttgctgctttgatctttgctttgtgaagaatttaataggcttagctttaattatggctttggggtgttccatgctgacttggcatgtcagttccttcagatggactcagttacatgtacccaagtgggctggtacttagctgcctcacaggggaaagacctcgtcagagtatagtaggcagtgccttagttcagtgggactttcttgcctttagggaatatgtattttttttttttaccatggtgaaaatttatatattcaaaatattactgctttaattcactgtcgagtttgtcatggataacttttctttctccattctcctcaaggaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacggtaggactctcagcctgggaagggtcttgtgcgggtacctagagttcatgtgaagccaggagctgccagtttttttatggatacacagtgtgaggtttgggcttgttttccccctttacagtttattgtggaatcaagcagcaaaggcagtttctttgttcctttcaactattctataaatatgctactgaaatgtcatttgtagcagactggttgtgtttcttttcataaagaagtttccaggagccaaataagttctaagtcaaaagatctgaattagtgatttgcccctcggtgagcagatccagttggacaccatgtcatctctgggatttccctacccagtggccttaggcttggtatgtttttcctgaggagttgagttttgttttattggaattgaaaaggaatgatttttatttttttacatgagcagtcttgatcgctgcttatttacctgctctgtagaagagctcattatatgccatttttcatgtcagcaccgcttggggttgaaaggtagcagttgggagtagaacacgttttcttattcaagattccgttttcttccacctgttgcactcagtggccaccttggcactaggaccgtggtggggattctctttattggtgacgactggacaagaagctgctgcccatgagtggccctgcatttccagactctttatttgtggcgggagctgctggtccacttgtgtgttttcaccccatctgtcgaaaagaggtcacaccctacttcctggaaaacagtgatgttcaagtgtttttcatcctagaatagagggaaataatttctttcactagctatggaaaccaaatatatatcaagagtaaaccctagctcaatctggtatgtgttttatttgccaatcttttgttttaaatggtcaaaccaggaaaaaaatatgctttgttttgttttgttttttaattgagacaggttctccctgtgttgcccaggctggagtgcagtggtgcaatcatagctcactgtaacattgaactcccgaactcaagcagtcctcccacctcagcctcccaagtagctaggactgtatgtgcttacccctacacccagctagtttttaaaaattttctgtagagttgaggtcttgctatgttgcccaggctggtctcaaattcctggcctcaagcaactctcccgcctcagcctcccaaagtgctaagattacaggcatgaaccactgagcccagcaaaaagtgttaattaatgtagtattagtatattataattatactgcattaatgaataacatagtataatccttttttgtaaaacaattcattttctaaaattttgaaatctagattttaaatcttagaattaaacatctatatttgatagtaattttttacaattcgatattataagtaacatagccatttttaatacatgaaatttttttctactcctcttgttttattgctcactagctgtcatgtctgtggtgttctgtcttactcctcccacgctgaatatgtaacactttgatttcagttctgatagaatgcagaatttctccaatagaactaaacaacaaaagatggaaagcaatagtggaaaagtatgttaagctctacaaaccagagtacactatatttacaaaattttaaaatcctgaatgaatcaataaatttaggtaattttttttgtcagtgtcaaaatactagctgagaagagtttcatcataaatgttctgaactctacttttaaatatcattgattcccaaagaaatttaagctgataaaaagtaccagaatttcttaaaaagagactcttcctgtccttttccttccttcattcagtcttttaaaggttatttgtccttctcttcactaggagaataaagtatgagaatttttacttttctactgcttgacttcaggaatattaaaaacattattaaaaggccgggcacggtagcccatgcctgtaatcccagcactttgggaggccaaggcgggaggatcacctgaggtcaggagttggagaccagcctggccaacatggtgaaactccatctctactaaaaatacagaaattagctgggtgtggtggcaggctaattactcaggaggctgaggcaggagaatcacttgaacctgggaggcggaggttacagtgagccaagatcacaccactgccctccagcccaggtgacagagcaagactctgtctttaaaaaaaaaaaaaaaattataaacaatttcctttaaaagttttgtcttatgcatactaaaatgtgtaggtgggcaagaaacgtattcttttgagaaaaacttgaaatgcttacacatcttaagttttattaggatcagccttgtaatgctcccagaagtgcttcgttcctgaaaatatttttaccaactaaaattcctccaagatctaccaaaaagagcactgaagtaatgcttttgtcttagaattttgttgacctgtgtcctttgtcagacataatagagcaacatttagaattcctgaacaacctacagcttgggaaattaaaacaatttctaaaacatatgccaagttccctactaaattgtacaagaatcattattctaaaggaatttgcaaacgaatgttgtaagccaattgcagaaatattagtacataccttgtttttcctgatggtgtgaaaggctgtatccactgtgtactgatgtgtttgacaggtatgaatggctgccagcctatctctaagccagcagcttgctggcttggtaagcaggcatgtcacaacacacgtaagctagggccttgcagtcgttttcaggaggttggtgttttgctttttctttaggttaccatggaataattgatgctgccacctggaggagctcttccatgaaatttccttaaaatagaatctgcttaaataatatagccaacagaaattaggactttaaaaaaagaaaacaaaatgtaaacatctgtgaaaattcaggttgttttctgaaataagcactgagctaaaaggtagacagactgggcccattatagattgtagaacagtagcctcttcatcgctcagggcgttggtttcttaatctataaagtgagagggtcgaaggggcctttaaaaggcccctttcagctcagcacctagactctgacattatttgagggaagctatttacggtcattaacagcatatgaaacaacgtgttcaaaatctaagagaaaaagaaaaggaaatcaattgcttttgcagttgtgaggactaggaattacgtggcgttgcggaatttgcagctttcctatagcatattctcctcagctcctaccacttagaaaagaaattatttttccagagaagataaatgcataaaataggtttctgttttgttttgacaaatggcatttcgtttaaattctttacttttcaagaattttgttgataatagaattaaggttaattgaggctccttgaaggaggcagatggaagagggaatcattctttaaagcagattgctatagcacagctggaagaaactcatttctggaaatcggagagctttaaactatacacggctttaaaaaactgtacctagtaagtctccctcccttcctaaagatgggcgttgggcttaaatataacatagaagccttgtttgtccttctagaggatggatggatgtctttgtgtgagagagagattaaaaacattgcacctaggcatatgtagcctttggagggaagagactctgcatattggatggtgttctagcataatcttgagtgcaaatatatgaaacatgccaccgatggaaatatttcaaatacccagcaatagcaaaaatggaggctcaatatcacaccatcagaaaggagtctcaacttttaatccactaaagcagacttacttaaaagtgatatctgggagctaaatccagggagcctaagacttttcacagatagcacctactgctctgatgatctgcatacttcatctcctgatcggtaattggcttctagagaaccctccatgttcttctggggtgagtgtagacactcagggtgacatggatcttacagatgctccctgccttttctctccttcgtttctgacacagaacacagagagaagtattgcagggctccatatgtcttacgggaaatgctctgtatccaaatgccagctgagatcattagccacgctgaaattcgttgtctcgtactgtgctaaggttgctgctagacgttgttaacagagttagtggtctttggttatggtggttagcagccccacttatctgttccatactaccagtgaatagtttaaaattcatgttgcacctataatttatcccacataaataattcaggctatttattttggcattcaattgatttttttctcactttaaaaaactgaggtatggagactggtgctagcaacacgggattggctaacgcatcctcttgctgttcccggtgtttgggccttgcctgtgacagtgggaaaaaaaatggccttgctgtgctacaaccggagctgcggtcagcgcttcgatcctgagaccaattccgacgatgcttgcacatatcacccaggcgttccagtctttcacgatgcattaaagggttggtcttgctgtaagagaagaacaactgatttttctgatttcttaagcattgtaggctgtacaaaaggtagacataatagtgagaagccacctgagccagtcaaacctgaggtcaagactactgagaagaaggaactatctgaattaaaaccaaaatttcaggaacacattcaagcccctaagacagtagacgcgataaaaagaccaagcccagatgaaccaatgacaaatttggaattaaaaatatctgcctccctaaaacaagcacttgataaacttaaactgtcatcagggaatgaagaaaataagaaaagaagacaatgatgaaattaagattgggacctcatgtaagaatggagggtgttcaaagacatatcggggtctagagagtctagaagaagtctgtgtatatcattctggagtacctattttccatgaggggacgaaatactggagctgttgtagaagaaaaacttctgattttaatacattcttagaccaagagggctgtacaaaagagaaacatgtggactaaaaaagatgctgggaaaaaagttgttccatgtagacatgactggcatcagactggaggtgaagttaccatttcagtataggctaaaaattcacttccagaacttagtcgagtagaagcaaatagcacattgttagatgcgcatattgtatttgaaggagagaaggaatttgatcaaaatgtgaaattatggggtgtgattgatgtaaagcgaagttattaactatgactgcaacaaagattgaaatcactatgagaaaagctgaaccgatgcagtgggcaagccttgaactgcctgcagctaaaaagcaggaaaaacaaaaagacgacacagcagattgagtgggagatgggaggaaggctattacgtatttcagaatttttaatactgtgtgaagtggtggcttgctgctgtcatcttttgttttgttgttgtgttactgaatgtggcatttcagggttaacattaggttcttaaaagccaaagtcagtttatctttttgtgcctctcatctttctttcgtgttatgtaagattgattattcgtttctccctactggtaggaaccatagttgtgtcctgtacttgaagaggctgaaaaatagcccataaccataattgcagtatttctttgtatttctctgttaagcaaagaaatattaaggaactttttttatgtctttgtattattccataattagtaaagctaattgtgaatgtccaattttaatgaaatgtccaattttaatcagtttttttcatggatttgtgttcttacggtacttgaaaatatttaaggaagagatgaagctctgcagttttttctatgtgggatgattgcttttttaaggaggattaattctgaggtagtatagtaagtaaaggggaatatatgaattgttaacaaattaggatttgtttacaactacttgaatttttaaattatgtcaaaacttacattacttgccaagcagtatgatgtaagagtataggaaacataaataagaatacagaggtatcaatttgattaaaattcaccattttataagactaagcaataatcttaaaaacctctttcctgaatatttaaatgtgtttgtatggtgttatgactaattgttactgatttacagactaagccctcttaaaacctttagttaaatataaaaagaaattatatatatcttgcctccctgatggaaaactatgtaaaattgtagacttaaaaggtttgtggaggccgggcgcggtggctcatgcctgtaatcccagcactttgggaggccgaggcgggcagatcacgaggtcaggagatcgagaccatcctggttaacacggtgaaaccccgtctctactagaaatacaaaaattagctgggcgtagtggtgggtgcctgtagtcccagctactcaggaggctgaggcaggagaatggcgtgaacctaagaggcggagctggcagtgagctgagattgcgccactgcactccagcctgggcgacagagccagactccgactcaaaaaaaaaaaaaaaaaaaaaaaaaaaaaaaaaaagttggggggaaaaatttatgtttttccaaaaaccnnnnnnnnnnnnnnnnnnnngtttgtggaggccgggcgcggtggctcatgcctgtaatcccagcactttgggaggccgaggcgggcagatcacgaggtcaggagatcgagaccatcctggctaacacggtgaaaccccgtctctactagaaatacaaaaattagctgggcgtagtggtgggtgcctgtagtcccagctactcaggaggttgaggcaggagaatggcgtgaacctaaaaggcggagctggcagtgagctgagattgcgcccctgcactccagcctgggcgacagagccagactccgactcaaaaaaaaaaaaaaaaaaaaaaaaaaaaaaaaaaaaagtttgtggaaatacattaggatatcagaaaactaaatatatggagttgctttatgactattacatgttaaataaaatagcttgttttggagtttttttttttaaagtcatgaagagcttcacaattctagtgatacagtgttgattatatattgtgctttatttattttaaatataggtaacacagaattagatcgtttggataggttttgatgcagtgcagagcttaagaagaaaaattaggaaatattctgaaggccagaactctggaagaacttagaaagtttgggaataaattaaacttacatagatttaaaattaaaaggggtttatttcccaaaccccttgagtcttttcttttccttggcatttgcggaattcttacaaagaaaaatttacagaagtactattttcgttaataaagcatatatatcattctactaccattagcaaataacttagttgtagttaatataattgttaaaaggtttagctctgttacaaataaaaacaaaaagatctggcaaccagactcatgatgttacactaccatgacaagaaactctgggcagtgaaagttggacccacatggagtacataaacatctgatactgggagatgtatttaaaatttttcaagttatattccatgatttaggaaccatttagagacatgaagtctttatgggttgggggaaaggttgatacttagtttgattaaaggtaatgattaatatgcctttttgttaatacttctttctgaggctgtcttcccctaaacagtatcttaatctgttaaatgtaattgaaatattatttgaagcagtgagttattgtaacctcagattagttacattgatcaaaacattgatttatacacacacacacacacacacacacacacacgcagcttttatatttagtctggttacattagtgaccatggtatttcctttcttacttcttaaggagcctttgaatttcttgtccagataaaaatctgaataatatttatcttagactcatacataaagggacacagttaccgttaggtagcatatgttttactatcggtttgtcaaaaaagttaataaaaaatgcttattgatttgtttctctaaaaaacaaaacaaaacaaaaaaaaaactgaggtataatttacatacagcaatattcacagaccgtaagtgtgcagttcagtgcattttggcagtcatatacatccatgtaacctccgttagcttttgaattggaaaaatgttaggcttagaaaatgatgcggaatttgaaagatgtgatgttgtagcacatctgtgagggctggagtgccctgttcacactggctgtgaacctcagcctccgagcccccagccctgactgaaagtcaccgtttacatcttttgctcagttctgatgtattagcaaaacagaatcagtgcttgtgctgttttcttcacattctactgtgtacgctccactatagcctcacgtcacgtgcttagtttgttactctgtcatggtttgccttgcaggtccctgttctaaggcatacctgccattttgaaagttcctaaaaggtttctggaatttctattttaataaaggaatcttaggactgaaagggatctcagcataaatcttttctgtcactgtagtgggcctagactaatgggctgtatttttgtcaggatatgaccaaaaaaggccacctcttgtcttcctggggctgtgaattcaggtggtacctgatcgctttttcaatattttactaaatcctgtttgctttgctgaattcttcttggcttaccttttatactgcagtgaaatatgtcccaaaagtaaaatatttgtaatataaaaattccggttagaaatttgtgtgacttttacattgttcttttcagaccactttcacgtatggatagtgatgggtcaagctgatgtgtcctttcagagtgggcaaataaagaccattcacaaacctgattttccctttctcaggggaaaatttgccttttgatattcctttattgagaaatagagtactttttcctagatgtctttctcaggtatatgttttctccccttcaatgagtggtatgccagagtaaggccctagagaaagaagaccagagttaggaaaaccttaaattaaaagattaagctatgtggaaaaactattacatgtcagagttagtggtaaataagagtatgttaagttaagatataaaggaagaagagtaatattaaaaaagaacctggttttctatccctgtgtttagtccagcaaactaagtgatgtggatattctcatttacatttattatctgtcctattagaacattgaattttctataagaagcctttaaacttgtataatatggcgctttatgctttgcagagttttgtttgtttttgggatggagtctctctctgtcacctaggctggagtgcagtggtgcgatctccgctcactgcaacctctgcctcctgggttcaagcagttctctgccttagcctcccaagtagctgggattacaggtgcccgccaccacacccggctaatttttgtatttttagtagagacagggtttcaccatcttggccaggctggtcttgaacccctgacctcgtgatccacccgcctcggccttccgaagtgctgggatgacaggcatgagccactgtacctggccagagtctttctttgtgcttttctttttacttttcagagatttcaacatgctacaccatgtaactctcacattgactctgaagtagacaggacaaatgataaatttccaagtaaagatgaaaacgggggcccacagtgcttctgagggatgttttcaaggttatatggcaaggtagttatagtaactgaaaatctgagaaaccaacaagtaaattgattaaaatcttatcagcagtagtgtaaccccctacccaaggtccttttatgaatcttaaaagcatttgtcatttttggtatcatcttcacatctccacatcttgtagattccaagtaaaggaaaccttctcagataatccttgggccaaacaaagaagaaaattagtcccaaggttttaagaggttagggtattgttaaaattttgagccatagatcttgtttgtcttcagctaatatacattttcaaatgtattcagtagaaaggggagagcagtggaaagaataagggcttacttgttttgaatccaactacttcctatctttttgactttgagcaagttactaaatttctctggatccttgattacttaaaatctacaatgaaatattacctcattttgtaaggattgaatgaaatagacataaagccttagttttcttttagcctttgaatcacccttaagggatggaaaaaagagaaatcacatttctcttttgtcctccccctatttattccatatgtgaatagtgattgtggtgttttatagtgggtggcattggtgtatccccccttctccttcatatattttagagagagttagtaatcatttgcccctcttcattttgattgtttgtagtatcagtaggtttgggggatattttaaagctgacaagaatgtcatcgttcctgcctttctttggtttctccttcacagaggatcttcaaatgcttccttgaaagaagaagaatgtaaagagcctttgctcttccattctggggatcattaccccttatctgatggagattggtcccctttagagacgtaagtatctttgaaatttcttggtttcttgaaagaggaaggagatgtattaattagcttttctgttaatctgtagtaatgatatttcccatttctctcacacagccaaggaactgaatgtttacttgtaacataaatatgaatcttttctctcaataattattttgtttctaaatttgatctgacttactctaacagtgttggccagttgtagatctgtataatcagcatggaatttagccatctacagttattttttttctttttctttttagtagagacaaggtctcgctctgttttcccagcctggagtgcagtggcacactcatagctcactgcagccttaaacccctgggctcgagtgatcctcccacctcagcctcctgagtgactgggactacaggcacgcaccactgtgctcagctaagttttaaattttttgtagagacagagtctcgctattttgcccaggctattcttgaactcctggcctcaggtgatcctctcgccttggcctcccaaagcactgggattacagacatgagacattgtgcccactcatctgcaattcttaaaaattctcatcttttagtgtcaactgttggctgtaaatgaataatatagtgaaaaaaagtatagtcataactgtttattctgcaatcagattctcaggtgttatgttaatttgcctgcttttcctttcctacaaaattatcttctttctcattgatttcttgtgaaaagcaaatgagattatgaatctacagtgtttgtttacaaaggacctggtaagtcctcttaaatactagttggtgtcatttttattattattattaaagaactcaagtggaagaaataattgatgctcccttccatagagtttttatatatgcaggataaagtcaagatattcagatttgtttcttttaatctgtcaggctcagcaagactgaaggtttcccgactttcaagtcatcgtgtgtctttgttctctttgcagcacctatccccagacagcgtgtcctaagagtgattcagagctggaggtgaaacctgcggagagcctgctcagatcagagtctcacatggagtggacgtggggcggattcccagagtccaccaaggtactagggtttacttgcctgtggaaagtgtgttaatgattaaacaagtgacgaattcctctgcccataagtaaaggaggcaatttctgactgagctctcatgaatgtaaatgatagtgccctcatgtcataaaagtaaattcaaagttaacattttttgtaacatttggactatatatttgcaaccgaaggatttcagtagtattttgtgtatatttctatttactgaataataatgattgttaattattataaggacattttaaaaggcatcttaaactgaaattttcacactgaatttttattttttattttttggagacagagttcttgctctgtcacccatgctggagagcagtggtgcagccacaactcactgcagccttaacctcctgtgctcaggtaattctcccacaccagactttcaagtagctgagactgcaggtgtgtgctaccacacccagttaattttttagtttttattttttgtagagacaaggtctcgctatatcagcttggcctgatcgcaaactcctgggctcaagagatcctcctgccttggcctcccagagtgctgggattacaggcgtgagctgccatccccagccaacactgaaattttaaacaagaaattgttaaacctttttttccagctcataatgaaagaagaaagaactgagaagataaatttcttgagagagaaaatgtttagatcttctgttgaatttaggtttttaaaatatacattttgcatatatttgtgatcgaatttagacttgccacttttacactgttttaacagagccttgatgtggtccaaggagggtgaaattttcatttagttttctcccccaaaatgagtattttctacttcttagtaactgaaaattgtcagtttcctcagtcttctccagtataacttcacagtagaacatttaacatacacctttttttttgagataaagtcttgctctgtcacctaggctggaatgcagtggtgccatctcggctcactgcaacctccatctcctgggttcaagaaattatcttgcctcagcctcccgagtagctgagattacaggcgcctgccaccatgcccggctaatttttgtatttttagtagagacagggtttcatcctgttggccaggctaatctcgaactcctgacctcaagtgatctgcccaccttggcctcccaaagtgctgggattataggcgtgagccactgtgcccggccagaacatttataagtatcatgatattgaacaaaaggcaattattagtttttctcactttattatggaatttttacatgtacaaactaagatacttaatgaatgtgttaagttaaaaatagaatgaacacattgccagcttaggaaatagattataacaaatactctgaaagtagtttaatttttaaacaatttaacttttttaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtaatcgtttgtttaatttggctccaggtactctcaaattagatggtaaattatttcagtgttccacataacgtgatggctgcctctgtatttgtattcaccagtcgaaacccgtcgcacttttttttttttttttttttttttttagctggagtttcgctcttgttacccaggctggagtgcaattgtgtgatctcggctaactgcaacttccgcctcccgggttcaagcaattctcctgcctcagccttctgagtagctggggttacaggcacacaccaccatccccggctgattttttgtatttttaatagagatggcatttcaccatgttggccaggctggtctcaaactcctgacctcaggtgatctgcccacctcggcctcccaaagtgctgggattacaggtgtgagccaccgtgcccaggcccgtcactcactttcttacaattgctttccatggcgtccccctggaaagtccagttggagcagggcctgacttgcacactgctgtctcttgactgttgctactcagtgggttcttgagaagcatttactgagaaaacaaataatgagttgtaatcaattgatgagtaaaattaaccactttattgataaggtatgtcagtaaagtgaagtagaatcttaaaaaattagaatagagaaaaaatgttttcacttgaaacatcttagctgaggctaaattaggtaggttttttagcagtaatatcagataaaaatcaatgcatactaattatgattatgagtatgtgctttcttttgctgattatttccctctaaaataggtagaaggctaggtgcagtggctcacacctgtaatcccagtacttaggaagctgaggtggacagatcacttgagctcaggatttcgagatcagcctgggcaacatagtgaaaccctgtctctatcaaacataaaaaactgagcctggcatggtggcgttcatctgtggtcccagctacttgggaggctgaggtgggaagatcgcttgagccctggggcagaggttgcaatgagccaagatgaagccactccattccagcctgggtgatagagtgagaccctgtctcaaaaataataagaaaaaataaaaattaccttaagaagttattctaatcacctgagcccagggaggtcacgactgcagtgagctgtgattgcaccactgcactctaacccatgtgacagagtgagaccctgtctcaaaataagtagagaaaacatccaactcttggttcaacagttcttcctcacttttggaacacaagtttaataaatcagaacatccttactatttgaaaataaaaagccaaccatcgatacttggtacagtgggtcagaacatacatattctgaactctggccttggatcctatttttaggaaagtgtgaaaccttctctaaaattacccaacatcatatatagccaattacctatttcaattaaaaaaaaattctagcaccaaagattaggtaattataaaccaacttaatatatattaggtatggaccttcaagttcactcagaaataatttatctaaaatgaaagaatgtgactgtcgaaggtgttggtggtcagataaaaccatctagcgaatggtggcttaacttggcacctgctcttccaccgaaggcctgtagccacttgttatgctctaagaaatgttaaggggggaaatccagttcttttaggatgaatgctttgtttttggaactaatgactcctgttcttagcacacagtgcaggatctgactagagacaggaaccctgagtggtttttactattcttttggcctcattctttttcccctctactttttattatacatttttgccctccctctctcctcaacccctctctccctacatctctccattcatccacatacagtgttttattaataaaacatttgaaaacaaattgcaggcatgacatttcactcttagatatgccaggatataccttctaagaatgtgaacattctctgcatagccccagtactattgtcatcttgaagaattcatgtttacatttccctaattgtaccaagaatatttttttagctggcctgtttcccaagccaaaattgcatcaggtttcacatgttgcatttgatttttatgtttcttgtaatcttttttattttagaactctctctcctacacccatccacaccctcatgccctctctacacccgtgatagtaaccttttaaagagctcagccagtgtcttctaggctctctcacgttctggatttgtctgattgtttttttgaaggtgacattcctatattttcttaactgggagttagctctagaacttactgtccactagaaatggaatatgaatcacatgtgtaattttgaatcatctcattgccacttttaaggaagtaaaataaggtgaaattaagtttagtgatatatttcatctaagccaataaatccaaaatataattttaatatgtaatcaatataaaattattaaggaagtatcttagtgtgttttacgcatttttaacattttgtgtacctcactttagcaacagtttaaatgctcagtagccacatgtggctggtggtcactagagtgggcagtacaggtctagaggcttagagttattgtttgaattgaagattagtttattgcatgtattgggtactcatattgtatctcatgatgaccactaatagtaatgctgaacgtgattattgtttaagatgttatctgccacatctatccattgtgaagtattttttgtccttttgtagttagaaggtaatgcagggtggatacttgggcaccatgtgaatatcctgtgcccagacaaccttgccttcatggttttagagtaatgccctcgttcccaatgcaggtggttgccttaagtttggtcatgcttgttcttagacctataaatacaaaaaagacttcaccattaaaatataaattatttaggggctagtattactcaattaacagcaaatgagagaatgagtaaaatcaaagtatatgtatggagcactgaacttctcttctattggcatggatggctgggaaccaacctaagtaaaaaggctggttgacacctttaaaattaaaaccctattcaaatcctgcttgtcactcttactgtttgcaaacgtgcgtgtgttttgcagagctgtaaatgaagaataactaaattcttacctctgattttttttttaaacaggtgttcacaaaagaagccaacaccagggacctgatgatatttaccttgatgacttaaagggtctagaacctgaagttgcagctctttatttccctaaaaggtagagtggtccttatttattgaaggacagctctgaaatagtctagttatttctagagtaaaacatttcatctcaggaaaaaggaacaagatgatggtgtcctttagctaaatctgatgatggcttcaggttttggaaaatttagaaatagcgcgtgtcttatttcaatatagtgacttgaaattaataattacttacgaagacattttcaatacaatgaggagagatatactagttaaacctacataagggtatatgacttctgattagcatttcctgtagtggttaatacaaactcaacatgcttgggaaaattttttagcatttattttattatgtgttttaaaagaaacacatctttatttgaaaatgttttccaaagaatgtgttcacttcttgggagtctgagatcctgagccttttctgaaccgggtctgggtctggtggggcactgcccccgcgccccgtgtccccacatcccctgcagctccacagctgccacccagcctccctcactgtcccgcaccattttccctttgaattacttcaaatatgggcctcaaatatgatacacttggactgccttcccaagttcatttctactcttaggggaattctgttaaactgctactctgtggttacaaaaaaacaacttttctccacggaaagtatgacttgaatatactgagccataggcacacataattaaacacttgtaaatgaattactgaaaagtatattttgttttttatttggaatagaaagatgggattgatataaagctatttaaattttttacaggtattttgggaaagttcttaaaactcctttctagctctgtcctaaatttatctcaacatatctacttcatttgaagtaatagttggatttttttaaggtgaaaaaactgaaacggctttattttaacagtaggaaagttcaaatataagctgtcatagaattaccacttttccccccacatttcccaggccttaatcatttatttatattggtattccttcggtatatgtcttagtttctcttttaaaaagtgaggagagtaactaaggtgatgataccttactccactctactgtaatttaactgttcacagtcactgtccatgcactaagtaagcttcttacctcattaactatttcttgaaacatttcataaatatttaaagatagtgagtgagactcttgtaatccatgtaagcattagtcatgtcatgatccttagcatcttcattaccaaatttacagtatttgtaattatcactaaactttaatataaatcacacacttttgtatttggtggcatcctgagtcagacggcatccccatgtgtgtagatgttgttgttactggttggggtaacactagctgctgtagaggtggaactcctgatctcgttggcctaccacgatggaattttgtttcttgcccctgtgaagaatgctctgtgttggtgtttagggggaggccttgcccacagggattcaggaacacaggctcctttcaccttgaggctctcccatccccatagggtctcagagtccagagtttactggcagcagagaaaggaatgagcatcgcataggagagggcccctggggaggggcaccatgtatgccttccgtccatattcacggctcagtcatgtgctcacgtggccccacctgactgcaagggggcctcgccgtgtgccccggagaaagaggagacaggtgtggtgaacacagaagggttggccttgcccctcactcccagtataacaacagttctgctgactttgtgtttccagtgagaacattctgtcagtccagttaatctcaattttgtgggtatgagtgtgcatggctattaagaggaaaaaatatccaaaaacctgaatttttttgttgattcaaatgggaaacaggttttgaaactgttacctagttaaaacataatctgtagtctgctgccacctactgctcaaagatgagatttgtttgaaagagccagtaaacctctgggtcactgtttttttaattcacataaaaatactggctttttgaataaaataagtgaatttgaaaattctcaatatctcaaatgtgacattaaatacctattcaaagggtatagagtagtaagcattggggactgtgagacttaaggtgctgtgccattcatgattattctttctcaaatttacacttcattgcataaggtttcccttgatcaccttctgaaacctggcttctgtgccttatcttgaaaaatgaaaatattcagtaacctcatctttagctcctggaataacagttacatccagtttatttctgaatacatttctttttctaggtgggtcttgcctctagagaatttgctcgtttaatttctccttccttctttgtgaggtaataggcgaacttagaaaagatttggttttaaagaatatagccttggactacagtaattttctacaggatgtataaagtgccacagctttttctaggacgttaggatcaaaggtttccaaacagcagattttcttaattaccctgtcattttcatcatggaaatgtaaataaatacttataactattttactcctttaattaaaaatcagaaaggccacagttgaaatgtttgcattattgtgaatgaccgtggtgattttgtgacgtatttactatattcacagttaatttctcactggtactatattaggttatctttcatgtcatttatgatatgattctaaaccctatctaagaaaagttatgcctgattgtaggtccatccgttctttttagcggatgtgttatttggtttgagcccccagagaaccatgcagtaaactaggaattcaaggagttgtaataaagcacatcttttccccatcccctgtccacagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaaggtacgttgggtgtttgtgccccatcttcatttcagagagcaatctggtcatcacttggttaaaacttaccgtgtagccatttcaggatatttacattctttagggatcttgtgcaggtaacaggtatgttctgtaatgtcagacccttataccctcacttaaggtcttaattgacacctctttatggagtggctttgaggtagtgtgcccttaaaggctctaatttcaaattaagaggttgggagttatcaggccgccctgttttctgagctgccagggtgcgatcatcacactgcaccagttttctcatctgtaaagttacagaaacatttgtggaactggggcccagctgcccttctggaaagcactgggccttagacatgaatatagggccctgaagttgtagaaaattgattgtccactgagtacgtggtctttctggcaaaaattaggaggattactttctgtataaggctggagggttggcccacgagagtaaagcttgctcaggaatcaggagggagtttagcagacatgtcaggatgcctataggctgggctgagtgccatgtgcatccgtcctcaattcatcagcatttttttttaaccttccttttaaaactgaactcttagtatttctcagtttggcctgtggcccctgtatgattttcttctaagggaaaattttctttccgtgactagtgtcatcttttgtcttccctctcccttagaggaactgaaggtgtgatgtggcagactgcatggccagaggctcaggaccatgtgttcctgaagtctttcctttccagggtcacaggaagctcattatgcctcttccctgtctcttcattgtttgtttgctttatattttgcaagaaatttaaagtgtgttatggccaatggttcattctagggactaagttaaataggtcacattctttctgtaatcctcttaaatgttcagtttaaaaaattatatgcgagggaatgcgaaatacaaaatgtaggtaaaatataaaagttacacctttgttttaaatattggtgacttagtctagtagagtttattggaagaggcagaaatgacaagtaaatgtaagtaatacacacattacctggagaaacaatccaagtgagcagtttctctgttagcctagatctaggagaatacaggtttaggaacagggtacaaaaattcatgggaagccctcattcactctgcaagaacttgggatttatttcacagaccttgagccaaattctaggtttttttgttttgccttgttttgtttttttaattctccaagcaattgtaacatgtaatttttgttgttgtttttattatttaagacagagccttgctctgtcacccaggctggagtgcagtggcaccatctcagctcactgcaacctccatctcctgggttcaagtgattgtcacgcctgcctcagcctcccaagtagctggaattacaggttggcaccaccatacccgccttatttttgtatttttagtagagatgggttttcaccgtattggccaggctagtccctaactcctgacctcaagtgatcggcccacatcggcctcccagagtgttggaattataggtgtgagccactgtgcctggcccaaacaattttaagatatgttttgatataatgtagcttgctaaagctgtaagacccctatgaatattccccagttatgccgttgcctgtcagtaaagtttcttcctctgagaatagaacttcgacagttttcgtgtgtgtgtgtctgtctgtctttctgtgtctgtcttccgtccctctctagccacatctgtatgtattttttttgaaagtctctgtcatgtccctttttactagtttgtttgttttcactgggagacagtggaaaaggagaatagaaaagaagtgttctttcttgtcctggggaaaaaaagcgtctgacattttgcttttgatgaatattcaaaaattagtttttttagacagatgattttagccttcaatttctgcaatgcagagagtattataatctcatatagggatttatgtaatctctaaccaaattgattattattttacattgcagaaaaattcatggagcatatcattacttatcacgaatttgcagaaaaccctggacttatagacaatcctaaccttgtaataaggatatataatcggtaaatactcctgcttttataattgttaaatactcttgcagtttttttacaagtgccatttttaactgttacttataaaagtgttccttcttataaaacttgtcatctcatataaattagccagtgggcaatgactttgaagtgaaagtaaagcttcaattttatttttaaaagaagcattgaaatgttactctgtttgatagattttacggcttctctgttcagagaagttgtgcttgaagcgaaggttattcatgtgacaaaaaattcagctgatcatctttattgaaaagaataagcaattttatatgtcacttccctcctccctccctccctgattccctcccctctctcttgctcactttcactgtgtaatggttttgcacaatttttgtttctcacagttactataactgggctttggcagctcccatgatccttagcttgcaagtattccagaagagcttgcctaaggtgaggcgatccaccatctgctgcctttccgaaagcatccgcagtgtctagtacttacacaaatccatatgtgcatatttctgaactgggtactattcaaagttttacttgagcttaatatttaatataaaagatcaaagtcatatgtacccactaaaaatatctcatgcccaaactctgggaaattagcagggctgccacttctttatttcatttttattagacataaatactagtttctgatggtctgtaaaagttgagagattttactaatcataagttaaatatggaatgaatgaaaaaaactttttctcccattaatatgggaagaagcagcaagaagaaggtgatgtagccaagagaagcttgacatcagtgtggttagggcagatggtggctaacatacctgttatatacaaactcacaattggtttttaatctgtcccccaagaagacatcatcagcctagttggtcctcttaactcatgagaaccacattttccaaagatagataaatgagatttgcccacctgtcagcccctaaggtcctacatagcagaccgcctggtctcatgccacagagctgtgctgccatgaaagcaggacggggtctgtctctcagaggtgttaaaaacgctagaggaatctgggaggtgtgaagagagcatcggtcacgttctcacattccatagtaaggccccgtccttcaggctagcatagaaggtaggtgctgtgtggccagtagattgcccagactaacccaggttggttgttttcaggccacagttgagtcctgggtgaaagacaagatgccaaagaaatctggtcgctggtggttttggcgaaagagagaaagcatgaccaaacaggtaacagacctagaggtcattgtttccgtgggctgaaagaaatgaatctttcatttattcaaaaaacctttttgtcaggcacaggaatttggactgtatagggctattttaccatatagcagtttccatttttgagcacttaggacgtgcaggtgttgtcccaagtggtcctttactgtagctcagcactagagatgttcgagttgccatttcacaggtaaggaaacttgggtgcttcacgaagtcacataactggtgagagacggagctggggcaagaccttgagtctgactccagagcctgtgctctttctgcttcactgtattacctatcagataggagcagaaggttatcgtctgcctgcatagttccagatgcaaataaccagaatctgttccaccaggtctccatagaaattcatccagagaaccatactaaacaagcagcagagcaagtctttttttccccaacaccttctgaaaaagagggttcagggagttctcacctgtttttcaaatgtcagaagggaagtcttgcctgaaccaagttcatgtccacgtcagcaagggggctgcctttcagtcccttctgcacgtggtgagttactcccaggaggagaaggaagctggggacctaacaagtttgggtcgcttgtattatgttttgtgacttgaaatggtgctcttaaaatgttttacttctgggtctgtagggacagtgatttgcatagaagcacatgacttctgtcttaggtttctaattctttggctcagaatagagaaagtctggtttttgagcatttttaagttgtgggttcagaaggcagttgtgttctttcctagagagggctgctgatgaacttggcttatctgtagggaaaaaattgcatgttgccattatcatcttgctgttacagctgccagaatccaaggagggaaaatctgaggcaccgccagccagtgacctgccatccagctccaaggagccggccggtgccaggtgggtgccctgtcctctgcccggctcatagcactcaggccctctagcagggccattacttctaagttgattttggcagcttgtttagttcttgggagtatcttctgcagatactacatgctgtgatatatttgtgccactcagcagatgacaactgcttttctaaaaaacatcaccagcttagaaaaataaataccctgcctccttgtggagccgtggcgccagcgtatgggaaggggccgtgaggaacgcttcagccatgttggcccaggtgcctctgctccccctgcatcccatccggagccaaagggagacatacaaaataatctccaggttggcttgggtgggtttcctttcctggaagaaacagcattctttggacagttagggtgagcagccctgagaggagttgctcgcgatacgccgtgttcctgcttctgcctgtccacctcccccggccagtgcatgcttgcttctcccagcccttggctgtctcatttagtgtctaaggctgagggtttattttcttgccccttaccgccccccatcctatatcttttaaggggtgtctaaaatttttcttactagtttttgtttttttctagagtctcactgtgtcactcaggctggggtgcaatggcataatcatagctcctcggctcatacaatcctgcctcggcctcctaagtagctgggactacaggtgtgggacaccatgcctggctaatttttaaatttgtattttgtagagacagggtcttgctgtgttgcccaggctggtctcaaactcctgggctcaagcagtcctcctgcctcagcctcccaagtagttaggaccacagacaagtgtcactacccctggctaatttttaaatgttccgtagaaactgggtctccctatgttgcccaggctggtctcaaactcctgggctcaaggtgtcctcctaactcggcctcccaaagtgttgggattacaggtgtgaggcaccgcacccagccggagtttgttaaatcattgtaagcgattatgttttctttgatttgtgccttgtgaaacatacataccctcttcaacaagagtcagtagaccttctagcattcactgggcatagcagaaaatagcaggtcatagtcagaaagtaagtgcttgccagttatgaaagtggccttatcagttaacaatatgaatatttcaggcgtacagagctgtggatatgggagaatggcagaagggataactctacccattcctagaaaagatttaggatatctttattttcttgatcctaaatgaaaagctctcatcaataaaatgccctgctgcctcttccgtaactgggctaatgttgaacaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgtgagtcttgcatgatctgtgttgtccagtaggacttattttagtaatggtttaatttgatgcacatcctcttctgtccacacgtccccagctgcatacacgccacacggcatggtcgtgtcaatgcctatccacagtggaaccacgaccgccgcccccaagagctatcaggcccacctggggaacctgtggcttgggtcctgccacccaccccagacctccttcctccatctcttgagagtcagtcgtacacagctaacccagcgctgagccaggtactgtctcttaggagccacagcaatagagaaatgacattttagacacaatttctcctcttattttacaccctgcctttgacccattttcggtatgaaaaggtcttgctgggaccagagcaggctgtggctaaagcagtaattctcaggtgtggagtaagagtagtagaccttttgctttgtgggtgttcagagaagtccctggaaccccaaaatactgttcaggcagtggctccctcagcattgtcagctgcgctgggcacagggtgggctgtgtctaagaccccggaaaccatcctgcctcttgttgggattccgagacaccagttgttctgtaaatttttaaatcgtttcaaactatgttttcagctgattttctttattcttatgcttttttaaaaggcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtaagctcaatccttcaggtgggtggcaaggaacagccccgtgctcagggaggggcaggcagtgtgtggtggggagttcctcacctggggctcgaagccctcagccaaggcattttataagccatatgctctgaggcgtccccagtacagtccacatggggtcatttttttgcatggaggagatggtgagggtgcataacaaatgtcaaaaatcacttttggaaagattagttatttggtttcaattctgatatgaaaacaagccccttgacattggggcggaggaaaagagaaagtgtggcagtcagttacctccgaacacacacatctggcgctcgtgagactccgctttcagaagcacctcagtgggtgcgtttgcatgggatggccttgcagttgcttgaagctgtgattaaatcccctttcaagagtgtcccgccaccaattagttattggcagctgatagtcaaccaaataggaaaacgctgtatgtgtttgattcctgatagcttttcctgtttctaccgtcttcttaggtcggatgctttgggacagattctcccacagctgggcaaagactggacccaccagggtatagcaaagctctaccattccatcaatgagtaggtaccctccccacgttaactcgctctggtgagctggaagcttgctttaagaactatagaacaatggtgtaagtcttcagtccacatgagtcatgtgtttatgctgaagcattcccgctcttcctcactcctttcctgttgatggtgtgggagccgtgtgcacctggcattggcatcgaacctgtgtcatctcagttaatcctcacagtgctgtgtttcaggcactacctacatctataactagaatgacagttatttttttagctagaatttaataagatagctgattttcatttttggtttattttctgggtattttaaatttttttttttttttttttttttttttttgagatggagttttgctcgtcgcccaggctgaagtgcaatggcgcgaccttggctcactgcagtctccgcctcccgggttcaagtgattcttctgcctcagtctcccgagtagctgggattaccggcacatgccaccatgcccagctaattttgtatttttagtacagatggggtttcatcatgttggtcaggctggtcttgaactccgaacctcaggtgatctccccgcctcggcctcccaaagtgctgggattacaggcatgagctattgcgcccagccttaaaattgtatttctttgagtagatagtgcacgcatgcatgagggaaatagttcttgcatgggctgctctctcttggggcaccctttgaggggaagatagccgtgccatggcgtttgtgggttcctaatacatatattacattgatctgaagaatctcagtgtcttcagcattagttgagaataccataatatgaaaattacgaatatgtcagttacctgggtataattttgcttcttgtctgatggagtggtttgcatcttgcacattgcctttataaataatatcccctatattttttcttcacagtgggtaatttaaagatagtccaaggttttttctgtcctctaatctggctttcatggactagatgctgaacattttatatcagtacttacaaacttaacataatccttagttgcctgtacctccatttttttcccacgttttccatggaaggtgaaacctctataatcctaagcagtttcctgctaaatttgagaatttggttttcacagtaaatgagaggaagtttatttggatcttttaaaagaaaagtatgggttgagcatggtggctcacacctgtaatcccagcactttgggaggctgaggtgggcaggttgcctgaggttaggagcttaagaccaatctagccaacatggtgaaaccctgtctctactaaaaaatataaaaattaagccgggcatggtgtcccatgcctgtaatcctagctacttgggaggctgaggcaggagaattgcttgaatccaggaggtggaggttgcagtgagccgagatggcgccacagcactccagcctgggtaacagagtgagactcaaaaaaaaaagaaagaaaagtgtggggttttttttttgttttttgttttcttttcccttagccagaacatgtgggctaacagggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgagcactaaaattttaggaccactcactggggaaaacgaccattttgagattggtgattgtatttgtatttttttcttagagaagtgatagaaaagaaaccagagaagttcaaaattgagtgtctaaatgatatcaagaatctgtttgccccgtctaagcagcccttctatgctgcctttggaaaccgtccaaatgtgagtatctcctgggctctgggttctgatgtgggtgaaattcagagggatgtacttcgtggggtgtagccacgtcccaattctcaaagcagttttgtaagcaaaatgaggcatctgttctgcttgttcggttttcacttgatctattccaaatatctatagcaactggggaggtcctgcaggtgcagatctgccccagaatttatacgaaggacgcttttccatcgtttctgtggctgccattccatttcctcaggcagctccggctcctcttctaagcagttctgagctgcgtccttggatcaccccagagccagggtcagtgctggcccttcgctagcacttcccaacctgcctcccttctgcagggccatcgggcctcaggtgtgcagaagatgtggcctctctggcctcttctgcgccagggaccctggcttccccttggtggctgcccaagttttctgactctccaagcaccactctgtagtttaggtttgtctaaagctcagttttggtggcaactgcactgtgccgcctccgcatgttttctgtcgagtctgtctgtgcagtgcttctggctcacaaggagcctgagaagtatctcctgaattctcctccctggaatcacccgcttgctattttcttctgcaggatgtctatgcctacacacaagttggagttccagactgtagaatattcaccgtgaaccccaagggtgaattaatacaagaaagaaccaaaggaaacaagtcatcgtaagtacattctcagctctcagcccggcgccctgcagccaggggtacagttggggacagacagaccctgtccttttccccctgatccttgagatcaggccctgatcaaaggatcagctacatctcctctgtgggtatctctctttcacaatatctgtttgaggggtctctggttatcctagacttgtaagagggagtttgagccctgtgatgggactgaggcctgcctctgaacctgcccacctgagcaatctgagtgacagcttcacagccccccatcttgtgcctttgaccgatcttgaagtaatagcctgtgcctcttccccaacctttctcttaggtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagacctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaatgcatttggctcttttcttcaggggacattgaaaccatctttctagattcttgccagaaattggtaatttccataaattagcatcttgatctttgctgacacttaaatttgtctacagcaggagctcctttttgttgcttattcttaaaacctggcttcagaagtgcagctacacccccaggaactaacctcttgctttgtaccttctgccaggaaatgacccatccatatgtgacttctgctgtggtctcacggctgtccaggaggctgtgtttacctcctctccctaagcacttgaattccctgggagtcctgtccagagcccctggacaccccacctttccttaaacccttccttagggtgggtatgatttagcagtcaatcctgatgttttcatcacagagtcagagtgacctttgatcaaaaccacatcgcatatattacttacatggtgatgttttgtcctctcagattgctgggcccttaccagatgcagcatatgctgaaccctgcatcccaaaggccctccacaggagcgtgtgttcaggatggaaatgtttgtttgcatgacgtgatggcaaccatgggtctttgggaatgcaaaagaagagctcagggaaattggttacaaaggaaatggtctttacccagagcagctttgagggcttcaggggagcagtgaactttgcatacctgagctctgaggacgtgcctgcgtgtggcttctctctgttttgccccgcacccattggagttggcatgtgtccttccattttctttcccgtttataggatggcataaggaaaatacacatttatctttagaaaggggctgtggtgtggattggatatgtgcaaagctgggtttccaagcttacaggcatgaacgaagtgactccaatcacaaatactccctgtcaagctgcaaatacataaattgtgagaaaattagtcacctgggaaagctagattaacatgccaaccaggaagtaatttcaaatgcagtttaaggtttgcatttattgacgataccattttgtttttaatcgtgtaaatgaggccatttgttagtgttacatggaggtttggaggggatgtcacagtccttctctacttaagaagtgtcctgaccttttctcagcaacaacttgatatcagaagttgtgaacttggctgggcatggtggctcatacctgtaatcccagcactttgggaggccgaggtgggcggattggctgagctcaggagttcgcgaccagcctgggcaacacggtgaaaccccatctctactaaaatacaaaaaattaaccgggcgtggcggcatgcacctgtagtccccgctactcgggaggctgaggtaggagaattgcttgaacccgggaggcggaggttgcagtgagctgagatcgcgctactgcactccagcctgggcgacagagtaggactgtctccccccaaaaaaaaaaaaagttgtgaacttgtgcctgattctgtctcagggtttggtatgcctctgactgactcgcaggcactacttcaggggtgatgacttcttgaagggctgcttcgaaccccacagccttaagctcagctgaccttgttgttctactacctgtacaaaaagacagcctttccctttctaaagatgtctcctaagtgggccaggatccacctgtcatccagctttatctcaaagtagaggcacgctccagccataatgaggcatattctgttttgcctgtcttgaatacacagagctgagattcaccattgttggtgagtagagatgcactgagaggaggactgggttttacccgatgttccagacccatctacggagtagggaaagcagcaggtagtcatcacccaccttttgcctgggccctgcccctgcagctcttgagcacgtccccttgggcgccgagtgcggtcttttcaaaaggagcgtgagaggagaggagagggcgatggcgcgtgcccactgggttttcctgaaaaca

SEQ ID NO: 16159 - DNA, 10304 bp, Human
gggtgcaccagttgtaaggggaggggtgctcattttagctggaagagccaaggaaggcttcctggatgaacatggctgtccagttcagccctgcatcctcaaggtgatgtttgctgacccctgagcaaacgtggcattgctttcatagttgtgcatttctttgtccattgcttctgatttatggcaagtggtatctgttttccattaatggaaacaatattagttgtccctttaagataaataataataggccgggcgtggtagctcacacctgtaatcccagcactttgggaggccaaggtgggcagatcacctgaggtcaggagttcaagaccagcctggccaacatggcaaaaccatgtctactaaaaatacaaaaattaaccaggtgtggtggcacacctgtagtcccagctattcgggaggctgaggcacgagaattgcttgaacccgcggcgcggagattgcaatgagccaagatcgtgccactgcactccagcctagacaaaagagcgagactctgtctcaaaaataataataataatagacaatagttactgaatacctactatgtgccaggcactgcattaaatgctcctatgtacataattcacttaggcctcccagcaatcttatcaaatcacgtggctgtacccattttacagacaaggaaattaagacacatcaaggttgagtcacttgcccaggctgtgtggctccaaagtctgcgttcataaccattaaccaggcttctccacctcagcattaaggacacttgggaccagacaagtgtctgttgtggggactgtcctgtgcattgtaggacatgcaacagcattccctggcctctacctactaaatgccaatagcaaccccagtcatgaccagcaaaaatgctcccaggcattgccacatgtcttttgggagactaaatcagccctatgagaactgtaggtctacactaaattgtttttccaagccaaataaataccaaaaaaaaaaaagttaatttaaaataaaatgttaagtaaataacagtacatgtgtcacctgaaaatccactaggatgtcagctgcctgggatcagagaccccttcacattctgcacacggctgcatccccagtgcatagatggatatgggagaattgtgaaggctgggagatgctgaacaatgttgttgctatttcactattaggtgaatgtctttgtcagctcaggctgatgtaaccaaatattaataccacagactgggtggcttcagcaacacttatttctcccagttctgccggctgcaagtctgagagcagggcgccagcagcactcttctctgggtttcacacttagatgcctccctgagtgctcccatggcagagagaaagccctagtgtctcttcctcttcttcttttttttttttgttttgttttgttttgtttttattttttgagatggagtcttgctctgtcacccaggatggagtgcagtggcatgatctcggctcactgcaaccttcgcctcccatgttcaagcgattctcatgcctcagcctccctagtagctaggattacaggtgcacgccaccatgcctggctagtttttgtacttttagtagagacagggtttcaccatgttggccaggccagtctcaaactcctgacctcaggtgatccacccgcctcggcctcccaaagtgctgggattacaggcgtgagccaccgcgcccggcctgtcttcctcctcttataagaacacgaatcccatcgtgggggcgttgctctcataaccacatctgaaccaaatgacatctcaaaggccccacctcctaataccatcccattgagggctagggcctgcaacctatggatgtgggggacaaagattccatccctaacagtgaatatctgcggaatctgcattctcagcaaggtgaagctaggggtggtcactgagggtcttccctcccttctccccacaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcaggtaagagcccacgccccgcggggaaacgcgccaccacgagggaagggactctgagcattgtcacctcctccagaaagcctcctctgattgcacactggctgaatagcatccctggtccctcctgacatcaggaatgtttgtgtgcatggtctgcctccctgttaatatgtgagcatcatgggggtccacgcctgtgcctgtcctggcctccactgtgcccaccactgccctcccccttgccagtgtttagaacagtgtccagcacaaacaggcactcaaccactatttgttgaatgaacaaatgagtgaataaatgggtggtgtgatttttgacgtgcctggccctgagcgaagcacattacatatatcatcaaatttatctcaaccattcggtcctttctcaacgttcctaatcctttgcatcatagtagcccagacacattttctgggtcctgaagataatttttattgataggtacatgtgtgtctacaaatggtgagcatttctttttgttacataagagaatgaatggaaagtttatttactccagggcctgacacggggtgtgtgctacagtctaagggctcccactcatctgggagttcacgggagccggagctgggctgcatgtgccaactacgtcttatctccccagggaatgctccagcaaccctgtgggggaagtgttttcacacccactaggtatttgaggacactgcccaaccccaggtctaagtccagtctgtctttgtaagcatggaaatatggttcccacgtggcagcttggggacctaatatagccccacaggactatgtgattggcccacacaaggtttcccaaaaatttgacttggttgccaacaataaaagtgaagttttttcatataaaaattcaaaatctcagcttcttttaaaaaaaaaatcataagatcaggccaggtgtggtggctcacacctataattccaacactttgggagctggaggcagaaggatcgcttgagcccaggagttcaaaatcagcctgggcaatgtagtgagaccccgtctttacggaaaaaaaaaaatttaattagccaggtgtggtggcttgcacctgtagtcctagctacttgggaggctgaggcaggaggattgcttgagcctgggaggtaaggctgcagtgagccatgatcacgccactgcactcctgcctgggcgacagagtgagactccatctctaaaacacaaaattttttttaaaattgtgaggttgggtccctcccctccccctgccccgccaccaacatatacaccagcctgtggtcctacatggcacctcctggggagatccaagtccacaggggcccagttcagtctccttgtgtatgagatcatgggcctttgagttggtgactccttccctgtatatggggattctggaagcttcaagaaagaccaaaagttttcagaggtacaaattgtataggcagtggagaaataggtatggcggtgtgaactgaacgtaaatatcatgccagccaatatttattgagcactgactgtataccctgcatgtgctaagtgctttacgtgcactctcgaatttaacattagaagtactcaccatgtcaggatttttccacttatgtatgtggaggaagtagcagtagctgttgcattaataatccacagaggcttaccagtacttttggtatacattgaatttatttacttatttttaaaagatggggtattgctttgctgcccaggctggcctcaaagtcctggcttcaagcgatcctcccacctctgcctcccaaagtgctaagattacactgtactggagtacagtgatgcgatcttggctcactgcaacctctacctcccagattgaagcgattctcatgtctcatttacatgcactctcgaatttaacattagaagtactcaccgtgtcaggatctttccacttatgtatgtggaggaagtaggccctcatgcctggcttataagttgaatttttaaatgggtattaagaaaatagcattcaaccagtaaggttaactttttaaacttttttaaattaaaaaaaacaattttaggccacgtgtggtggctcacgcctgtaatcccagcactttgggaggctgaggcgggtggatcactttaggtcaggagtccaagaccagcctggccaacatggcaaaaccccatctctgctaaaaatacaaaaattagctgggcatgttggcactcgcttgtaatcctagctacttgggaggctgagacatgagaattgcttcaatctgggaggtggaggttgcagtgagccaagattgcaccactgtactcaagtctgggcaacagagtgagaccctgtctcaaaaaaaaaaaaaaatttagagatgggggtgttgctatgttgcccaggttggactcgaactcttggactcaagcattcctcctgcctcagcctcctgaatagctgggactaaaggcatatgccatcacacccagctggtaaaatcaactttcaataagcatgaagggtagtgatgaagagatcagggctagagccagatggcctgaattcaaatcctgctttctcctctctagctgtgtagtagctgtgggcaagttacttaaactctttgagcctctgatttctcacctgtccagggcgggtatgaacaggcccacctcacagtgttgcaaggattcagtgagttcgcatgaagtgattagaagtgattggggctgggtgcggtggctcacgcctgtaatcccagaactttgggaggctgaggcaggcagatcacttgaggccgggagttcgagaccagcctgaccaacatggagaaaccctgtctctactaaaaatgcaaaattagccggacgtggtagcacatgcctgtaatcccagctactcgggaggctgaggcaggagaatcgcttgaacctgggaagcggaggttgcagtgagccgagattgcgccattgcactccagcctgggcaacaagagcaaaaaaaaagaagtgattgggctgactgagtccacgccacatgaagggattagaagcgatgcatagtgaatgtgcagaaagtcctctcttaaggattagggtcaagaagaaaaagaaaggaaagggaaagtgctcaccatttgagacctgtctggaaattgctgtacttagtgtaaatttcttctcagcttcaacatctttgatcgtgattttatcaggaaaatactaataaagccactgttttgttcaacttctgatacttgctttttgaaaagataataatacctttgcctttttaaggattcagtgaaaatgctgttcttcaacttcattttggggtgcagtaggattcactgcttcacatgctccttgtgcacacatttgagtgcctactgtatgcaggcactacaggggagacagggtgaccaggacaagtcttccaacctcaagaagcttcaagtctattggggttgggatggagtagtggcaccacccaccccccccatcaccataagcaggagacacaagccaaggaggttctgtatgggaggcccactgacactgctggagctacttagtggggcacgctccaggaaagcttcccagaggaaggggcttcccatcccagaggtctaagaccttaaagccccaccaggtattagttcatatctccagcctctaacatattcctagagacagaattgttcaagtgggacttgtagaactcagctgtgccccagaacctccaagatgccccaggctggaaccacactggcctctcctctctgccaaaggccccttcaaggatgaggcccaaatccactaaaggactgtttaccacccaattatattccagaccagagaggcaagctggcagcctgcatgccaaacccaacaaaaatatgtgttttagtggcccatagagtatttctttgcactgaattatcaccaggacttaaatcaacattttatctatttaaccaacattatcaccaacatttgtcaccaggagagttcatgtaaaactgcacatttccagcctcttttgaaagcttcggtgaggcagcctcagcctaaatttgcccggggcagtgatgggggcactgaacaagactattcctcacagtccatcgggagccgtggagggtgctaagcagaggaggaacaggatccctctggctatgtgtggaaaatggactgcagggatgagggagcccagcggggaggtgaggtgactgcaaccatccaggcaagaaaggatggtggccagaccaggtgggagcagtgggcagtgggtttgattctcgcactgttttaaatgaagagacttcctgggggttatacgcaaggtggtaaggatgacgccaggtctcctgtcctaagccattggaaagatgggattgcctaaagctagggagggaaaccaccagtgggcagaggaaaccaggatcccatggtgagttcgagatgcccctcagacacccaggtgggagcgtcagggaggcagcctgttgggggtctggagttcagggctgaggtgggggctggagagagagatgaggagcggccagtgtagagatggtgcttagtgccccaggcctcggagtgggcacaactagggagaggacccggggccactcaacctggagaggtcaccttccgcctgggaagcccagcagggcacagggcagagcttctgcgctcctttcctggagggcccgctgacccctccggcgtcccttcccctctctcccagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcgggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatactgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcatgtctgtctctaatgtggatcatgtccagggaaaagaaattgatgaaaaagagagaatgccttccatggggctctcttaaaaaagggagctgggtttcccagcaaagccagcaagtgggggctggaagtaaagggccctgtgtgcttgggttgttcaggcccggtggggccctactggggttgtagaaaaagagaacagacacttttaggaaaatgaccagtgaatactgtgctccctctctcgtttctcttggactgtccccccctctgtgcctttctttctcccgtttcccttttatccttttttccttctcttccatcctctattcacctttttcaccccttagggctggtttttcaaactttcacacaaaggcacccctgacagttgacaggtcatcagggggcctgtcagcgttgttgactatgaggtgaaatcagttcattttatctttaaaaaatcatgtggggtttgtattctactctgcatttattttaatctgtgaaaaaaaaatactttgcatcatatacctgcatataaatctaaacctagagcggggacagatgtttttgaaagggagtttacagttccctgggcagactgagaagcacaatctgcagcccccacaggcctccccgtgcccccaaagacctgcagagcacccacccgacctgcagagcatccacccaatctgtgacctgcagagcacccgcctgacctgcagagcacccacccaacctgcgaccttcagagtacccaccccacctgcaacaggtccccgacttcatacagcatatgtgacccacagtagagagggcgctcaggccagtccagcagattctactccagctggcaggacatagagcccctcagtgccaggcgtggggagggggcttcccactcaggtcacagtcacaagcttgtcctaaccctcaagccacatcattcccatcccagcaccttcacacctgcccatccctctgccagagatgcccttcctgtggaacactgcatagctggctccttcccagagaggccttccctgaccacctctcaaagaatccacatcagcaccaccaccacccctctcctcttagccggcttggtcttctatatccacccatcaacctctgaaattgactcatgtattcctcttcttagctacaggactcagcaatatggctcaccattgacccccagcatctcgcatagggcctgcacctagtaggtgctcaataaacatttattgaaggaatgttagccaggtgtggtgtagtcccagctacttgggaggctgaggcaggagaatccctagaatccgggagttggaggctgcagtgagccatgattgcacctgagaatagctgctacattccagcctctgtgacagagcaagaccctgactttaagtaaaataagtaaattaatttaaaaaagaaggaagggaaataggaaagagggccaaaaagcagaaggcatttatttttaacatgggatctcgggttctccaagcacctctctctctctctctttctctcccctctcgctcctctttgtcctcctctctctccctccctgtctttctcttctcctcctctctctccctctctttctctt

SEQ ID NO: 16160 - DNA, 27663 bp, Human
acatgtaaatgatctgcagtttaaaatgcaaaatcctgtcacgttacatctcacatgtccaagacatcctccgtgtgctgaaaaaaaaaatgatggttctcagaaacggtataatccattaataagtcattcatccaatacataacaatttttaaaactccttataaaaaggagtccacgtattcacagatactgtagaatccccagctcctatgtatattaccgaaaaatgcaaacaagtgtatctttgaggtattatggcaatccacatctttctcatcagactataccagtcacctcagtactgtggaaatgttccatcgattttggcagcccaggccatgaggccccccacaacatcccgaactgttaaagggtctaactcttgagctgctgataaggactggaggatcttcacggctttctgtgagtcatttcccagtttgcaaatcacataaatggggacagcagccccttcttgtgtgccctgcttctcttcccagattgcttcttttaagagtttcaggctctccgcatccctgcgttccaaatgtttcagagggatgtgtagggcatgaggcaaacgacaaatgtccacctccacctgaggcctgacgtccagcaacaggtggaatgccccagaatccagcagtcgcttatagtcggtgacagaaacacgctcctctgggctcagtagttgcagggagcggcatttatcagtggctgaggagccacagaaggcttcatagtccagcagatcagtcacagtgggccgttccccgcaagctgcacagtcgagcctgcggctccgcagccgaatagagcggaaatgccctctcagggcatcaaagagcaacaagctgccactgtaagaggggcccagacccgcagcgattttcagcacttccaaggcctgcaggcagcccaggaccccggtaacgacaccgagcaccccgccgtccgcgcagttggtcactgtctccgctgggggtggttgggggaatatgcagcgatagcaagggccaccgtcataatggtagactgtgatttggccctcgaagcgcaaggcactggcagacacgaggggccgacccgccagcacacatgcgtcattaaccaggtagcgagtgggcacgttgtccgagcagtcagccaccacatcatatcggcggaccaggtctagggcagtggctggcgtaagggcctgagtgtacggcacgcattccactgccgaattgaggcggcgcagcgaggcggcggccgaaaaggccttggcctggccagccagtgcctcgccatgcagcacttggcgggccaggttgctcatctctaccacgtcatagtccacaaggccaaggcggcccacgccggccgctgccaagtactgcgctagtggacagccgagcccaccgcagcccacgattagcacgcacgcggtccccaggcgcagctgtccgtgcacgcccagctcgggcagcactagctgccggctatagcgcagaatctcatctcgggacagagcggccttcggcggcagcggcgacaccggaaccagccgttctggctgcggttcctgctcagccaaaagagccgacgccagcttctgcttcagcgaattcaattcctcctcacgttgggcaacttcagcttgtaaggcgagtacctcctcccgggaagccatggcgacctcttccggaagttgtcgtgaaaggcatttccgcttccgtcttctgtctcctagcgactgggataaactaaaaaactttatggagcttgggaaaaggtgatgaatagatatttacttcctgaagaaaccttcagattaaacttcaaagatgtataaatccagaatatttctaattgaaccacgcaatggccctagaagaactagcgatcaatcacacaggtcatcccccgcttccgaatttggtacggtccgacccgtccttttccgcgccacattacgtaattccgcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagaggtagcgcaccaggtctccctccccgaagaatgagatgagctggcttccccggcccgggtgtcggcagctggctgcgcgaagcggccctgtccagccttctttgcctcacacaggaaggcccggggagagggccaccctgcgagggaagcagaggcggatgcttgttgggttttcttcgtgtcctgggttctcattcctgcccttgggttttgtgagactctcatttatctttattatgtagtactcccgtcccccgcctttccgtagaaaggttggccactcttttacttggaagcgaggctgaaagcgtgatcccactcctccctctaggcggtcaggatctgcggcaagagccgggagtccaagcgagagctctcactctccgctccggtgccgagtgcttacataagcatgaggtttggtgtgtgtgggttagggagctattgctgggcacgataacctttctggaaaggagaaagcagaagagcatcttcgctgatcactggtggatgtttggtgtgattgttagaaccgggatggggggtgggtggagttcgaatttggaagtgttaatgcagtgtttttaaaaactgcaaaaaatcctggagtcagtacgaagtaacttgttttacgattgcacaaatgggatcatgctgtgaaatctttgaagactttttctcatattaacatgtacaaacatagcaaattactttggaagttaggtaacattccatatggctgtgttatttatttaatcaggtcatggcaatgaactggattatttccagcgccttttggttgtttctgttttttggcttttgctttgtcgatgagaacaaggactttgttcacaccatattttccagctaaatttagaaaagtgcttgacacatagcggtgctcctttattgcatcagtgttggcagcagacgcgttcatacttttacttgtgtactagggataaattcttcgaggtaggattgctgggtcgacagaaatgtgcttaaaatggacagttactgccaaattgctctaaagaaaaaaaaggttgtacaagtttggactctccattcttcagagtgcctgtttccctatcaaccagcccgcctgagcattagacttaacattgttggaagtactcatttgtgaaaaccattgctgttttgattgtatttccttgaataactgccttcatatgccttgcccctcagagttttaaaatttttatttttcctgtttaatcttttaattttgatttctataagctctaaattaaagaaattaactatcatacaaccgatctcgttcagggcttgtattctaattttgcaatttttttttttgctgttttaatttttttatgtagtacaatttatgtttccttttaatggtttgtgaatcaatcttttaagatcaaaatgaagtttgataaaggaaacaaaacttttcagatgcaatcaaattacttgaagtcagcccagcttggtacctttgagctgcctcaccctcaggtggtgtagctgctttgaagtggtaggggacagtaatttgcttttaacgaccccattttgtttatggaatttctctttcagcacgtctattaaaatcaccttacatattttggcatgtaaaggcaccagtgcccagatttaaggcacagtgggaagccaaagtcattgttctactcttggagaatagataacacaggggtttgctttcttgtcttcaaagtttgctggggctgacttgttaaagcctttaacagtggaatatgttttctggttgattttcttgtatttgtttcttttttctttttcttttttttttttttcttttggagacggagtcttgctctgttgcccaggctggagtgcggtggcgccatcttggctcactgcaggccccgcctcccgggttctttttagtagagacggggtttcactgtgttagccaggatggtctcgatatcctgacctcgtgatccgcctgcctcggcctcccaaagtgctgggattacaggtgtgagccaccgcgcccagcctcttgtatttgtttcttaaagcaggaccaagagaaaacggaatgttatgtcgtaggtattatttatccaccaagtattgtgttggtttgtttttagactagaaactaccacctgagattaatgggaagtaacagatgttaattctgaagcacagtggaatcttttgtaatgctactctgcttttgtttttttaatttgataatgtgaggtaataggcacaactatttgaaattgtggtttaagataatgtcaccattctaaaatcggtttttttaaagatgaaattaaatcagatttatacttgattattctatttggatcagattaacaagaataatcactgagttactcagtttggtttgagttaccatgtaaagtacttttgaaatattttatgtaactaagatttgctattaaggttcagaatattatttccaaataggtaataaaatttcatatggctgggcacggaggctcatgcctgtaatcccagcattttgggaggctgaggcgggcagatcacgaggtcaggagattgagaccaggctggctaacacggtgaaaccccgtctctactaaaaatacaaaaaattagccgggcgtggtggtgggcgcctgtagtcccagctactccggaggctgaggcaggagaattgcttgaggccaggaggcagaggtaagccgagactgcgccactgcattccagcctggcaacagagcaagactccatctcaaaacaaaaaaaattcatatgatacataggtcattacgtgattttcttttgaactaaaaagtttgttctctgtgtaggaattctttaatatctcaggacattagcatgtttcagcaacatactgggtttggaggtaaagtactaaatgtttgacatttatttcatttgataattgaagttttcctcaacgattaatatagcaatacatctccatttatacttttaaggaattagtaatttttaaattacttttaaatttgagaacactgtcatcagtcattaatacaaatttaatttttttagtggaatcaactatgaaattataatcatagatgatggaagcccagatggaacaagggatgttgctgaacagttggagaagatctatgggtcagacagaattgtaagttataagaacatttttctgtgatatgaattgtgattatgtaggggaaagatgagacatgaacaatgcttaaattcaatctatttgtttagaaactgaaaagataaagagcaacttacgcatttgggatttaaatgcatttttgttgtccgtaaaattttacatatctttggtatgttgggtcagtggtcattttacagcaaagagtgagcttttggatgaactctgtttataactaattctgcagataaattttcttgaagggcaaaaattaaagcatgatactgaattgacaaggaatattatataattgggttataattggtagtgtgtgtgtgtcttaatctttcttgctccctttcggtaagtattctcatgctttcattagagaatactgcctgaaattaagagcgtgtaggtagaaaaagttactgttttcttgtgaaacattaatgacttcttagagtacttggcatttttagtctatagaatagtcttgtgaaagtagattgactgtattagtcctaaactttagattcacccactgtaccttgaaacttgttattctaatatagaagttacttaggcaaatatagagtttattttataatggcttcatgaattttatttttggttaccggtttgtatttacaaatgtttatgtatactcgagctcttttataatttatattcacaaattattgcagaccacagtttttcagtcttggcactattgacgtgtggacagattaattctttactgtgggggttgtcgtgtttattgtaggatgttcagcaccgcatctggactcttctcactagatgccactagaaacccccctccccacttggcaactgcaaatgtttggatattgtgagatatttccttaggggaaaaattaccctttgcctccagtagagaaccattggtatagagaaagaagtccctttgagaacctttattgttatttacagttcaagaaatggtaaattaatcattttaaaaaaaagccactcagtctaaatattcttgataaatctcagtaatagaaatactttctacttagaggtgagtgtcagttgtatgaggtcttggtggcaagagtttaaaggaactgtgttactacatggtaaatgtagttctaggaattctttcagtctgtctcacagatgagtaactcaggtctgtcacacctcaagtcttctctgaaaaccttctaatggatgggaatacagaaagaggtaaaaagttgacaaattttcaggcttctagcagagactttcagtaatgctaggtttgaatttttggccagtagttccctgttttctttagaagcccagggtgaaggccactgattcacaacacttttgagttatgtgctgccatttaatctcggaccatcaaccagacaacattttgaatacttttgtcataaaacctcagccttaggatgtgattgattgattttagggaatggttactaaactgacctttcaaattttggaacaacattgtcttcaaagacattttttctatcaacccaataaaattcaaaatgagaaaaaaagttgcattcactgttacgatttccctctactaccagataaaattccttattcattcattattttatgacatttaaataagttaaactagaaaatgacttttaaaaaaaaacagtattaatccatgctagggatgacacttgcttttagtgacagatgtatgtttcgttgagaaaatgaaggatattgaaaccatgttagaatacctcagataaagtgttcaccacagatgctttgtcagcctttcagactggctgaaatgaatctttcagaaaagaagccaaagaagatatttttaaaaattctgtaggtgacacaactgaagcgagaggttaggtcatttttaatgacctaactaggtaggaccatagagaaattgggggcacttactctgaactattcacagtgcttacaaggcagagatctgaaattgtgaaggacttcaactgctctgtgttgaatgcttttattatgtttggtttatgtagtttgtttcatctcccaacttgagatcagataaagtcatttatattttgtcatattttcttccagctttattgaggtataattgacaaagttatatatatttaaagtatgaataccacatttggggaatgaacctgtccatcacctcacgtagttacccttgggggcaagttgacagtgatgaggacagttaagatctgctctctgtaaatttcaactatataatatgatactattaactatagtcaccgtgctgtgtggtagattcttagaactttgtcttacattttgtcattattttatagtttagtattttaaaaacttactctgataataaaatgtaagacatgtttattattcttaaaacatcaaatataagataaaaaggtttgactacttaaaaatattaagcttctgtccattcccaaataccaaaatatttctaacaagatcagtaccccaaccaaccagataattcataagaccaaaactagaaatggccagtaaacaagaaaaaaatactgagcctcactgataagtgaagatttacaaaacaggaggagagtacatattagccttattagctgaagatttatttttattttctcctttctttttaacccagtgtttctgagagtattatagaacaagtccactcaaatactgttgatcctagtataaattgatactgtttttctgaagtatcatctggcagtaatctcatgaccctcaaaaatccttaatgcctttgtaataagtataaagcagtttataaaactgtatatgtactatagtctcaattctgtttttaagtaacttttttcaagattgtctgtgataagttttacaaaggttcttgtcaaacaaattatagtttcccataaaagtattttataagcagctgtggcaaacatgcttcaaaaagtatatgcctgtcattcttgcaagcactttatgtgaatccacttgcttgttcctcatgaaagccaagtgagagggggctttgtcacgcctctttatattctcaagatcacatggcaaatgagtagtggccaggattcaaacccaggcattgtggttccagggttcatcttcctgtctgtaatgctatcctgcctcacatagaaaggggccatcagattgatatgaagaggcaaaaaaggatcaggggagggtggagaggtggaattaagagtctgaaagtaaagcataccaaatagaaatagtttggatttcctacataagaaataaacaagcacatccttgtaaaatataaatgttaccagtaaaaccgaagttgcctttgatgaacattttatttatttatttatttattttttttttgagattggagtctcgctctgtcgcccaggctggagtgcaatggcaagatctcagctcactgcacactctgcctcctgggttcaagcagttctcctgccccagcctcccgagtagctgggattacagacctgcaccaccatgctggctaattttagtatttttagtagagactgggcttcaccgtgttggtcaggctcttcttgaactcctaacctcaggtgatctgcccacctcagccccgcaaagtgctgggattacaggcgtgagccaccacgcccgacctgatgaacattttctataggcatcccattcccttgcacaggggagacccaggtcaacagtttggtgcgtttttttgtgcatatatgtgtgtatgtgcatttgcagaactaggtagtgtggtggtcttgttttttaaaacataactgccatcttcctgtatcatcattacttctaattctgtcttggcgatcttttgtcaccagctcacctcatttctgttaatggctccataatactctaatattttatataaacctttgaagattctgaaaattataagtatcatagtctccttgtccatggttttgctttccgtgatttgttacctgcagtctgaaaagaggtaagtacagtacaagaagattttttgagttagaccaagttcacataacttttattacaatatattgttgtaattgttttattttattattgggtattgttaatctcttactgtgcttaatttataaattaaactgtgataggtgtgtatgtataagaaaaagtatatataaggtttggtactattggagatttcaggcatctcctgggggtcttagaaagtatcacttggggttaagggggtgtgcaactgtaacaaagttatgtttgtttgtttgtttgtttgtttgttttttgagacggagtctcactgtgtcactgaggctggagtgctgtggtgtgatctcagctcatgcaacctctacttcccgggttcaagcgattcttctacctcagcctcctgagtagctgggattacaggcacgtgccactacacctggctaatttttgtatttttagtagagatgaggtctcaccacgttggccaagctggtctcttaactcctgacctcaaatgattcacccgcctcagcctcccaaagtgctgggattacaggtgtgagccactgcatctggccaaagttatctttttttaaaagaaagattttccagctaaaacagagttgtagaaaatctcagatgagctttaaaaaatttgctttttcagggcagataccagatggggatcagtattttgtcagaaattattcacaaaatcaaataaaatctagctgtgatctgatatatcctgctcgattttgttcagtgacttgcaattatcatagatgcttatttgaatgtctttccttcctgtaagctcttaccagacagcagtgtattttatccatctttatgcaagatgtactttgctatagatacaaattgtgacttaaaattttttaaatgtggggatagtggagtaaaagtgtagaggatttctttttagcagttagagttagattgttatcagcttaaaatagcctgttatcactataagatgggttttgtaagtctcatggtaatcataaaggaaaagcctaaagtagattcacaaaagataaaaagtaaggaatcaaagcataatagtacagaagataatcataaaggaaaggagaaagagaaagaagcaaaagatctacaaaacaactagaagcaattaacaaaatggcagtaggaagttcttacattacatgtcggtaattaccttggatataaagggattaaattctccaaagacctggagtgactgaatggattttttaaaaaagagccaactatatgcttcccacaaaagacttgacttgtaaggatacacatagactcaaagtgaagggatggaaaaagacattccatgcaaatagaaacctccagcagattgcatatagtgaaaaaaaaaaaaaatcatctgctttaattgaaaatgctttgttgagagatttgcagtcagaggcaacctgcttatatactggcaagtgtagaaggggacaagatagacaagacatgctcactaatgagtctccctgaaccccatacctcagaaacgtagggcacagtgagaactttggcatttgacttttaaagtgtccagccaaaaggaaaaactaaacaagtaaaagtcaggctccaactattaagcaaaaagatttaggaggactaagtgattgaccaatagtaagaaaagagaaagaatttaattaggaatatgacatgtccttggaccagtagaggagatgaggtcatccaagcataaggtcaagataagttaatagaggaagagtgatattagtattcaaaacccaaagggaatcgagagaacaaacatcagatttcccaagaaggtgcaaaataatgaagtaagtcctacatttttctaggaaggaatcaatagatttaaaaggaaaatcaaatatagatgtaaagacatatttaaaatagagtgagtgacaccagaaaaaaaagtttaaaattgtgattgtagggtcagggttaaagaatgttgctttgctggacgggcgcggtgactcatgcctgtaatcccagtgctttgggaggccgaggcgggcggatcacgaggtcaggagatcgagaccatcctggctaacacggtggaaccctgtctctactaaaaatacgaaaattagccgggcatggtggtgcatgcctgtaatcccagctactctggaggctgaggcaggagaatcactttaacccaggaggcagaggttgcagtgagcggagatcacgccactgtactccagcctaggcaacagagcgagactgcatctcaaaaaaaaaaaatgttagctacgttaaactatttggtttgttaccaaatgcttttttttttcttttggcaaaaaaatattaaggatactttgctttaagttctaacaagtgcaactatatttctattaaagtgagtatgcacttttgaataagataaaatttaacatgataagatttctgtttctgtgtgtaaaatgctatttcttattcctacagcttctaagaccacgagagaaaaagttgggactaggtaagtcgtgtaatctctaacccctcacacctgctgcttgcttggtgacatgatccagtgtgtattttcccagtttggaatagggccaaaatacagtaacttcctatgatggtttttaatgatcttaatgacatttaaatggtataacttgggtcgcctgtataagtcaagacccactcaggaaaacagaaccactgtaagtctttcagtgtagggaatttaatactgagtctctggttacacccctgaaggagttcctgagaaaccaaatggagcagtgaggctactaagattagtaacagctggaggtcactgccacccctagggatggagcaacggcaggaagagatgttagagcccaagaacctgggctgcccagagggagctagaatgatggggcaggggctgcctggcaggagctagaactgtgggaaattcccagtcagaggtaggagggagagtaacagagggaggaccacttagacttttcccttttcccctccctgcagtcttccacctgtacctcccaaagctgtttggcagccagttgacaagagaatctggaatatgtagttcacccaatatagcacagagtagggaagggccagagaatgggtctgagggcaaatatcttggaccagcatgctgcaaaccttggaacatcctttaagttacaagtttaaaaagttactcttcatttaaggctgggcacagtggctcacaaatgtaatcttagcactttgggaggccgaggtgggcagagcacgaggtcaagagatcgagaccatcctggccaacatggtaaaaccccatccctactaaaaatacaaaaattagctgggcgtcgtgacgcgcatctataatcccagctactcgggaggctgaggcaggagagtcgcttgaactcaggaggcagaggttgcaatgagccgagatcacaccactgcactccagcctagtgataaaaacagttattctttatttttaaaaaaggaagcttttccagcttttaaacatacagcattattgaaaagctcatatgagctcagtaattctgagaggaaactctgcctttatttgtgctaaaacttaacatgaagaaagcacaatgcttaactggagtctgctatcttgaagaccatcaattcccaagcatcaaatgttctcagtatctgaacccagaagattctttgggattcaaaaaaatctggaaactgccatgaaaccaaaaagtgtaaatattcactcctttatctttctgagacagtcttactctgatccccaggctggagtgcagtggcacaatctcggctcactgcaacccctgcctgctgggtttgagccattcttgtgcctcagcctcccgagtagctgggattacaggcgtgtaccaccatgcccggctaatttttgtttgtttgagacggagtttcgctcttcttgcccaggctggggtgcgatgacgcgatctcggctcaccgcgatctctgcctcccgggttcaagcgattctcctgcctcagcctcccaggtagctgggattgtaggcatgcaccaccatgcccagctaattttgtatttttggtagagacggggtttctccatgttggtcaggctggtctcgaattcccgacctcagatgatccgcctgcctcggcctcccaaagtgctgggattacaagcgtgagccactgcgcctggccaattttttgtatttttagtagagatgaggttttgccatgttggttaggctagtctcaaactccctgacctccagtgatccacccatctcagcctcccaaagtgctgggattacaggcatgagccaccacacccagccgatattcacttcttaacaaaataagttagaagagttcagccttgctcataagacacttgtgaggggtctggactagagaatgcaggaatccccaagtcctgctcctaacaagttaccctagcctgccaagtccctgtgggactttgaggcatggagctggctgagtaattgtcacctaggcctttggccccaaataccagagcaagggtctagcgtaccaggtttacggtgtaaaagacaagaaaaagggaattgaaatgttttggatggagaatcaataggacttaattacagtttagaagttatggttaaaggcaggaaatcaagaatcatctctagacctgtggatggagcagttggatagttggtgcctttcctggagaggtggcctgtaagagagaggtagagaattggaagatgattttgcaatgttatctttgagatttctgaaatacccaagtggagatattaagtaggaagctgatttgtaaatgtggagctcatcagtgtcttagggggatgccaaggaaacaccagatgggtttttaaagcatgagaatgtgataattgtgctacataatcttagacttttgaacttataaactatttctttgctatactgaaatagaggtatgatctattgtattaaattgacatctgaatgggggtgtgtggccagctaccttcttgattatatatgtaatatacatgaacttatgtacttaaggtgaaaaataccaatttattaatctgacttttagagaactaatgtgtgctcttcaggtgctaaacaatttccttgatgttcaaatgtatatgtaaagatttctgttgattttcttgaatggatctactttcatttttaggaactgcatatattcatggaatgaaacatgccacaggaaactacatcattattatggatgctgatctctcacaccatgtaagtggtatgtttctttattagctatttatggtagtcttagcctgttttactgacttactgtttattcttttcaaatttcagccaaaatttattcctgaatttattaggtaggtactatttctaatatttgaaagaaatatgactggaaacatttatcttactggttttgggcttattttcattttttattaatcaaaaatacacatactattttttctatcaaaaatataaacaaagtttgggaagtcagggtaggagggttgcttgaagtcagcagtttgagaccagcctgggcaacaaaacaagtacttgtctctacaaaaaaaataacaaaaattagccagacacaatggcatgcgcctgtagtcccagctactcaggcggctcaggtgggaggatgacatgagcccaggacttcaaggctgcagtgagctatgatcatgcctctccattctagtcttggtgaccctgagacagagtgagaccttgtctctaaaatatttatctgtatagatagtagacacacacacacacacacacacacacacacacacacacacacaacacacatttgagactaaatgatgtattttaggagtcctgaggagcaaatcaacaggtagttcgttatctgaattctttcagaccacagaaaaaggtggaagatggcttctctgataaatggaattaagccttgagttattagaataaaacaccgtgaacaaaagggtttattccaggaatgccagaatggctcattattggtaatcacttataattcattcattatgttaacaaagtagtgtggttaagtctgtagatgctaaaggagatattatttactaccattttctagttaaaactttaagaatagaaggaaacctcttaagcataataaaaataacccagtcctaatacaaataccacaccaaatagtgaaatgctgaatcatttccaatacatgcattaatacaggcatgctagctatcattaaacatggaaatgttaatacagtaagataagaatttagttaaatgttagtaaaatatacacagttatatttgtttgtaggcaatataattaaattcttagcccaaaagaccacaaaacctctgtgaataagattttggaagctgttctgagtttaagctagatacataaaaacagaatcagattattgtccctccagttcagggagttcagggagttcccactaacatctagggaaaaatccaagttccttcccttgtccctcaagcccctatgtgtttgttggcccctgcctccctttctgacctctgccttgtgctccttcctttttgctttccatgccatagcatgcttctgagttcacagagttccattttcctttgcctgaaatgctgtttccatgctccttgatgaccatctgctgctcatccttcaatctctgcgtaaagtcaccttagaccttttttggttatatctccagtatacaaaagcctctttaacctgtagagtagaaaatgggcaaaaagatacaaacagaccatctatagaagaaatccaaatggctaataaaagaagacgttcttcctgggatgtagtcaaggaaataaacacaaaataactgtgtgtgaccattttattatccattagtttaacaaagttaaaaacttttagagcagtagtaatatccagtaccaataagatggtaaaaaatggacacacaaatattgctgaaggaagtataagttgctataacccttttggaaaatatgtgttcaaatttgggaaaatatgtgttagaattaaaaatactcaggcttggccgggcgcagtggctcacgcctgtaatcccagcactttggggggccgaggcgggcggatcacgaggtcaggagatcgagaccatcctggtgaacacggtgaaaccctgtctctactaaaaatacaaaaaaattagccaggcatggtggtgtgcacctgtagtcccagctactcgggaggctgaggcaggagaatggcatgaacctgggaggcggagcttgcagtgagccaagatcgcgccactgcactccagcctgggcgacagagcgagactccatctcaaaaaaaaaaaaaaaaatactcaggcttcatttgggcaattccagtatattccattttggggagtctaagcagtaatacatttataaaaacgtttattgtggccaggcacagtggctcatgcctgtaatcccacactttgggaggctgaggcgggcggatcatgaggtcaagagattgagagcatcctggccaacatggtgaaaccccgtccctactagaaatacaaaaaattagccgggcatgatggcactcgcctgtagtcctagctacttgggaggctgaggcaggagaatcacttgaacccgggaggtggaggttgcagtgagccgagatggcgccattgcactccaccctggcaacagagcgagactccatctcaaaaaaaaacaaaacaaaacaaaaaaagtttattgtagcactgtttattgtggttgagagggtagggcaccatggaaacaaccacagaggtgtgtgagttgaatattctatgaagtagttttgcaattattaaaaagaatgggaaagagctctcttgacctgtagggatgtctatgattccatgatttgcattgtttttgttttgagatggaatctcactctgtcatgcaggctggagtgcagtggcgcagtctcagtcactgcaacctccacgtcccgggttcaagcagttctcctgcctcagcctccagaggagctgggaatacaggcacgtgccactacacctggctaatttttgtatttttagtagagacagtttcactgtgttggccaggctagtcacaaactcctgacctcaagtgatccacctgcctaggcctcccaaagtgctgggattacaggcgtgtgccaccacatctgaccccatgatatgtattgttaactgacagaaaccaggtcacaaaatgtactttttttgcatcccaattttgtaaatgcaaccaaaaatcctaggggtgtatgtttgtctttatctttctctaggcaaagaaaagtgtggcaggacatcaggctgtttttagtattatttgcttcaaagaaggcaagaacagaatggaagggtattgggaaaattaattattttaatttgagagacaaggtcttccattgtcacccaggctggagtacagtggcacaatcacagatcactgcagcctgaacctccctggctcaagccatcctcccattgcagcctcccaaatagctgagactaaaggcatgtgccactgtgcccgactaattttttttttttttttgagatggagtctcactcttgttgcccaggctagagtgcagtggcgtgatctcagctcactgcaacctgcctcctgggttcaagtgattctctgcctcagcctcctgagtagctgggattacaggcacccgccaccgcgccaggctaatttttatatttttagtagagatggggttccaccatcttggccaggctggtcttgaactcctggcctcgtgatccacccgcctcggcctcccaaagtgctaggattgcaggcgtgagccactgcacccagcctgtgtcgacttctcttaaaagttttgtttgtgtagctcatgaaaatgactgttgaaagctcagtggctttttctaattgacagctaatttattctacaggaagcaaaaggagggtaattttgatattgtctctggaactcgctacaaaggaaatggaggtgtatatggctgggatttgaaaagaaaaataatcaggtaggtacatgtgttacaacttctttattagtataactactggaaatgtattcatagcaagtatttggattagctatcatgctgcccgggatttgtgggatcaggttataacttccagtaaatactcccagatagtttcttacagtttttcctgtgattagagcctggatgttttttattaaggaaaaatcagcataaacctttggacctttggtagaaatggtctcattcagcaaaagttactgtactggaccttcagttttaatttatgtgacctgttctatacttttggtctaaatatgtagggtttctccccataattatagtgtaattttaattaagattgatttcagacagacctgggttaaagtcttaactcactgcaacctctgcctcccgggctcaagcaattctcctgtctcagcctcccgagtagctgggactgtggacctgcaccaccatgcctggctaatttttgtttcatagagatggggtttcaccatgtggcccaggttgccctcgaactcctgagctcaggtgatctgcctgcctcagcttcccagtagctgggactgcaggcacgtaccaccatgcccagctaatatatataatatgaatatatatatataatatgaatatatatatgaatatatataatatgaatatatatgtatatgaatatatataatacgaatatatatgaatatataatatgaatatacatattatatgaatgtgtatatatattatatgaatgtattttatttatatatatatatatatatatatatatatatatatattcacttttttttttgtagtgatggagttttgccatgttgcccaggctggtcactcctgggctcaagtgatccagccatcttggcctcctgggattacaggtgtgagccaccgcgcctagccaggtctcctttcattgactaaaaatttctattttgttctagataaataacatttttatgaaattaatgttacatttatgaaattagtatagcattttaacactgttcttcgatgtgtttctcttgtttataaattgtattttgtaaagaagatctgattgttttatttggcagccgtggggccaattttttaactcagatcttgctgagaccaggagcatctgatttaacaggaagtttcaggtacagtgaaaatttccactacttttatataacttcttggctaactttctttacaatggatattttaaagagacactttacatttctaccttgtttttattctgggatactaaaaaggcagactaaaattcctagaagttgctaatgaagcctaaacatctcaaggagacatattgtgcttttcctttaaaaagctgaaggcagttaggtttgtgtgcttgttaacattagtattaaggctcaactgctctttggaatgttgctattactgataatctgttccaaagaatagcatgtacttaattttctgcatttcatatgaatacctacagcattgtctacagaaaaggttaaactctttaatatttatatagagctctctcagttaccttgttctccatatgtttgaggaaatttttgttgttcaatttggacaaagcttcggtccctctgagttttgcgtgtctgtttctgggtgtatggggtggtggtctagatttgctgtagtagatgtgagctgctttgtgtgactgaccatggcaaatgacaaaacttgccagatttttttttttaatctctgaaactataaaatgcccctgcatctactttagtgacccccaagccccccaaacattacttaataatttctactagttgatacttttttccactaaataatgttgattcttgggtcctttgcttaatgcaggaaaatctaggtccttaaatgtgagaattgacacacacacacacacacacacacacacacacacacacaaattaggacctggctgttgacagtcaaaaagaaaaatgaagcctctctagaactaaaatgcaaatagactggagagctgaacttggggatgaaagagaggggaggctataccctaaggctaaagagtcatttgtgatatgattaagatctctgattgcggatgggcgttggctggtggatgggcagtggcttgcgcctataatcccagcactttgggaggccgaggcatgtggatcacttgaagtcaggagttttaagaccagcctgggcaacgtggcgaaatcctgtctactaaaaatacaaaaattagccaggtatggtggcgtacgcttgtaatcccagctactcaggaggctgaggcaggagaatcacttgagacccagaggcagaggttgcagtgagccgagattgcgccactgcactccagcctggcgacagaggaagactgtcaaaaaaaagccaggcattgtggctcacacctgtaatcccagcactttgggaggcctaggcaggtgaatcacaaggtcaggagatcgagaccatcctggctaacagtgaaaccctgtctctactaaaaaatacaaaaaattagccaagtgtggtggtgggcctgtagtctaagctacttgggaggtggaggttgcagtgagctgagatcgcgccactgcactccagcctgggcagtagagtgggactccgtctaaaaaaaaacaaaaaaaaacaaaaaagatctctgattgccatgtggcaacaatgcaaagaatagtggcactcacaaaatctctgtacagcgggaagggccagtgtggatttcacaggccacagttttgatggttttgaataaaaacctagggtaactggtaactagttgtgaagatagaggctgtgaagaaaaacacagcagggagaggaatggggtgagggtggtttgctgcatcagaaccatacaaggattagtggaggggatgggggttgaaggatggcctgggagttctggattttcatgtattgacagcaatgattagctgtgttctgtataaatgacagagcagccaaacagacaaaagtgaacctgttaattgcacaatttttttttcttttttctgagacagggtttcgctcttgttgcccaggctggagtgtgcaatggcgcgatcttggctcaccacaacctccgcctcccaggttcaagagattctcctgcctcagcctcccgagtagctgggattacaggcgtgcgccaccatgcctggctaattttgtatttttagtagagatggggtttctccacgttggtcaggctggtcttgaactcccgacctcaggtgatcctcctgcctccgcctccccaagtgctgggattacaggcatgagccactgcacccagcccaaaaaattttttaaataggctgggcgcggtggctcacgcctgtaatcccagtacttggggaggccgaggcaggtggatcacaaggtcaggagatcgagaccatcctggctaacatggtgataccccgtctactaaaaatacaaaaaattagccgggcgtggtggcgggcgcctgtagtcccagctactcgggagggtgaggcaggagaatggcgtgaacctgggaggcagagcttgcagtgagccgagattgcactgcactctagcctgggcgacagagtgagactctgtctcaaaaaaaaaaaaaaattttttttaatagttaaatctcattgtcttctcataagagtggtggtttcttaaatacatgcattaaagttcatttgtcgctagacaaagcccatttttgtcattaaatccctagatttaggaagaaggtgctttttacaaaataagaaaaggaatcctggaaaggctacagtcaatataaagccatttaatagcatagaccacctggatcctaatcgcatttatgggattatatggcttcatgtaacattttattttactagccacagtgttaaagttaccatgtggatggggaggaaggaggtggcagtgaaaagaaatatcttagaaaatgattcttaaggggaataaagcaactcttaaagagaggaaatatttcatagcctaatcccaattttaaaggtaatgctggctggatgtggtggctcacacctataatcccagcacttttgggaggccagtgatggaggatatcttgagcccaggagtttaagaccccagctctggcaacatagtgagtctccgtctctacaaaaactaaaaaaataaaaataataataataataataactttaaaagttattctaagttatttagcaattatttaatggcctttcttgcttagcctggcatggtggcacatgcctgtagtctcagctacttgggaggctaaggtaggaggatcttttgagcctggaaagttgagactgcagtgagccatggttgtgccactgtactctgggcaacagagtgagaccttgtctccaaaaatacaaatatataaataaaggtaatgtggaaacatagtcccatcagtatcatagttcttcccaccccacaatcccagtgctccctcccctaacagcatctgacatattatatatcttcattgagtttttaagttcacttcttaaccccaaaacataaaaaaaaaacctgaaacccagtacattggtcaataaatatttattattgaataaatattgctaccatcagattctcctctctccatatttattccaaattgattcctttgaatccttaaggaaactatgtggataaaggattgcacacactaagctgtcaggtttttctaagggctgtgctgtcctatacccacttcatagtcaaaagataaggtcgccttagaagtctgaggggaaaaaaatgtggattcagggtgaaaccctgaggcacagtaggtccagatggccttaactttgaagagaacaaagttacaccaaactgcctcttcttgctttctcccctctccccacaaaaaaaggtagaaattgctgcctccctatgaactgagacactgatctttaaaaaaaaaaaaaaaaaagtgtgactctgaaaatacggagctccctgctatttagttactgaagaaagtgcttgggtctacccactggactgcccaactccgctgtctttgtaaatctggtgtttggcctgcagtccatctaaagttaggctgcacattcacccactgttaagtgtctaactgtgacctcaactggtgataggtgaatcccaccaggattgtttctatcctgtgatgcctcgttcctgttttaacctagcttcccaagctcatcctagagcaacttagtttatcctggggaatttataaaggaaatcatgagaaatcaaaactcatcataaacatttattggaaaatgactgtgaattatgaggttctttcttgtcatctaacatatatagttgcttcatgatcatctgtccaccctgttgttcaatatttggaacagtttctttcaactttaaattttagggaaatcttaaataatggatggttctgcatcaaatgattcattttaccgtatttcactaatttctgatagtatggtgggaaaataattctataaaaagataactgagaattcattttcacaattattctaagttatttagcaaatatttaatggcctttcttgcttaggacaaatgtatcataatcatcaagtgtgcgagcttttctgtttaccaatggccagtgaaagttttaggctttatacataccagtgaactctttgaaaggtcaggatacataggcatgtgtatttatccagaagttgatatatatttttaatttcttacagattataccgaaaagaagttctagagaaattaatagaaaaatgtgtttctaaaggctacgtcttccagatggagatgattgttcgggcaagacagttgaattatactattggcgaggtatgcaactgatgctaaatagtgtgtcatgttcctggtaaaggagcagtaaggtttagaatttttataataaaaagtttaactttcataactgctaaattgtggaggtcttctagttgtttagaatattcatgcacaaagggtaaaaattcatattagtacatttgaacagtaagatttaaaacattaacagtcagcattctcttttaaataattaaaagttcctggtactttctcaatcctagccctttcttctaactaatcagcattatggactgagtctctttgcttcttttccttttgtcaccgccaatggccaccatactttaaaatgaatgatgagttccatatgtccatttcctgttagtaagagaagaccaggaattacagagcaaggaggtggtgatctgtaatatttagggctcgttagtgagctcttagggtagggaagactctcctcatttaatagtaaaactcttattcagagcaagaaaatagctatggaatgtcacttctcttgtggaagttacaagctattttacttaatgctaaaccattgtagctaaatttgacaagtgaaaaatctacgcacaaggccattttacttttggagtataatttttccttgaaatgcaaactgaaacttgagtaaaccaaggtaatacctagaatcagtgctttttaaacagttgcagatttgtttcatgtgacctatctttagataatgcatgtttaattttaaagacttggagatacacacagttgctttcataatcccctaattttatacttactttaaggacctctgttgtaggactaatcctatttctgttgtgttggtaatgtggtataccggctaagctgcctaattgtttttaaagactaacgttacttttttttttttaaactaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagtattgctgccttcattagagtatgtgaatgtagaattttttacatggggaataatttgaaatagtctttttaaaaactggaatcatagatctttatacctaattgatctcagaagtaagataatgttaactgatgaaatgtttatggctgtgtctgtatgaattgaaaaagaaatacacacctctgccctttccttaaaaatgtatctcaaatttcttaaactagaaaatacatttagagcaggcatttacagttcggttcttttcagctgttgaattgatgaaacatttcatctatcaaagcaggtctatttaaaatgcatattgtgaattgggaaacaatttgacagcagttgattacatagccgtttttttctcttttgagcaataacctctatcagtaaggaaaaatattaatgacactgaggcagaaacttagctgctacagtaatttttaaacatcttactgaattatataacaatttttttctcaaaagacttgttttcatattatttaaagaccctcagcaaagctcacatccctactaatttgaaaaatctctgccttaagctcttctctccatttagaaaagtgttctgccagttaaaatttgggctaagctatccaataaagccagggcaaatattatgtttacccactttctctaaagtaggtatttcagaagagatcagttaatttctaactgtagcataggttatggtcatgtagtatcttttaaaatttgagtaagggcatgctttgagcaagtaagtttaagttgactttcttctggaaataaaagtaagaggtgtctctaaattatttattgaacagtattcctaattactacattttcctggcttaacttggctgctgaagaaattgaggcccagcacaatggcccatgtctataatcccagcactttgggaggccaaggcaagaggatggcttgagcacaggcatttgagaccagcctagggaacatagggagatcctgtctctacaaaaatataaaaaaagctgggtgtggtggcactcacctgtggtcccagctacttgggaggctgaggtgggaggttcacttgagtctgggaggtcaaggctgcagtgagctgtgatcatgcctggacaacagagtgagaccctgtcttttttaaaagaaaaaaaaatgaaaatctgatttttcatttgcatttctctctgacagattctaccagaaatgaatcccagactataaaacctgtggtgtcatttcgaacattaaaaccaccccctcccacgcttctatagttgaacccatagtacacattccaataagggccactcttgttctgtttcccttatgtccagaactgtccagctggccagtgagggaactgctttccttagggaagaaacttctctcattcataacaagaagaaaattcatcagtgcttgatgtgaaattagttttaagctaagataatagaaatgtaatattctcagtttttttggagtggttagaatttattttttcttaacctaaactcaaagttgagttctcagtgtcaagtatgtggagcagaaattaagtaacaaccttagagaacctaatatagatagtactgccttctcagatactcactagagtagataatgtttgccttttaaatctttttagttattcacacaatcattatcacaacactgtcactcttggaatttaccatagagtatttgagcagtgaagactcatagcatttggaagtcatttagaaaagaatctggaatatttagatgcatttttgtagtaaatctggtgcttaaacactgtaaaattaaatatttacatctgaatccagcatcccattttgctttgtaaatgaggccaaagatgaaatccagatgttttcccttgtatttgtattatcactatatggaatctaagtatatctaagaaaaactaaacttaaacttactttgcttatttcatattagtttttatctgtcttctgcagtgt

SEQ ID NO: 16161 - DNA, 72742 bp, Human
ggtgctcaggtcgttgaatacaaattttaacagctctccaggtgattctaatgtgtagtctgggttaagaaccactggtctgagtgcaattttgaaaaccccgttcataactgtgctactttgctttcagggcataagcatgatgaagggagaggctgtggcttgttgatggttgcatccccaacatcttgtggcagtgccaggcaggtgctcaataaatatttgtggaatgatggatggcttggcacaaatccccttaatggagctgagatggctcccctgaagaatgcgtgtcctcaattcctcctggcacatggggaaggattcgaatcacttgaggtcaagctgtggttctcacgaggatcttaagacctctcccgtctaatcttctcatcctcaacactggctgcaccttagattcatctgaagtttaaaaaaattttcaggccgggcgtggtggctcacacctgtaatcccagcacttggggaggccgaggcgggtggatcacgaggtcaggagatcaagaccttcctggctaacacagtgaaaccccatctctactaaaaatacaaaaaagtagccaggcatggtggctggcgcctgtagtcccagctactcgggaggctgaggcaggagaatggcgtgaacccagaaggcagagcttgcaatgagccaagatcgcgccactgcactccagcctgggcgacagagcgagactccgtctccaaaaaaaaaaaaaaaaattaggaattctgcttcagtgggtttggattgcagcccagcacgggagtttaaaaaggtgtcccaggtgattctaatatgtgggaagggttgaagaccactgttttgatcttttctacctctgtgagtctgtttccaacttcagctaagttggtggagccccctggcagagttttattggagggtgttctttagttactgggtccttatgcagtgtttgccaaatgtacctgttcattaatgctcacgttgggtgcttaattaaaaatacacattcacgagtctgtattcagacttatggaatcagaagctccagggaggggcctgggaatcatgctttaaacaagcagccaggcgtgtttgtcacttgccaaccgccccatcagaactgtactcctcgttctccctccagcacacccagccccttcgagctctggctctgtgttttggttctcactgccagaacacacttccccaagatcgcctcatcaatcaggtttcttcaaatgtcacctcctcagagaggtcctccttgaccacccaagggactaaagccaccccaacctttatcccataccctggtgagttctctcctggccccataagcagatgctttttgtcctgtttctctccttcaggcctctcccactaccagagcctgagcttccgagggcaacagtgtctggctccggctgggtgcccagcacctggcacgtggtaggtggccaggaggcatagctgtaacgggggggactagtgctgtcagtccgattccttcctaggcgctggggagttgagttcagggccatgcaggtgtctgaagtactgtgaaaatcatgccgcccccgtgggcacacggagacgcctggagacacgggtctgcaatagaagggggtggatacccccttccaccccatggagaagaaaagcaggaaaaagtgtggggccagtgggtcccttagggcaaaagtcctagtggcggcagctttcttgtctagaccctggttcgcgcagcgcgtgtcgcactcacccgtggagggtgggagacagcggccgccccagcgcccagcggtggcccgggacagtgtggtcaggtccgcggacagcctccttcctcccggcaccggccagcccaggccgcgcgcccctcccctccggtcccctggtggcggccccgcccccgccggcctggccgccctgtccccgcctccacgccccccccccccccgcctccccgggctgcaacaggtgcctccggagcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaaggtcggtggaggctacccctggcctggcccctgagcccgccaggggctcaggcctggggactgggcacaggagtcctcttggctccagccgtcccccttcctaaggggcctggagggagggtgcccctacccaggtgccagggaggggaggcgtcagtggcccctgccacccttagggggcggtcggctccctcttgccccttaggggcaccagtttctggttgctcatgactgctccctgagggtcactctcagcaaaacaaaaggtggcaggcaggtcccaaggctggggggcgggtgctgtctgctggcctcttgcctgggactgggctgtcaaagggcaagggacatgatttctgtgcctttggagggaggaggtgaggaagcgaagaatggagttagcagggaggagttgccaaaaaaagaaggaaggggggtgcagctgaacccagttatcaagggtaggaggccgctccttccctccaggcactgaagtgaggccacgcagctcccatcacctcctgtgagcagtggttgacggggactttgtgttgaaactgaggaagaggttgtctgtctgatgctggagagggttaaaacctttggtattataaggccggcccatttcctccctgggttctgctgctgaacccatcacttaccactcacaagaggattggtctgagctatattaagtgatcttctacgcttagtcctaatggatgtggtgggatggggtagggtgaggggcagctgcagcatggattcagaaggacacaggctctttctgcctgaactttgtcactctgtgcctccaactgccctcagttgctgggggctggggacttccccgggctgggcccaatgcttatctgtcacttcacgtgtttaacaggagcattcgttagagggaggaggaggaggagggggaagcggccacacgcccaacctcactgtgtatttctggttagcaggttgtcttggaaaaaacaaaaaacccaaccaggcttcctgattttgacagcccagcccagcccagccaatgcttgttgaaggctcagtggcaggcctgttagtagcttccagacgcactctgggcttgcctccatctagtgtgtaggaagggcttgtgctgactggctcgtggaggaagcctgtcaaggaggcttggtggcctgatgtttcccacaaacactgtgttaggcagataatgaagttttcgcttccatcggtgtcctctctggccacgttaggtgaggggtttgctttagctttgggtatcctcttcccttggatacccagagatggtcattagtaataattttgtgtcttggctggagatggaaacaattagccaacagaagagaccagtcttctagagttgcaatctggaggacatcttttgctttgaaaagatacaattaagaatctgcaaacgatccgcactaatatccgtggtctttctgttcattaagattaaagtcatgtttttcagggaacgaatactcacacccctcccagattggtaatcagcttttattttccttgtcgggtggggtggggggatttccggggaaatagtttccaagccaaatctgaagggaggtactttttatggtttttcttggcaagtgctgcttggtggccaccagatgggtatctaaatgaccacaatgaaagccctggaatctgttttctcaaaaaaaaaaaaacaaaaaaaaaacttcagtttttggaacagtttcagatttacagaaaagttgcaaagatagcacagagagttcccatatacccaataccctgtttccccgtgttattaatgttttacattagtatggtgcatttattgtaaccaacaaaccaatattgacacattattaactgaggtttatgccttattcagattgggaatgttttatgtgaccttcactgttttgaggagtgttggttgtattgtagactgtcccttcattagactagggctctaggttttcgggaggaagcccacaaagataaagctcccttctcatcacatcgtatcaagagtatgtactatccagccaggcgtggtggctcacgcctgtaatcccaacactttgggaggctgaggcgggcggatcacctgaggtcaggaggtcaagaccagcctggccaacatggtgaaaccccaactctactaaaaatacacaaattagccaggcatggtggaaggcactgtaattccagaaactcaggaggatgacgcaggagaattgcttgaacccagtaggcagaagttgcagtgaggcaggtggcaccattgcactccagcctgggtgacaagagtgagactctgtctcaaaaaacaacaacaaaaagtatactatccatgtcatttatcattaatgctaaccttgattacccagtagaggtagcttttctcagtttcttcaaactctttggaaggcattactacatgaagcccacacttaaggagtacagagtaatactccagaatctggaaagcacttactctttgctgagaagtaggcagcacagaagagttagcacccagaaagagaagggatgctgtggccgggagtggtggctcatgcctgcaatcccaacaatttgggaagtcgaggtgggaagattgcttgagtccagggcttcaagaccagctggggcaacatagcaagacctcatctctaataaaaataaaaaaataaaacaattagcctagcctagttgcgcatgcctgtagacccagcttcccagctactcggaggcttaggtaggagaatctcttaaccccaggagttcgaggctgccctgagccgtgatcgtgccactgcactccagcccatgggacagtgcgaaaccctgtctcaaaccaacaaaccagacaaaaaaagagaagggacatggtaagctttaagaggctaatgtgaactgccccagatgtgcatctggctctgggtcacccagatgttaatagcagtcacctctctttgcttctgtatggtgggactcctcaggggtgaacactagccttaatctttttattaggttttgtcccagatggcaacatattggtgacgcatgtaaagttctatccttaactctgggcacgagcttggcaaaaaccaaggaaggaaaggtactgctaatggggcagacattgttgatagaattggtgaaggtaaattagggaattttggggaggtcggatgctcattttatggagtttagcatgtagcagacgttcattagcccatgtgattccactccaaccctaggaggcaggcactattatcacccctgttttatggaggaggacgctaaggcacagagaggtaaagtaattttcccaaaatgggcagtgttgctccataccatgtgttctgaactattgtgttagggtcctcattctctcatttggtgagagacacatgcaaaccagttagcaaggtgtctgggaccatggcagggctggaattgaaaaccttgtttaccaacaaggtgatcttgagcaagtcatctcatctctctggacatctgtctgcttatctgtaaaatggctgaaataataccacttgcctcataggaccgttacctgccttgaataggttaacccatttaaatcaacacagcatgtgatctgttactagtggtttagtaaacccttgcttttgttaatggaggtgttcaattaatatgagccattgtttatttactcattcagctattgagcaccctctgtgttagatcctagggtcacaacggggaatgagacccagatcctgtcctctctgagctactgcctctaattgtgcctctgttgttttctcttgtctaattgcattaactaatacctccagtagagtgttacatgatagtgaagacagtgggcatccttgccttggaggaggactccagtgttggctttaaaattgaggtgtatgaattatgtaaaggaagtattagttctttcttttttcccccgagagtttttattacaaatgggagttgaattatatcaaaggcttttttagcatctatggaaaaatatgatcttattcttcgtagacctattaatgtgttggcatacattattagatttctttatatgaagacatccttggtatggactccacttggtgtattattttcttaaggtggttgtggcatcagataatatttaagcatttttcagtattcatgagtgatattcatattggcctattttttgtgctatcaggtttaggtttctttccttttctaagctcaggaataatttctgtctccctgggactccctggtctctaaagctgtgatagaattcctctgtgaagccgcctggacctggtgcttctttgtggagttgtttcttgatggctttctctatactgtgggaattggtctctttacactttctacttctactggagtcaatttttgtaaactctatctttctgggaaattatccattttatctgtctaggtttcaaacgtattcactagagatgtgcaaagaagactcttaattttctttctagtggaggagacaaccaagtacacagtgacagaaagacccggtgggcaaggatgtgggagtcctgatggggccactgatcccaccctggaaggggaagatgtgctggctgtcagcagacagttcagaagctgaattcccttatgcatgcttgtgaatacaatggactcttatttctcccaacttgtaatacactgagagagacgggtgggtactgggaatccctggtcacctccagagatgccggatctccagttactgtgttggggacagatatgtggggagtgctcacatctgctttgccttaacagtctggtgcagccctccttcaatttctgctaagctaaagcatttaataccaacttcggcctttcagaaaggaaaactggttccttctgatcactgctggttgttttatagagtctattcctgtgatccttacacttttgaggtcacagccctttaaaaagctgatgaaatctgcagattctatagacacacacacgatgcgtgtgcatgctccacatgggcagccctttcccctgggcactgccccctcaccacataccccctgcaccccccacccacacatccccacctcccctctccactccctctcatatccccccacgtgcttttgatgtcatttctcagcactcacagacccttctgtgtcccattccctaattttactggcacttcagtgtaggaacacctgctctcgacccattcacagggcacaattaaaaccccattctttcagcaaacacactgaatgctggttttgtgccaggccctgtagcagcatagggacaaattagatatggtgtctggcctcccctggcccccaggccaatatgggtcacagtctggtaaacaaatagggacaaatgaggtgctgtgatacagtatctgtgtgtgtgtgtgtgtgtgtgtgtgtgtgtttggtgcttgctaaaaatagtgttctacactaagcaagcaggttcactaaacacatgtgacattcagagacattgccttctgtgttgagttaaggacaggccttaataagcctgctttggacaaataacgtctccaggtgcagctggaaaggtgaaatgagggctagaactgagcatcggccttgcagggaggcagaggaaatgaagttgcctcactcactcttccctgtgaaacacgtggcatcttggcttctaaattcaagcccctgtgttcttttggtggcatagattttgatcaggagtagaggctcctaaaactttaaagcagtgttattcaggttggttctcaaggctctccagccatatcaggtggcaggttaaatacatttgaaaaatgtagaatgggtggcaaggggctctcagtcctggctgcattagaagttctcaggctgcatcctggaccagtgagatcaggttcttgggggtaaggtaactttgctgagagtttgcattggtaagtggcagggcaggccttgaacctgggcactgagcattctaggtccctgccatcagcactatatctcacagccaggatgtggccctggagggcagcaggacaccgtatggagctgctgtctctagctttgtctgatgtgtctcatgtacggtgggatgtgtgcacgttcacctcttatagttgatatttatataattagaaattgtatcttgctactgtcctaatgggattatactcattggaaaactcctggctaaggtagaaatgagaaatgacagggagctctgctatttttctgtttctttctccatcccggtggatggtcctgcctgcctcctgggcatttggatctaaagccctgcacttgaatctttaatgctttttccctctgtggaagaaatataccaaaggcagactgtaagccacatgcagagtggggagattgcttttcctgggttggtatttgggaccctcccgaccttgtaatctgaggttttggaaaaagagcatttcttcagctgggtctgaagggaagaaagtggccagcaaagctcaggatttatgaaggtccttatcaaaacagacctgcttgggcatgcctgcaaaagtgagaatgttaaatgagggggaaaaaaaaccccaagtctgaaatgcctgctaaagttattttaaaggttatggaaaggggctgtttacctgtataatcctaagaaggtgcgctgcaggtctaaaatccacaatgggtgacatcacctctgttgccatggagtagggaggaatgtcttaataaccagggggttggcaggggccactgatgaagtgtgcccacccccaggaacatggcactgaaatgaaagctcctggggaaaagtataaataaagaagctgtcagtcaagaaggcattaattttaaatctctgaccccggccaagggttacacaggccccactgtcttcaagggggaagtttccacttggattttaggttggctgaaagaaaaatggaaatcagcctttcaggctgtgcgaggggatgtggggatcagtaagagaccaaactcgcagaggtggctggtcggagagagggactgtttgctaagttgggcagaggatggaaagaagggatgttcccctgctcatgtcatcttctgcaggcctttgacagagtgggtgggtttagccctggcgagtcctgttgcaggaggattatctgaagtctatttctggggaactcttctgaccaaatctttccttctccttttggtgaggaagccactctgaggtctgttctctgtcatgcattgaactctcttctgttagacgcagaccttgctaaatcacgagtttaatctcaaatgctttaaaaacggagggagttcagcaaggtgattggataaattgtggtggatttgacagtgaaatagtacacagcaataaaaaagaaaggactactgcacacaatgtgggtgaagctcagacattctgctgagccaaataagtgagacatatacatcctgtatgattttatttatgggacattcgagaacagtcaaacccagcatatggtgagaaaagtcagggagtggttcttcctgggcgagggtgtctggcttcaggggggccacagagaaccctctgggggacttgaaatgttcgagtgtgtgtatatatatgcaaaggcacaagatgtatgtgaaatatttgtgcattttacttcatgtaagtgatgcatattttaaaaattaatgaaggccgggctcagtggctcaggcctctaatcccagcactgggaggccgaggtgggtggatcacctaaggtcaggagttcgagaccagcctgggcaacatggtgaaatcctgtctctactaaaaatacaaaaattagctgggcatggtggcaggcacctgtaattccagctactagggaggctgaggcaggagaattgcttgaaccctggaggcagaggttgcagtgagctgagattgcgccactgcactgtagcctgtgctacaagagtgagactctgtctcaaaaacaaacaaaactgatggaatctgcagatcttgtatagacacacgtgcatgctacacatgtacagcccttccccctgtgcactgcccctccccctggcccccgctgcagcccccaccctgaaattgaatgcaagctttgccctgactttttgtggtcttgggaatttccctgcaccccaagcctcaatttccccatctctaacacagaggtgttcggagtagctatctccaggggtttatgtaaactgcagagagaacaggggagcgtacacgtgaaagcttgcggcacagtggacataagctattagaatgactaaaaataggaatatctctggaattctccaaggcaggagggccccaggaaatggcttgaaaccagcaagagacagttcttcccatccagatttgaagatggagatgagtccttgtgtgtgccacatgcctgggccctgctgcccccatctaaaaggtgaccttgaggcctgcgggttgcagattccatacatttctccacccctatccaaaagcaatacgtgtcagcgcgtgggttcgtgtgtttttgcaagcggtcatgccagagccagtctgcaagcctcattgcttgtggatcacctcagtcctgtgtcctgggcgcctggccttgcggcagcctgcctgggaggcaccactgagtccttctttcagccccgtctggggaaggcagacagctgtcttagctggggcaaggtcagcaaagacatcgccttcaggatgactttttccagtggttccatggacgagacaggatggcaaatgtcctccctttcctttttggcatttctggacctgatttatccagatggaatttctcgactttcaggcctgtgtctgtatgtgtcacctccgaacgaagggtgtgacaacctgactctggtcattaatacacatgattcattgattgagaatctacttactgttaggtggtgtatgtgtgtgactgggtggggcgtgggcagcagtggtctgggggcttgtcagaaagtttgctgagtgtcagatttgttatttggaggcaacccattgcttttcaaaggggttctttctctaggttgtgcacacctgccggatgaagaatctgtccaccttcctgctctgttttgggattctttgcggcccctgatgggcaggaagttatgagagttgtcggggcgagtggcaggaggcgaggtttgcctctctgtctgctcccctttcctccggctacagatctgcggtgccagctgtggcatcctaagtgctgccttggcgacagactgtcatgtcccaaacccaggccctgggactcacgccacctcggcatcggggtgagctcatcaagccgtgggtcggatcagcttggccagggatcagtggagccctgtggccctgctgcccatcggaggggcatccagcccccaggccaggccctgcttctctcttcccagccactcaagcctgaaagctccatttgcctctgcccctccctgtgccccccaaggacggctgcctctcagaggttccctagctgggtttctattttggtcatacgattctgcttcccgaaaattccacccgcctgcagttctaggcagagaagatgttctcttgctgttccttttttcaaaagtgatctgttggctggcgggttggcgctgagcgagcggccacctcagacttggctgtgtgtccgtctgcgagggtgagcaacaggctcacagagcttccagggggagaggcgctggcggggaccactgtgtggcctgagtggatttttaaaataatctttgactcaatcctggggcaaaaggagagactgtgaacattcccgaagaaaggaatctgtgtcttcagttgtcaggggcagcccacctcccgagtgaaatgatgaggcccccagagtgatttcttttccgggggggatccttgcttccctgtgtcagggtcagggtgtcgccatccaggaaatcacctctttcctgagatgcaggataaagtagtggttaggggggtggaggagccaggttgcctgagaatgaatcttggctctgctacttagaagctgtgtgaccttgggcaaattactcaccctctctgagcctcattttccccctatataaaatggggaaacgatatcagctgcttcatagggttcttgtgagacaaatatgaacatacactagatgcgtacagttctcgatataaagtaagtggtatagatgtgctagtattttgattatgacaagcggctcactgacccactaacactttagtaagatttagtcgatccactgccaggtagcctgggaggaaaagtacaaagtgtggaatggagagggtgttggaagcacgttttacctcctccacacattttctgaaggtcagcaggatctgaggtaaaaagagaattcctaaagtgctgaccaacccattttatttttataaaaatgtcttcctttttttcgtaatgctttcgaaggggttggggactagtgcgttcaagttgttgtaaaatagactaactatagcagggaaagggcagaattgtcaccgaaaagattgttctttcaataataatccagtaggccccatttactgggtattgattctgtgtgtcttgggctttgcataggttagggaaaccgacaggcttgtatcatcaccagtgtcatcaccccgtgtcacacatgaggacatggagtttccccaagtctcacagccgggggtgggagtggatctggagtcccctaaccccgtgctaccctctgttgactgagacctggatctcagcgtagagctcttgcttggtggggcaaagaggagggctgaactggcctccccagcaatcttgtcctgtagtttttgggagtggccagagatttctccacatattcacagggcctacctattgggtaagcacccaggaacttgatgaaaggaggggtgataagaatgagaactttcaggtgtctgccacagagatgagcgtcacctgccagggctgagagtgagaagatgtctcatttctgaatcagttcaggttgagggcgtgagtcatgagttgatgcttccagcagtctttgggcctctgctgtgcgcaggcctcctgtgccatgctggggctgtaaagccaggagccgtggttctcagctgggggcgagcctgcctggcaggagatgtttggcgatgcctggagacatttttggttgccacaacggggagagggacagggcagctgctattggcatccagtgggtaggtggctgtgaggatcaagtaatttactacatgtaatgtgcttataacaatgcctagcatgtaagttctcaatatattttagctgctttttctgcattataatcatcttcataataattattgatgtaagactcctatctgcctctaagaacctcagagtctagagggtagacagacgagtgaatccatagatagacttcaatgtgggactctgtgggacctgggagtgtagaagagctgcctgatccagcctggggaaacagggagggcctccaggagggggtggctcaggtcaagtcatgatggataaatagtggcttgttaggagatgtaaggtcgggaggtatggaagggagttctgggtaaggggaacagcatgtgcgtgacatggaggtacagaggcccttgagcagcaacctctgaatcccccatccctgcttctatcttcttcctccctttggtactgatgcttcgtatgcaggccaggtacctcccatggtaggtgaaatggattttaggtggtccaccagtgaggacgttgtacgtgctaagaactatttttcagcgctattttctctttgaactagtcagaaggagtggagtttcaggccaggcatggtggctaatgcctgtaatcccagcactttggcaggccgaggtgggcagatcacttgaggtcaggagttcgagactagcctgaccaacatggtgaaaccctgtctctactgataacacaaaaaaattagccgggcatggtagtggtcacctgtaatcccagctactcaggaggctgaggcaggagaatcgcttgaacccgggaggcggaggttgcagtgagtcgagatcgcaccactgtactccagcctggcaacagagcaagactctgtctcaaaaaacaaaaaacaaacaaacaaaaaaggagtagcgcttcagtgaggtactgctgtaccattgacacctttctttctaacactggctcctccctttccctgttcctaggtcttgactttctggggtcttggaaatgttccatattttgattatgttggtggtagcaagaatgtatgacatttggcaaaactcgtcaaactctatactcaaaacactgacatctgtgtatatgagttataccgcagaagcattggcgggggcggggctgtataaagcctcagactcagagcctttgcccagccactgtgtcttgcttgaatttagtaagttttatttttattgtatttttaccctaccttctatttatggaggtgacattgattttccatctgcagtagtggtgtaaagtttccttttaaaataaaaaaaaaataagtgagtgaatttaaatactagaagtattaagtaaatactttttggtggcacatggatagagcaaagatcgtgcaagtggttaaaaaaaaagcaagctttttggaaatcctcctgagaacatttggtggttctgagatgaaactaacttcacccagtgccgtgcgggcatcgtgatgactgtaagaaagccgcctgtgagcgtggcagttgtttaaggagaaatagtgacgaatctcagccactgacttagagaaatattttaatgatgtgctatttgtgaaatttactgtcaaatacccaggggactgagaattaaatgattattaattatcttcatattccctgcttgctggtaaacatttaaagtcttgtcaagaggaaaaaaaaaaactgccgcttggattaatgaaaaccaatgtaaatgctttaaatacttttgctcagcacactggagctttctgtttttcagagctcctagggagtgtgagtgatgtgtgttttcaggactgcgtttctgtggactgtgcacatcagccccaagggtgtgtttctgataagatacagtgcagtttttctgatacggccggaatttttgctaagaaactttttgtgttttgtttttctggttcgaagggcagtgaattctcagaatgttgtcggccatgggtttgacattcctcttttcctagattaaaactctgtgctctgttaccttctaggaaggcgtgtgtgtgtgtatgtgcgaattcaaatacacatttacattaaactacagcctcacaagaactccaggccttacagatgctagctagaaaaatcaaaggatttcagagccagaagccaccaaggaaactgattcagtttaatgctgttcagttataaatgagaaggtgttgaggcctccagtgggtgggggacttttccaaagtcacgctgctacttagtggcagagcaggactgcactcttcatttcctgcttcgtaaaacagggtttcattactgtatatcatgctatgtcacctaccacctatgaaataaaattaaaaatgtttcttttgggagttacatttattttcttacacaattacacaaatcaaaggaagtctcctttctgccatgccactgtcctcccattccttagttcccctccctggaggatgtcactattacttgtgacttccagagaaagcctgtgcatccttcagctgtgcgtgtacatctgtctgtgtgtgtacatatgtgtgtgtacatctgtctgtgcgtgtacatctgtacatctgtgtatatatgtgcaggtgtaatctgtatacatctgtgtgtacatctgtgtacattgtgtgtacatctctctgtgtttgtgtacatcctctcactttttatgctgtgcacactatacagcttgcttttctctaatactaaatctcagtggtcattccatgtcaatgcataaagaacttcttcaggcctttttgtagctatactgtatcccatcatatgaatgagccagaattaattcatccccaatagatgggctttgggttgcttccagtcttttgggattacagtcagggttgtagtaatgaatcttaagcatacacaggtcattttgcacaggtgagagtatatctgcaggaagaatttttttttttttttttttttgggacaggttctcatcctgtcacccaagctgggaggtggtggtacgatcatggctcactacagccttgatcctcccacctcagcttctccagtggctgggactacaggtaggtgccaccatgcccagctaatgaaaaaaaaatttttgttttagagatggggtctctacgttgcccaggctggtcttaaactcctgacctcaagcaatcttcctacctctgtctcccaaacggttgggattccaggtgtgagccaccatgactggcccaggatgaatttctaaaagtagcattgcttggttccgagggcacatgtggttccgggggcacgtgtgtttggaattttcatggatattacaaaatgaccctctctagagttatagccttctatcttttggtttggatattagcatctttgagtaatagtttattccaggtagacttttctgaacttgcctcattcattcagccaacacatcctttctgagggcctgtttagtggcaggaccattccaagtgcttaggggcatggcggagcaagagtcctcatggcatttgctgattggtgggggtggatctcgaggtcgagggaagggcagactggaggtcgagggaaacggagcactccacagttcctcagtcgttatggtgagatgtgcacagaacacagcaggggcctgtgagtggggcctgagctagtcaagtggtcaggggtccttctagaagcatgcagtacttaagcccagctcatgggcatgaatgggctttagtcctgtggagaagggggcctggcagtgggtaggggaggagctgttgaggcagggagagcagcaagtaccaaggtcccggggcaggaaggagcttgatgcttttaaaaactcccctttgccagacacggttgttctcgtctgtaatcacaacactttgggaggctgaggtgggaggatcacttgagctcaggagttggagactagcctgggcaacatagtgagacctcctgtctactaaaaataaaaaaaaattagctgagcccggtggtgtgcactggtagtcccagctacttgggaggctgaggtgggaggattgcttgagcctgggaggtggaggctgcagtgagctattattgcgccacagcacttcaacctgggcagctgagtaagacctcaaaaacaaaacaaaaatcaccacactcccctttggctggagttcagagagagggaggggagagagtgaatgcaggcgagggtagatgcacaggcagggcccagccaggctgcctggcgggggtcatttatttttacctaagagctgtggggagccattttggaagtaggggtaccatatggaccctaagagatcagcttggctaaactggacagtatttcctctaggatagcccagaaagggaacaaggaggctgaggctcactggggtggccacctggggtcccccaaagcaggaagagggcttgtttctggctggcaggccccggacatggttcttatatttacttattctctcagccactcagcaaatgtttatgggggcttgcaagtgccaggccctgtggtaggtgcttggcagacaatgctgggccacagtgacacgggcccaacactgacggagctctgggtcgagtgtggggttgtaaaattctctaaagggccaaggagtaaatatttcaggctttgggggccattcgattcccagactaccaactctgctgttgtagtataggagcaagctgtagcttgctttgttcaccctgtgtcaataaataggctggctgtgttgtcataaaactatttacaaacacaacccatgggccgcatttggcccatgggctgtggtttgcctgcacctggtttggcagaatgagattccctaaacagatacctggtgcgacgggagctgttagcaggcgtcagtggagaaaagatggcagggaaaagggaaggaggggatctttttgatgggtcgatctcaggaggtgcgggctgagcagatgcaggaaggaaccaggggaagtgggaggatctcgcggggagggtttccaggcagagggaacccaaggcgtctgaggcaggagctgcttaagtaccgcgaagaggttggaggggttgttgctgactcagcttggggagaagtggggagtggtgggggtgggtggcaggccggggcacatgctgcgttagtgactttaggttccatctaaagtgtccagaagcctttatagtaggttttgagaatggacattttaaaggctgctgcgtgacaaacagactgacagagccacagaggaagtggggaggccagggaggagatgactgcagtagtccccatgggagaggacggcggcttggaccagggtggatgcgatggaatggggagacctgggaatctagtttctgttctgacagtggagcagtcagggctgatgatggatcagatgtgaggcatcagagtaaggagtccaggccgccccatgagctggcggggaggttggaggagcctctgatgaggtggggggccttggaggtggagttgctgtgaggggtgggtgggtggcactaactccgtgggaatttcccaagcagccccacgtgcctggacctgtacaggatgcagtgaggcagggtgtctgctagaagagggtcaggctgagaattaaatgacagtgtgaggtgatgggtggcagtgtccttgggtggctgacatagaacattctacttgaacagcattctgcagcggtagggcctttcgaggtggcagcaggagcccgggctaggcagccgctaaaaaaggaagttaggtcattttgcagtcattggttttatctttattttagtgtattttattttatttttgagacagagtctcactctatcacccaggccggcatgcagtggcacagtcttggctcattgaaacctccgcctcctggttttaagcgattcttgtgcctcagcctcctgagtagctgggattacaggcctgtgccaccacgcctggctaatttttgtatttttagtagagatggggtttcaccatgttggccgggctggtctcaaactcctgaccgcaagtgatctgcccgcctcagcctcccgaagtgccgggattccaggtgtgagccaccacacccggcctgcatccattgggtctaatagtttgggtgtcaggtaacctctgtagcagtgaccctgcctgttggggggcaagtggcttgcctgtggtatttttaagcctgctaattccgtatctttcggtgggccttttccccgctctgggcctcagtttcctcatttgtaaaatgacacagatgagacatgagtcaggagccctggatctgaatgaagccacttcttgtacttggtgtgaaatctgggattgaagcccagggcactgtgggctgcagagtctgcgcagcctccctctgtgtcctgcgtccacgtcatgtgtgtagagtgctgccataggccctagataggtgcttttcaaactaggggtcatgacctaccgcgcggacgggttaggggatccgtctaatgggtcgtgaccagcgttgaagcaaaatcactcaggcaggagggagggtctgagggtgtcatgtagcaggggtaagtattgactcgagaggcttttgtttcagttgtgggtgtatatggtggcgtgaatggggttgtgagataaagtgcacttctccgaagggtttcatttaaagccaagtttggaggcccttagcccaggggtcttccagaactcattctgcttcgacctgtcttctccagggacctgggacaaagtggcctcagttttcttctggtgagggacggagcttctagcttggggtttggcatggtgggaatttgaaaaaaataaacgacgtgagacgaaatccagcctgtgattgctctgcaccgggagttctgtttttgaggcttaaaaagaacccccttcccccttctctttccagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcaggtgagcagggctttgaaaatgattgattctgtggtttagttttaagagatggttttctggttatgagcatgggattcagagtcaggtttaagactgactttaaatggatttaaatcttggcttggccccttgctggttgcgagaccctgagacggaagttaaattcccgggccaggtttttctcatctgtaaaatgggtataattcgtgtacctgactcaccaggtggctatgaggatgcagtcatgataaatgtaattgctcatatggcacctggtttattcaaaaagtgtttttcaaacatctaggtggcagattctgttacataagtaatggagagacagtggtgaactaaacaggcaaaaatttctgccttcatggagctgacattctggtaggcacaaagcaagccttaatatgtaaaatctatctcattataagaggaagtgatgtttgttagcatctgctgtgtgccgcagttatatggaggacctaaaaaaaaaaaaaaaaagaaatatgtgagccaaggagcttaaagtcttgggaagctgaggagatgtatgtagatagcagaatagcacgtaggctttggagtctcttaaggctcgctttgagtcctgcctccgccactcactacctgagtgaacacgggcatctctgctgctgcctttctgctgctgtgcttgtgaaagacattgctaatcagtcagcaccctctttctcattgggcacctttatgaagccgtgcctagcgcagacatcactaatcaatcaagagcttccccctccccgacccccccgccccgcttttgtactgagcacctttgtggtcttggtttactccctgtgagaaaataatagaacctaccttgtgtttttttaaaaaatggattagatgagatgatatatgtgaatctcttagtatagagcctgtgcagtgatatcctgggataccaaaatctgaggatgctcaggtcccttatgtaaaatggtatagtatttgcatataacctatgcacatcctcccatatacattacatcatctctagatgatcataccttagaatacctaatacaatgcctgcacaccacatggactcaaagtagaaactgcagcatggaaaattcaaattttgctttttggaactttatggaattttttttctgaatgttttcaatctgaggacacagaacccatggatacagtggatgaattgcactctctatgtatgttatttcatttgattctcacagaaacttggtttgtattattttttatcttcattttgatgaaatgacaaaggaggtacatgagggctaaggccagagattatcctatctgttctcctacatgaggaattggaagactcatgctattaccacgatccctgtggttttcaggttattttttattttagcaaatggaagccttttatccccaatattaaatggagtccccaaataggccgggtgcggtggctcacgcctgtaatcccagcactttgggaggccgaggtgggcgaatcacctgaggtagcaaattcaagaccagccttgccaacatggcgaaaccccatctctattaaaaatacaaaaaatagctgggtgtggtggtgcatgcctgtaatcccagctactcgggaggctgaggcaggagaattacttgaacctgggaggcggaggttgcagtgagccaagatcatgccactgcactctagccttcgtgacagagtgagactccacctcaaaaaaaaaataaaaataaaaattgagtacctaaatagataaaggtagagctcttttgattggtgtggggttgagggtggcctcgggccctgcccgctgggccttgttcacccccataccagatgaaaatggacagcagggagcatccagcctggcatttcctccacagcaggttctgagaacaccagggctacagtatgtcagttgttgtatctttaaaaaaaggagtttctgggtttaagagagttaagtaggtgcctgtgtgcaggccttctcagagacttcagtgtggacagaatatgcggtgatttcaaaggccatttggctacagagttctgagtttggtgactgaagtttcacagggctatcttagaaaatgctgccaggcacagtggctcatgcctgtaatcccagcactttggaaggcagaggcgggcggatcacctgaggtcggagtttgagaccagcctgaccgacatggagaaaccctgtctctactaaaaatacaaaattagccgggtgtgatgttgcatgcctgtaatcccagctactcgggaggctgaggcaggagaatcacttgaacccaggaggcggaggttgcagtgagctgagatggtgccattgcactccagtctgggcagcaagagtaaaattgtctcaaaaaaataaaaataaataataataataataaataaaaataaataaataaaaaggaaacatccttttcttctttttccctttttctttccttcctgctttccttctctttttacccttcattcacttttccttcattctttcatgaaatgcagccaggcactgtgctagtcactggggagacaggtgcaaactagacacacacccccgtaccacacggaaatggactgtaaaaaaaaaaaaaagaaaatcctgatcaagactaactcctggtacagattgagaaatttgggctcagagaggtgaagtgacaagccccatgatcaccagctagttaatgactacattgaaaattagaatctgggattcttaactccttgttctttgtgctacgtagacaggtcagtctccaaaccatgattttatttagtggttgagaatagggagggacactgctataaaatatgattatgatacatttatcggacactttgtttacaaaatcctttcctctccattaggcaggttgatcagagaggttttgagtgtcagagtcctttagttcctcacaagtaccaacctgtgccagccgatgtggtctttgcaagaatcttctataaagttgagaggatggggcatcagggaagtctcttgataacattgatctcagcttatacaggcaactcagcagagggctggaattcaaatcagaatttcatgctggctctgatgctctacttcttttttgttcttttttttttttttttagatggagtctcgctctgtcgcccaggctagaatacagtggtgcgatctcagctcactgcaacctctgcctcctgggttcaagtgattctcctgcttcagcctcctgagtagctgggattacaggcacctgccaccacacctggcttttttttttttttttagtagagatggggtttcaccatgttggtcaggctggtctcaaactcctgacctcgtcatctgcctgcattggcctcccaaagtgctaggattacaggtgtgagccaccgcacccggtcttttttgtgttgagatggagtcttgctctgtcgccgaggctggagtacagtagctgatctcggctcactgcaacctccgcctcctgggttcaagtgattctcctgcctcagcctcccgagtagctgggactacaggcacacaccactatgcctggctaatttttttttttttttgtatttttagtagaggcggggtttcaccatgttggccagactggtcttgatctcctgacttcatgatccacccgcttcagcctcccataagtgctgggattacaggcatgctctacttcttcagattgtatttcagcatcaaatacctacttcggaaccaaacaaaagtataaattgatacctggggatatgccgctgaattttcttctcacaaaatttttggtgctttaaagcatattaatacagggctaaagtggttttttaaggagtcatagtttgtaaacctttaaaaacttttcacttgtgtatatgatatgggtaaaagtgtttgacacgtgtggctcgttggttgcaggcagaagcttgaaagcatgttggcactgtaactaaggtaaaataaaggcactttggataccctaagactgcagagtggccaggcgcagtggctcacacctgtaatcccagctggccccgccacaaaatgtttaaacttagctaggcctggttgcatacacctgtgttcccagctactcaggaggctgaagcaggaggatagtttgagcccaggagtttgaggctacagtgagctatgattgcaccactgtactccagactggataacagcaagagcccatattttaaaaaaagaaaaaattaaaaatatacttcatggttcatgtcatagccctagagagtgaaaaatttgcagtagtcaataaatgaatgagtagttaaatattctttaaagtcaactctatttcattgtaatttttgttttctttttatcattgtatcaaactatatggaaatcatatggttagatgtgagtgattatttgataatgttagtccatttgaatccattttcgatatttcaaaattaaagaatatgaaacttcaaaaaaaaagactgcagggtaagagggatttcaggaggcaatgtggttggaaagaaggggaggagatttgcttgcacagggaggatatgattataagttggatgaaatgtttaagttggactctggcacagatgaagtttatggaggtgctaccccctgggctccccttggtactgctgtgatagagaagacatagaattggctttattgcaagtgcttaaccaagcccagctgatagtgtcagctcctagcagccctgagctaactgggaaaaaatactctgatgaatgatttctgccatatgtgaaaactcaggacatggtgacataaatccatagtgatgcttttcaaaattcccaggggaaaagaagggacagcagttagaaatatgctagaactaacataagcttcattaattgagaagttgctcacactgtctttatcaaggtggaagagaaagcaaagaggaagatctctaccctgtgaacagttctacctgtcatgtgtaagaaatatgtgctgcctcagcattttgttcacatacaatcatgccccccatgatcacattttggttagtgatggaccccatatgtgggggtggtcccgtaagattataatactgttttgtttatgtttttttttttttttgagacagtctctctgttacccaggctaaagtgcagtggcgcaatttcagctgactgcaacctccacctcccaagttcaagtgattctcatgcctcagcctcctgagtagctagaattacaggcatgcaccaccaagcccagctaatttttgtatttttagtagagacagggtttcgccatgttggccaggctggtctcgaactcctggcctccagtgatctgcccacctcagcctcccatagtgttgggattacaggcatgagccactgcacccagccttgtgttgttttttggttttgttttgtttcttttttttttttgagacagggtctcactctggtccctcagtctggagtgcagtggtgcaatcacagctcattgcaaccttgacctcctgggctcagatgatcttcccacctcagcgtcccaggtagctgggactataggcatgcaccacattgcttggctgattttttttgtatttttagtagagacagggtctctccgtgttgcccaggctgtcctcaaattcttgggcttaagtgatccacccatgttgtcttcccaaagtgctgagattaagtcatgagccaccacacccagccataatactgtatttttagtgtaccttttctgtgtttagataagtttagatactcaaataattcccattgtgttaccattgcctacagtattcagtacagtcacatgctgtacaggtttgtagcctaggagccactataccatatagtgtaggtatgtagtaggctgtgccatcttggtttgtgtaagtgcactctgatgttcacataatggtgcatttcccggaacgtatcctcattgttgagcaatacatgactgtatccatgattttcagaaagggccgtttacaattattgtacaagttgactaattttggtttattgcacacatggctgattttattttctcctttagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcaggtatggacttgaatgctcttccttttgtgtgtggtgtttgtcactaagagattcacttctgctgacccactgtttgttgcttgttaaggtgaggtatgtgtctcagcctcttactcctttgaggaatgagaaatatgagattaaattagcattagaagctaatccagctactcataagccagaagagaaagtcttcttcagcaggataaggatagaaatgatattcatgtgcccggatgcttcttcccttctctttctgatggagaaactgctagagttttgcagaggtttgtgtgttgacagaaggtttctgaaaccatcaccttaagtttcagatgaagagttcattaagaaaaaatggtaatttttgtaaaatatagaaaagtaagaaaaattaaaactatacattatcaaactacctaaaatagctatattagtatttttatatattgcctttcttttttctattcacaaacacgccagcctctgttaccatatatttctattcttaattctatagtgaacatgtagattgtactctgattttttaagtttacattttgccatgagcatttccttttgtttttttcttaatcagtagcttttttgtgtgtctgtggcttttgatttaacctcagatttttttttcaaaataagtagagaagtgtgcctatttttccccaaaataattggagttgaaatattcttaattgtataatctggttaaccaggaacaactgactggtgcccactaacaagtcaattaactagaacctttaatacatttaaattaatataactttttttggtatttgccttaaagtagaagtatcctattaatatgataaaacttggttcttaatctatagtgtgcatcagaacctctagggtggttcttaaaaattcagattgttgggcattctgaaactaaattagaaactatataacatgagtaaagcccaggtaaacaaacaaacaaatgaaaaacagcaaactccccaaatctccacaggtgctttgggtgtgtacctctgattaaggacatctatgataatattaagaacttgtaagtcctgacaattgctttttttttttttttaaatcagacaccatagccatcttggaatctgtttctattcattgagttttggttcttgaccatgagtcccattttcctgttgtgttgcctgtctagtagttgtcgactgcattctgacatcgtgatgatatatactggatgtggtagacattctgaacttcctttcgtgcttcatcaggtggatctgtggaaagcacaaggtgtatctaacttgatggggcttagcttttaaactgtcttctctgtattttatttgaggattggttttaggccccattagggcaggcctggagtagcccttcctctgaggcatgtgcctgttctgaaggcatggccattttggatgcttggtggggaggtctctttaatctggtgggctggaattcccatatgccagctccgctgcacgcttagtctctctgttctctccaccccatagcagcccctctctggtaaacctcgcaccatctctccctgtgcttacacagcccagcccttggccaaagagttgagggtttcccccagcagcttcctcctctctgatgccaccgattccagcagtttccacagcctggcactctgagcggtgccaggaatccaggattatttcaggaatcctcagcacagcgggaccactgtgctctgctcagatgctacttcctgcacgtggcaggggagctgtccccaggcagagagctgaaatgaaggtgggctcacctgtgcacttcctctcccttggggaccgcagtcttctgattcctgccgtccaatcctgagagcaattgccttatgtaatatatatatgtattttttgacagagtctatcactctgtcacacaggctggagtgcagtggtgtaatcttggctcactgcaacctctgcctcctgggttcaggtgattcctctgcctcagcctcctgagtagctgggattacaggtgtgcgccaccatgcctggttaatttttgtatttttagtagagacagggtttcactatattggtctggctggtcttgaactcttgatttcaagtgatccacccacctcggcctcccaaagtgctgggattataggcgtgagccaccgtgcctggccaagtgctctgttttatgtgtccacagctccatgcacctttccttcatgctacctgccactacttgtaattctaacatttgcataattattttgtcaatgtctctctctcttagaccatgagctttgtttaaaagagaccacaacttccttcttattcttcattgtatatcaccatcaagcacagtttgctgccacaaacatagcaggcactcaacaaatacttggagaatgaatctgctcattaaatgcattggccaaacaattttaagtcttaaggagagagaatctgtatccatttctggctttgtggcatcttcattcactgattattcaaaagatgtttattgagcacctactatgtaccaggcatggtgcttgattctgggttatgatatgaacaaaacagctggaaattctcaccatcatgagcttacattttggcaagatgatagtaataataaacatttagaaaacatttgctgcctgtgagatcctgttccaagtgctgcatatgtgttaacttatttaatcctcaaaagagccttatgatgcaggtaacaggtcaagtagctgtcaaggacttgttcaaggttacggctattaaatggtggagctgggatttggataccgcaagctctatttgcagcacagtagatctgatcatccacgtctctttgcagaccagctcttcctgccttctcacttgtgcagaaaaagcctgaaggggaaatgcccacgcctcctgcgggccactccattccccctagttttgcatgctgttccagtatgagccttgtcatcacctcatgggagctaaatcctgattctcagggagatgctgattggccctgtcttgggagggtgccgcccattggtccagtaggctgtggcctggaggttgggctgcatgaggagtgaggctcagctcacccattcatcaggggctggggccctggaaatttccagagaagggaatgggctgagtgtacagtccaggagacacctgctaggctgtccctgaagtttgtgcttctccctctgatagctcccaaggactcttgcctcttcatgcatgtgactttgtttgtttgtttatttgtttgcttattttagagataggatcttgctttgtcacccaggctggagtgcagtggcatgatcactgctcactgctgccttgaatttctgagctcaagtgatcctcccacctcagcctcctgagtagttgggactataggcgtgttaccaccatgcccagctaattttttccttttttgtagagacatggtctccctgcgttgcttaggctggtcttgaactcctgggctcaagtgatcctaccacctcatcctcccaaagtgttaggattacagtgtgagccaccacaagtggcccaagtgcctgtaactttgaagatccaatatatgatttaaaaacttgcagacaagtctctttaaaagacaaaaagtggagtctttttaaaaagtcatttgaatagattatgttttttcaaaataagtcatgctaattactgatttttagcatgggaagtcagtttaaaaaaaaaaacttcttggaaaaattgagaaaagagtggactttaagaggattgctgctcttacccttcaagggagtgtgaaaactccttctggaatctgcagcactgcccctttcatatccagaagagcagtgtagcctgctttgtaccttgcctgaatgcttccgccggcttctctgttgatttctgtctcactctttatctctgtatctgtttctatttctgaaccacagcctcttctcccctctcagttactcagtctccacccttctctcttttatttgcctcactatagaacttcattcttttttcatgcctagtggttttaagctcctctttatataaaaagaaaatgaatataagaccatttcattttttatccttaagtgtacaattaaaaatcttaaacatatgccatgctcagctgttctcttcattgctttttttgaatggtacttggtcttgggagaaagtttgttcccaaaccttaagtgcttgtcagatctcatgactcatttgtatggggaatgtctcactggggacctgccatgtgccaggcactgtgctggttgcgggtgatacaacgttggtgagatcagcacagctcatgccctgagggagctcaggggctgcgggaaagtggactaggatggtttgagttggtcagggaggcctgagaggccagatggcggccacttggaggggatctgtgggctgatgcctggactcacggtgggacgtgatggctgattagaagcttgtccattggattcaccgcttgggaggaactgcttctacagaacaaaccatgacaagagatggtacttggaagacctactttagaaagagtgtctcgttgaggaggtgacttgtcagctgggacctggaacaggtcatagaaccagcaaagagacaaatgatgtcctcctcctcctccgtgctctctgtctctcttggtcgggggagagtgttctacacacagagcacagcacatgcaaaggccctgaggcagggaaggactgtgtgtggctgaagagctgaaggagggccagtgtcattcaagtttagcttgcagggtgatggttggcaggcccaaactgtgcagggcttaaaagccaaggtgaggagatgaaattttgcttattccagggcaaggggaagacatgatacgttttgagtagaggaggaacttgattctgatttaacattttatagatcactcaggtttctccctggggactagattagaagaagttacggaagaagcagggagatgagattgttagcctgtggcagtaccaggggaaagatcaaggtggtaaggactagaaggtggcagtgggagcggaagctatggactctataatgtgatcttcaggacttaggtatgggaggtaaaggagcaactgagtggatggttcggttggatggatggcggagaaggacttgggaaagaaagtgttttcttgggggaagattgcaagttctctttggggcatagaaggtacaaagggcttccaaggcacacgagcaaagatgtcaagtaaacagttggatatatgagcttggagctcagaagcaaagtcctcaacttgctctcaggcctgtgggatgcctcggggccacacgctgcatcaccagaggccccagcaagcacccacttgcaaggactgactgtccacaccctcagtaacaatgcgcctctctctagaagcagtggactaaggaagaagcaaagaagagactgtataaacaagatcacaaacagacaagcccaggagggccaggcaatgaaaggaaatgactgaactgaccaaatgtcagggagcaacagggggtggtggggagtagggcagagcggcatgtgagtcttgcctcaggaggcagttgctgttcagtccctataggctgtgacatgtgggaatgtgggtggaatgttgccaggttttataggttttgttttttcttctttcccaagagctaggagttggaatttttatgtgaaatttctgatttttcagttttggccataaatcaaactttgggttgaatttggctcatggcaaatatgcttcagttcacatcatctggaataaataagaatggtgctacttcaaggtttatcaaataggaagggagataagagagaggttatatttatatgatttctaagaattgtctagttacagaacgaaccctgttaacagccggatcgaggtagtttctcttataaaaccctaaatctcaggtgagtgtggtggctcacacctgtaatcccagctacttgggaggctgaggcaagaggattgcttgagctcaggagttcagggcggcagtccgctgtgatcgtgccactgcactccagcctgggtgacagagtgagaccatgtctctaaaaaaacaaacaaataaataaaaaagttctaaatcttattgaagtagaacaagtctagggttctttcagaggaaccaatgaatcttaatgcacaagcctgactttggtctgcaggtatcagatgaaaaggggaaccacttgattcatctcaaaagagccacacgcttttggtggagccctgccatcattcctcgccctgtttcaggacaggatgcagtggtcctccggtggacaaaacatccattcagagcggttttgcaaggttgggctttaagtgtttccatagttcttcagcttatgaggtctaataatatcccagttgagagtggcctgtataacgccattgtcatttaatcctttcctggcggcttccaaaccctttaaccatattctgcacagaaattccctggaggggatactttggtatattccttatccatccttgtgctggggctttcaaaaaatgttattcttacaactctctgggatgcatgtttaatggaaagaataatcagaacgccatccttttagggagtgatcaaaatatgagaacgtggaagcgtcgcactcacctccaaagagtcctcttggttctttcaagcagatgttcagacatgtggaaaaaacatgggtagctctgttacgaggaattccttgcagatgcggaaacccgatggccatttcattcccggtaacagtaatgagctttgcagggaggtgagtgagggcctgaggcccacctgtccaggctactgcctcctgggctggaggagctggtaaagtctccagtctttcaaaacctcataaaatggattatgggacgtggatgctcattctgttggatttcagcttttatgctaactgcaacttacttgaaatgatatctaaggaagggaagaagcaagccagatgggattttttcctttccaggtgaaagctgcactcgtgacagtaagcagtgctcctttagcagttggctgggtgtgttagcttctatttgtctaataaaattttgtgtttggggacgtgagacaggaagtagttcttgctgatgctaatttgtcttgatcagggctgctgtgttggcatctacagaaggttccattggacctcctggggaggggaagggaaagaggtggtggccgggtcactcaggcttccaaaaaattggaggaggagaatgttctgagatcactggggttcatttgctcatttattaaaaatacttaccaagcacctactgtgtgcttggcactgggaatatggcagtgaaccacaggcaaaaatccctggccctgtggagctgatgtgctggctagggggagatagcaatatagcttataaataggaaaattaaatagtatgttaaataggaaaatgaaatagtatgttgggaggtgataagtcctatggggaaaactatcaggccaaggagaattgggagtggtttgatggatctccctgggaaagccacatttgggcaaagaaggaggtgcccacgtggaagctgcagggacctctccaggctgaggagacagcagggctgagttgggtgacatcttgaacagagaggaggcctgtgtgggaagggcaggggaaggggaaggataggggggcggatcgtgggcctcgcacatgtttagttagaggacttggactctgagcgaggcgggagctgggagggcctggcttgacgtaggtgtcagcaggatccctctgctggggtgtggacagggagaagctgctgcagaggcccaggccagaggggatggtggctggaccagggtgggggcatgggggagcaggagaaggggttagagtcagagcatgttttgaaagtcaggctaactggatttttttgagactggctgcaagaggggtggcatctgtctgtctggggctgtagccttgggaaaggccagagtctctagggaccctgttcatccctgccgagactcctgctatttttagagggaaagcatcttttagaggtgacttgatgtagccttttcacttcaagatggaggcggggatggggtggggagtagcagagcggggtgtgtgatgtgggggttctgaggccgacttttgaggagccatcctcaccacctcctccttgtctataccagtcttttgatgagactggtgatttcattaaaatttgaaaaagactacagtccaaaccaggtacacccgtgggccagttgtggcactgctctctgccccgccgcacgtgtccccggctgagggatgcccgcagtggtcgaggatggacttgtgaaacgattgagacctgcaccctggcctccgaggtgagaggtggagagagggggagggtgcgccagggtcggggctggcgcaggcagagaggtggcgtggtgagaccggcccgcctgctaactcatcttctaactgaagacacggaggttcactgaggggtgctttcagcccacagtagaagggagattgtcaggaatgagcctcagtaaagtgttgtccccagacataggcagaaaacagaaggcttccagaatcttggagaaatagctgttgccaaaagggagattaagtctgaaacttgcagtatttctggcaaccaagaggaacaatatagaagaaactttatttgtgtcacaaataaatgttggggccctcgtgtgtgctgggcagggtggcataatggctggagctacacttcaccatgtgctttctttagagtgacctagttagtctttgcagcgatgccatagagtgtaggtggtaggattactatgctcattttacaggcaaggaaactgggacacagttcgggtaagcagcttgccaggggtcacccccagccagcgcgcgatgctgcttgattggggcataggacgtctgcagccacagcccatgttgttgaccactggcccatgctgcctcttggaagtagacgaagcgggtggttcgaagtgaggcagctctagggtttggtagctttgggactctgggagactcactgggcagtagtttcttcaatgataaagtgatgtagacttacgtctgtcaggctatttgttttgtgtttgttgagcatagttaggatgctaaacaaaagttccagtgtgatctttggcacagagaaggcatttcatctgttgttctttcgttgagagagaaggccatctagacatagatcacttttgagctctacgagccttagattcctgagcctgttccagctttttctggttgaattaaccacgtctgagaccaggctatgatacggagggggctctgagagttctgagagttgtttatttacacgctgtttgttacagacatgatcttagctcatccttgcaaccacatggtgagtcggggctgctattattcctgttcgacgaggggtgagaggcacagggaagtgaagctcacatacctaaagtcaggcagctggtcagcaatgaagccctggccttggctttgaacttctgggttcttatctttcactcacccactcactcattcatccacctgctggcagcagcatcacgccccaggcatggggtacaatgagcacatgggctgagcccagacgcctgtggagcgctccagccggggctggatgtgagagtgagatgggacaggctttagaaagggtcctctgcggcagctcagcgcagtgcctggctggccatgtgacctgagtcctggacctagggtcaggcattcaggttctgcccttgcctccgccctcgccactgagggaccttaggtgaagctgattttctctgattatatgggaaaggagacatctgctttaggtgggtttctaagcacctgtcagctgcaacatgccacaagaggggaccatgaccacacctgggaccacttcgcaggccccgagccatctcgctgcaacccgtccgcaggccgaggctgatgttcataggagtgtccgtgtcaccagctggccctgctgcccttctggtaccctgtgggtttagtgggtgtggaggccaagacctctttattgaacattgagcattttctaatttagtcccatgaatgagactcctaacggcctcggaaggcactagctccgttgacaataaagtcatgaactggagcatgtggggaggtggggctgggtgggtggggaggaacacggggaggtgatggcttctcacggggctctgtttcctctggatcctgggagacattgcgaatgtcaaagtcattcattctgaacctcctagaagactatgggccgactctagcaatagtcatgcatgtttactgagcacttactatctgacaagcacatgatgtggaatggctcaatggcttgggcaggcatgcagcctctgctctgtgaatgaggaaaccaaggctcagaggcattgagcctcaccttccccaacgagcacctcatcgccagtgatgagcaggctgaccctggccgagcttttcctgtgtgcctgcttggagagatagtggcgctgccattaaccccatttacagctgaggaaactgaggctcggagaagctgagtggctttttcaaggttgcattgctcttcaggaggctgagacgaatgcctgcctcccagggtcattgcaaaggttaaatgggtattaaattggtgaggtgccaaaacagggccctgcctgcgatgagagctcaagatatgctcattgtttttcttattaatttgtcctctgaaccatcgtgttaggattttaaaaaggagcatttgttctcatgtggaggctttagtttcatgccgcgacctctgagctggcatgggtgtgagttaggggcagacggtgtggagggcgttccctctcaccatttcttatgtgttctgtgcgcagctcttgtcctcaaacgatgccacgacaacgacacccagcctgcagcctgggaaactgatactcttgaggtcaaaggacttcctcaaggccaagcatctgggatgtgggagagctgaacgtaaaagcattctgttgggcactttggccaagccatttccattgcacggtgtggttctcaagtccacagcttagcgggggcctattctgaatactggcacaggttcgaaaaatttcattcgtatgcatgtgtatatgtatacacagagacacatacaaatacacatataaattatatatattcatatatatatatatacacacctacacatatatatacaatgtgtatgtacaccgatatgtatttgtgtgtctgtgcccctgtatttttattcaattattttactttatttttagctctttaatgtgtattcatttttttaaaagtacaggaaatggccagacgtggtggctcacgcctgtaatcccagcactttgggaggccgaggtgggcagatcacaaggtcaagagatcgagtgagaccatcctggctaacacagtgaaaccctgtctctactaaaaaaatacaaaaaaattagccaggcatggtggcgggcgcatgtagtcccagctactcgggaggctgaggcaggataatggtgtgaacccgggaggtggagcttgcagtgagctgagaccgcaccactgcactccagcctgggtgacagagcgagactccgtctcaaaaaaaaaaaaaaaaaaaaaaaaaaaaaaaaggaactagatagcactcttcatgacctggagtgaactactcttattgctggtgtatttctttttagtcttttttttcccctgcgcctgcacacttgagctcacaaaactcagctcctgctgttctcacatatttgagtctatatcaggttattttgaagactgcaggggaggtgacagcatttactgagtaagtttaagtgcattccatgcataaatggatgtaatcctcctaatatttctaggcagtacttgagacacagagaggctgtgcaacttgtctaaggttacacaggaattgggggaaccacgaactaaacctaggtagtccagctcaaaagcccacgctcttaactgcttaggccacaaagaagaaatggaaatcattttgtttgtttgtttttgtctatttcaataggtttttgaggaacaggtggtgtttggttgcatgaataagttccttagtggtgaagaaatggaaatctttaacgaccttgagataattttccaggttgctcctgggggctctcattgttgctctagcattttgaaaaattcaggaaacaggccaggtactttgagtcatgcctatgatcccagcactttgggaggccgaggctggtggatcacttgaggccgggagttcaagactggcctggccaacatgatgaaaccccggctctactgaaaatacaaaaattcctgtaatcccagcactttgggaggctgaggcgggcagatcacctgaggtcaggagttcgagaccagcctgaccaacatggagaaaccccatctctactaaaaatacaaaattagctgggtgtggtggtgcatgcctgtaatcctagctactcaggaggctgaggcaggagaatcgcttgaacccgggaggcggaggttgcagtgagccaatattgcgccattgcactccagcctgggcaacaggagcaagactccatctcaaaacaagcaaacaaaaaaaccccaaaaattagctggatgtggtggtgcatgcttgtaatcccagctactcagcaggctgaggcaggagaattgcttggacccgagaggcagaggctgcagtgagccaagattgcaccactgcactccagcctgggtgacagagcaagactctgtctcaaacattcaggaaataaatccaggctggtcaagcatcaagtgagattgtttcttcatcaggttgttcaggcttttgtcatccattggtatctaccctgccccagcctcctctccctgtgtttggctacagcagcctgaaggcccctcccaggcagaggtagaacaacagtggctcatggggcaggtgcagcctcgctgtgggctgctgttgacacccccaagcatgtcctcctgtgagtggcctgacccagggcagctgggcccagaagcatctgagagtagaacctggggagcctagtggcctgagcctgggccctccgatgcccgcctcctccaggaggatgagctcccagtgcaaatggtggtacattgagatggtcatgggacctacctgacccttgccctccagcctgagttgttctcaccatactagtggcatgactgtgagcaaggataatttgaccttctggggcttcaatttgccgaagaagcaaattggagagaatgttacttgtcttttaggatttttacaggagtcaatgagaacgtgtgtaaaacaccacttagcacagtgccaagtgcaaactgctctagtttctttcataaattgattttggggaaatgcattcacatggtgcacaatttgaaaggtattaatacaagctgtgtacagggcaaggtcttccctcatacctaggtggccacctcgtcttcctaagccccagtgccattggttctctggacatcccgccagagatagtctgtgtttgtgcttgaggttgtattcgtggtctttgttgccgtcattatcagaattataatgtatgaaggatttggcatactgctcagcacattttaccttcctaataaatgatcaagacagttattactgctcaacttaggaagccattgcattttcatttttctgaataagaagtgaagctgaattgatcctcttgacatcatttatttaaccaagtaggctcttcccatgaaactgaggtttctactaagtgaatcccatgttcctatttgacatttattgtaaaactgtaaatgctgtcctaggaatagtttttggaacctgtatcaggtgaatattgattaaaccttgcctttgcttgaaccctggcttagtgacataaaataaaccctcaggacacacttgccttgtcatgtatctatccgtctctccttcctctatccatcagaaaatgatacagcagggccaggcatggtggctcatgcctgtaatcctagtactttgggaggctgaggcacaaagatcacttgaggccaggagttcgagacaagcttgggcaacattaccagacccttgtctctaccaaaaaaaacacaaaaacaaaaaattagctgggcgcagtggaacatgcctgtagtcttggctagttgggaggttacagtagaaggattccttgaacctggagatggaggctgcagtgagctgtgatcatgctaccacactccagcctgggcaacagagtgagatcctgtctcaaaacaaaccccaaacagtaaagataaaacctgattagtagatagtttagcaagggcatggtgccatggtcaaaatgcagcaataaaagtgttgagtgggattatgagtggttttcctcttatcttgtatttattcaacaaacattgggcttctaccacataccaggcattgtgttagatgctgcctgctcagtttggtccatggattggtggcctggatatcctctgggagctcatgaagaatgcagaatctcaggccctgctgcaacttaatctgtgtgcacattcgagtttgagacacattattccagaaaaagagtcgtcaaactatgccagccaaattcggcgcatcacctgctttttgaaataaggttttattgatacacagccacacctacgtatttgcatattgtctctggttgcttttgtaccactgcagcagaggtgagtacttgcaacagagactgtatgtgtggcctgcagagcctaaaatgtttcctatcttgtcctttacagaaaaagtttgctgactggagatggagatagagtaatgaacagaatagataaaatcccgagctctcgtggaggtgggcttctggtggagggagacctataacaaatcagtaattccacaatctgtcaggttgtaaaaaagctataagaagaaaaataaggcaggaatgggggatggaaagtgactgggaagtggtgaggatgctatttagggaagaacttcctgaaggggtgccgtttgaatggaattttgagtgcagtgagggaataagctgtgttgctatcttgggagccagcgtggtaggaaagggagcagccagtgctgaagccctgaggcagaagcttgcttggtgtccaccttgagcatcagtacagaggttggagccagctgagtctgattcaggagttaagtgttgatggtgaatgaggtttttggtttccatgtcagcttccctgtggcatttcagtgccttttataagaccatggaatgtagatagaggtccccaactcataacccagggaaatcttctgtgtgtcactggatacagttgcacaggctgtgcatggcacaacagctgtgtgtatcatgagggtgccattcacatttgcaggtttattaagacagtgttctgacgcatacctgccaaaggtatagaggaagtgttgtctgctgtgaagctgcatgaaagtgccagacaagccagcagtgagtggccctggtggtataatggtttaagagagaaaaaccatctgtgtttgagtgtctttaggttgggaacttggttcctcagtctttgcactggttgccagctcattttcattacttgcctggccccttaaggtgtttgtgttgaactctgatagcaagaaaggtgtttctgctagtctaaaacacttcccactccattcttttcctttcttttggatggagcttttgttggttcctccttctcaccctctgactgaccagactgcctgggagggtgagggtgggggtgggggtgagggtggtgagtgtgggggtagaggtgcggggtggtgagtgtgaaggtggaggtggggtggtggtgagggtgggggtggtgggggttggtgagggtgagggcgagggtagaggtgcggggtggtgagtgtggaggtgggagtggggtggtggtgagggtgggggtggaggggggggtggtgagggtgagggtggaggggtgggagcattcttggcttcctcttctgcctgagcctcgctgtgcaacctcagcccacatacttctcactgagctgtaggagcctctgccctaaaacgagtgggtagggctctgtaagttccctcctacctctaaacttacttaattctatgactcagagtaataggtatcacccaagtagaagtgcctatgtttagttttgttcactttgaggtgggagttccaacttctcttcaacttgggttgccttaacttgcaactccagggttgattcattcagggacttgaagctgttaagctgtcattttttctattaaaaattttttttaaagagtttggggataattgagctagaaggagacttagaaatcatctagttggatgactggtgtgtctgattcatgtatcattttactgagggtttcagctaccattttactgagggctctggttatcattttattgagggattcctacgtgccagaccttttgctaaactaaagttgtctcattcaatctcatactgagtacttgagggtaggtactgtcatgatcagttttcaggtggccaaatagaggttcagagagattatatgaaattttaatataaagataatacagcaactaaattggcagagccacgactcagatcattaaaggcagaggttagaaaagtattacttattgagcatgtacaataggccagacattaagagaagacttgcattaaccattgtaaccccatgaattgggttctactatcttacaaatgaaaaaactgagccccagagaaatgtgacttgcctgaggtaaagcttttacaggtaggaagcagaagtgttttagatttctttttctttctttctttctttctttttttttttttaagatggagtcttgctctgtcatccaggctggagtgcagtggtgcgatctcggctcactgcaacatctgcctccggattcaagcgattctcctgcctcagcctccaaagcagctggtattagccaccacgcctggctaatttttgtatttttggtagagacgggtttcatcatgttggtcaggctgatcttgaactcctggcctcaagtgatccacccaccttggcttccgaaaatgctgggattataggcatgagccaccgtgcccggccgcgttttagattttgaatctctttctctttctcatctgcttctctttgccttgtgatcttttatgggcatccagttggcctgttggccttcctcacagttctgtgcatctgtgtgggagctgggctcggggtagggtgctcaaccatttcttacctcctcccctctgtcacctggggccaagctagcatcatctcttgtctgggtgacagcctcctaactggtttccctgcctccacttgcacccttcattcatctgctccccacacagctgccagaggatctgttcagagtgtaccttggtctacaccacccccattctgagccctcctgtgtctcccctcccggagtatagatgcagagtagccttgtgctcctcaccgtggaccaggccgtgtcacccggtccctgcctgcctctcttcctcactcactcactccctcactccattcccacctgctaatggcctctgtgctattcctcaaacactccaggtaggctcctgcctcagggcctttgcacgtgcctttcactcctcccagctatccacatggctactttctctgcttcattcagctgtcagctcaattgtcacctcctcaaagcagcttcccctgattctcctaccaaaatagatcccctttctctcctgccatcatctgtctttctacttaggtgtttgttttgagatgaagtctcactctgttgcctaggctggaatgcagtggctcaatcttggctcactgcaagctccaccccctgggttcaaacaattctcatgcctcagcctcctgagcagctgggactacaggtgcatgccaccatgcctggctaatttttgtatttttagtaaggatggggtttcgccatgttggccagtgatctggcctcaagtgatctgcctgcctcggcctcccaaagtgctgggattacaggcgtgagccaccatgcctggcctctgtttgtttctttttttccatagcctgatatatgttctctcttcctttcctcctcccttccaaccccttcacccacctactcatccacccccctgccacacattcatctttcatctccttcatcgttgcttcatccccagtcccaagcacagtgcctgtcacatagtaggtacttcatctatctcaagaacagcggttgagaggttgttgctgctgctttgaggctttggtgagccccgctgtgtctggcctctcagatgaacagtgccctgggagtctgggtgatggatgtgctggcgtaggcggctccttggtggctttcctgtgctaaaggaagcagaggaaggaaatgacaaccattcagaaggaccggttcagttcactaggacatgcccaagcttcccggcccctcgtgtctgtggccaacatgaattgggctcgcttgaggccaacagaagtcgtgacttgatggaataggcacaagttagttttatgatgattaagaaggaaaaaaagaaaaccttatttttcactttccttttttaatcaagaagtatgccgtgggtgttcccttgtggtttttgagtcaaagagagtattgtttttgagctctgagttcccccgggggctgcagctttgcgtgtatctaactttaactttgaactaatgcttttagggctctggtgggattgggggtcccgggtccctttctgaacaaggcagcaggcttgtttattgtgtccaaagcgtgcctctcagatctcaccccatcttcttcctgttctcaatcgccccctccctggccaatctgcccctcctctcagcagttccccctcactcctccgtgagcaaaggagggggaaggatctgctttggtggaaggcggtggctgcagaggctgggctcaggcgaacgtctatcatggggggaggcgtggaataagccatgagtacccaaatgtggccttgtttgcagggattgaacaagggtggtctggggctggaccgggggtttcagccaagtaatattggggtgaaaaatgcagaaaagtcttgtgcaaaaatgggatcatattaagttcatgcactggccctaaagcaaccccgtgactatgtctctagagcaagtgcttacacatccacgtggactcgttctcacgtgcatcttctttttgcatttatcttttggtggattgttatttttcttgctgcgggagggagaagaatgattggcccaagtgcaccttgactttggacccgaagttgttgaagtcgtgaggcagacacattgctgcgcttgccttgggcagagacagagcctcggagggtgcctggtttggtagaagttagactttgggaagcttgttgggacttgttagtaacctgggtgctagtcccagcttgtaaccaagcccctgtcccctctcagggccaggatgggagtgacatttctcagtgtggggctttgcagcatcacttgaagccctctgcagaaccccattaagctgcggagaatggagtggattctagcccctgccaccctgcctggggccttccagggctgtcgcggcagccaggataggcagcaatgcccattcagtcaacagatgctgaatgtgagctgtgtactctggatagagggagaaatgagatcaattcttgctttcagggagtgcccagtctgctgggagaaacagacgggaaaataattgaggtcacaaggggattggttgaacaaagaatagcaggaaagatggagccggatgacctgggtttgaatcctggttctgccacttattggctttgtgaccctgggcaagttacttaacttctctgtgcctgtaaagtaggatgataatagtaccccaaaaagaggttaccataaatactgaagcagagggcctgacagtatgtgtccaattaatgttagtgattctttgtttatagagataagacctataatagagagataaggactataaaagaaggagaaggtagtgaggctctgggtcacaaggttcactttgcctcagggaatctggggcagcttcctgaggaggtgacatttgagtggggggcggggggtggttgcaggatgtaaaggaagaatggtccaggcttcaggggtgtgcagaggtgagggaactctgtttctgattgctcaagacctgagcctgtccacagatggcatttgacacgctcagggctttaagcagcagctgacactagttaaccaacatttacaaattaggaaatttctcataccaagttggatttctaacaatcagaagatctggcaacaatggctggcttcctgcatggcaagttgtgaacagctgcgcttcgatcctccctttggactggatctgcctcccgcatggggtctcagcaccactaggcccagttcacacacccacattcctcacctggctcctctgggcatcttgttggtgaccctgggtgggggtttggaacctgctttggaaatgcttagaaaaataaacccagatcttgctgaccttcacgtccaagtgtttgctcaaggcctctttttaatataaaaaagatgctcccgactgtaaagctggccttaccttcctactttagcatcctcctcctgggaaaaatgggagtccgctctgatccacaggtttcccacagggacagaggagggatgattgaggtgtgagttagagtccccttcagatggcatggtggcatgtagacccagccagtgcatgggacgtgagctctcttacacctgggggtgtgcatgtgggtgtttactattggcttcaaacacagaaagtgacaaaattgaactccacgaatttgtaagagggagtgagtcaattttccttggtcccggcaaactccatgcttgctaaaaatgagtgctgtagaatttatttgccttctgtcatcaaagaaaacccaggttcagaactggataagacagttccccagagaggacagatgatctgtctgtactcacacatcaacaagttctctcttgggcatttacgatggaatgtgtccccctcacccctttaaattatggagaagctgtgttctctttgaggtgaatatgcggtcacacaagtctttttaagaaaggaggctttccagccatgtgtgctggctcatgtctataatcccagcactttgggaggctgaggtgggtggatcacttgagcccaggagttcaagaccagcctgggcaacatggtgaaatcccgtgtctacaaaataaaacccaaaaattagctgggtgtggtggcacgtgcctgttgtcccagctactccagaggctgaggggggagaattgcttgagaacaggaggcggaggttgcagtgagctgagatggtgccactgcactccagcctgggtgatgagtgggaagctgtctagaaaaaaaataaaatgaggtttagggtctagctgggattctggctctgctgagctgggttggttcttactttgcccccacctggaggcaattgctgtagcacaatgcccatgttgggattgggtgtccacttgggggctgtgctgacctcctttccaagtgtggatgactagcaggagggggacacaccagctggcagtcacgttcaggacagtatgtgaccatcaccttggtagtggcttttctcagtggacagaggacctcagagctggagcccagggttttaccggggattcaataatccttaagaagtcagagttgagctttcccctcttacgacaaacttcatttcctgtttcatcaaaaagttcttcctggcaaactgtggcttctcagcctgtcacctctctgccacgggaggtgagaacctctcccatgctgtgagatgactgagccgcggccttgtttatggaagccaagtgccagtccctcaaggcgcgtgggttctcagccctaggattcaggatggagccgtgttcagctctgggcaagggtaggatgctgactctgtgcacaaagacctgcacgtagtagtagcagaagaaaagggccttggggccttaaataaaggtgaggagtggggagcccctcaagagcgaagtgtgagggaattactgacgtgtgccgcatttccacttgaaagtaaaataaaaatgtttaaacaaagaggaaataggaggagcaggtgtagcagaaaagccaccagccagggaagccgccagatttgcttttgatttccagtggcacccgccctgtgccggacaccttaggcagctgacttagcctctctgagcaaacccatggaaattcagtgcctggtgcccactccgcgtggagaaggaggggagcactggggtcctgtccttcctcatgtccacattcaaaagaggactcataaccaagcaaagtaacggtgaccgagctgcctgagatggcttggaggaaggtctgaaatgggtgacgatggtggcgatgatggtaactgttgacgctcactgagcacccactctttgccaggcactgtacccattatatcgtctaatctttgccacagctcatggggcatgggatgggcatctgttattttcccctttgcagaggtgagggctcagaggtgtggccagctttccgcagccccaaccagtctcggatctgagacttggttggttctgagcaggctgatggtcaagggtgtcacgttccgggctggctctttgctaagcgtttgatgcccatcacagtggggagcagctctctggggacatggtgctgaggttgccactgatgagaggattggacagggaccaagctgctctcaatgtgatcgactctgttcctgtctctcagcatgccccgcctctcagggaataggcccagtggggtttccctgcggtgacgttgaaccagtgtctgctgcattcgaggggcctcagatggagctgctatctgaatccagggccccggtgagtgagactcatagtcggggtggaaaggtgctcaagtaatgagaggctttcttttatcgtagattcactgtgtcagtctgggacattccctctgtaaatgggaggtgcctagaagatcaaaatcatttctctagcatgttgtcaatttcacatcactcagttgcaatgtgaggtcgccaatccccattctatgcccataacagccccatgagaaaacgacaagaattacaacaagatgaaggccaacgtttactgagcgcttactatgtgtcgccactggttctaagagctgtgcttataccaattcattgggtcctggcaactctatgaaatgtacaagtgcttttttctatgtgacacatgtgtcaaagagtcagagtgacctgcccaaggtccacagccagcgagttcagcagttgggacttgagcttgtgtctgccgactccctagcccccagtctaaactgttggaccccactgctctggaatcttcttctcctggtttcctgatggcaaaactgggacccagatggttctagtggatttgcagatgccacatggttcaccagaggcccaggctgggaggcacacgatcgcatcctcctggagcctctggccccaagctgcaaactccaatgctgacgctacagttccatgagcccgtggatacgtcgctgaccgaggaacccagggcgacatgaaaggaacacgcttggccttgacaggcccagccccggccggcgctcacttggaggcagttgaaaggaaaactgcgataaggggctgctttatcacgcctcttgacaggccgagcttcctcccttgtgtggcgtgagccttaaacctcttccaagtcgcctggcatggagccccggccgcctcctgctccccaagggctggagcggggagcccattagccagtgggagtgggagcgggcccgggcgggtgccagccctttgaagccgcgcagagggccccgcacagtccccttatcttggctggtggtgttcctcggccggaaaagggaagcacagagaggaaaagctttcccctgtggcttttgtgtttggttcgcattaaatgaggctgggcggggtttttgttgtttgttttccaacttttcagcgaaaggatgacggatgacgtttagcgcagcaggcgcccacttctctggggtggcgtgcccatgtcatgccgcactcacgcacactcctgcctgttgattgcgcagtctcctctgtgtcttttctagaagctggggggctgcccaggtcgtcctgagaatagcggcggggtgcggcggggctcggtggtgccagcgggtggaggctgtgaatccattcactctgaggccctggcagccagggacctcgtctagacaggaagatgtgtgtgatgggatttaaagatgaggctctccctcctgctggggcgagaaggctctaggagccttggggccgaggtgatttggtttgtaggatttgcgcatttctgggatgtgcagggatgcggctttctccagatctaaggggagcccgggccagtgaacaaggggtgttcatggcactccgggggcgcggggctgggggtatgtgtgtgcaggccagaccatagcagggtcctcataagctttcacagggagtagggctggggcaaggggtgtgtgtgtgtgtgtgtgtgtgtgtgtgtgtgtgtgtgtgtatgtgtatgtgtgtgttggtgggggtggggctgttctcaacgagcagatgtgaaaatcaatgggagaagagagtaagagatgggcagactgcaatctgagtagttatgcacctaaacagatgcacacagagacctatgggtgcccaggagtgtcctggagcccgttttcgtggccttgtgagagctgatttttaaagttccaggaactctgttacatgttgttctgacctatgtgcctgaggtcataggcatccgtgtatccacatggcggaggtagcacgtaatggtgccgctgcacttctcctcccagctccatatacagtatcgtcacaccgggagctggaaatcagccactgtgggagtgttgacaccgtggaaatgggcaaacactgcaaagcaagctttctgtcttggagaactggtcgttgaatatttcctggtctaccattgcatacctcacaggcacagcgcatgcaaacccagagcaaggaagacagacagacgggctacctgaacgaatgccactttttagttttgggaaaatacattacatttttatacattggttgatttccctcttcttttttttttttaaccttgtccattttatgcatgtggaagaatcactcagagatagggccatggcttcaccaagctgcagaaggggtcattggtgcaaaaaaaggttaaaaatttgtgccctggagccaggagatgattttccttttctagtcctctctctgaatacaggacattctcctagcttgtgggcaggcagtggtactttttctctcctggtaaagagtccttagcagacctccttgggtccttttgcagaggtttgctgagcacctcttgtgtctgggcactgacctgggtggttttcttaatcatcccttgatgatctactggctttggagatggtggcttcccatcttggggctccccaaacccagtgcttcagcacctcctctgctgtactttgaatgccagtcctgtgctctgcaaaccatggttccctgggaaaggagcatgttgattaatgttgtgttacttagtcagcatttttaacatttataattattttatttttaaatttttttttatgttacccaagctggtctcaaactcccgggctcaaataaccttcctgtctcactctcccaagtagctgggactacaggcatgtgccaccgtgtgtagctgctataattattttaatggcacctttatttcattgtgtatttatgcacacatttgatttcctgctggtgatcctggtttcctatttatggcagcaacataaagtttctttcaagataaatttctgtaagtaaagatatgaatttaaattgtggagagattcagtaaccaacagtccagtagaagatcaggaataaggctggaaaatgactgaggttggggaacagtggtgtgtccatttgtggctgtgtattcttccctctttagagactacaggaacagaagatcgtatagttgtcaagagaatgggtcttggaggtagacctgccgtgttggaatcctggcttctctcttcttagctgcatgaccttgaacaaactaatttctctgagcctcagttccctcttgtttaaaattataatacctctctcatagcgttgcagtgaagattgatagatatcatagtgaagattgatagatatcatacatcacaatgccctgtatttagcaagcacgcaatacattattagctgtcattgttgttgttattatgattaattatagcatctccctattatccagttttccccagcatggccctttttgtgaataggcagaacttaacaaatatttgttgacttgaattgaattttaaatgtttagaaagctgccaggcctggcaccttttaaccaggaaaaagcaattcggaaaccagacagaaagtaagcagcaattttatttctagtgaggaccatcgtcattcctgcgtgtgtcagacagtcgtctttccccacttcacctctcctcttgggaatacctttctagacgttcttttggattgtgagtaagaggatgagaacatttgcagactgacttgggtgtcattacttggtatgtttctgagcagttgaatcatctgactctttgtacatggcagtttctttcagattctcttttggcactggcttttcagagaaatcattgtttttgaagcctttggtaaagcaggccggtgcacgtatccatgtgccatttgtaccttgagtttgtttaaccagaagccgcctagacatggttgtcttactgtctttgcaatgcagttgagaagaagttgaatgaaggagtgggggacttgatgtgatgctgatgggctgatgagtccttcaattagacttaggtttaattacctctaacagaaaaccccaaataacagttgcttctcatctaagaatgtagaaaatctagagatgggtagtccaaagtgctatgaagtcattaggaatccgggttccttcttacctcctgttcaactccaggtcacctcagggttcaaaatgattgctggggctgcagctaccacctctatactccaagcactggaattccaaggaaggagggagatagggccaaaggggcccccctcaccatcttggtgagcttcctcccaggaactcttctgcaagtcatctgcacacttcttttttttgagacagtctcactctgttgcccaggctacagtgcagtggcacgatcttggctcactgcaacctctgcctcctgggttcaagcgattctcctgcctcagcctcctgagtagctgggattgcaggcgcccgccaccctgtctggctaatttttgtatgtttagtagagacgggggtttcgccatgttggccagtctggtcttgaactcctgacctcaagtgatccgcctgccttggcctcccaaagtgctgggattacaggcatgagccactgcgcccagcttgaatgtaattctttatgcactgggaagccatggggggattttaagtagggaagtgataggatctcatttgcttttaaaagatccctctggctgcttgtggagattctattcaggatagggacaagggacaaggcagaaattagcgagaggctggatgcaggggtccaggtgagagatgacagtgctgggacccagggaggttgatgagaacgtgaaaagtgggaggatctggggtgtttcttgaaggtcccgttgaacaacactttctgatggacaagggatagggtttcagtgcagattttctgtttcccctcctcataaatgttagcttaatttaagaatgtttctcaataggagtgatttcgtgtcccaggggacatttagcaatgtccagagacttttttgtgcatcacagttgggaaaagggtggctgctgctacctactgggtagagtccagtgatgctgacaaacaccctacaatgcctggggcagcccccgacaagaaagacttatttggcccccaaatcaatagtccacactggccaatagtgcgaaggttgagaaatcctgatttactggtttcttactccaatgtcttaaattctgggattatgataatcccacatgttaccatccatccagagaagcacccgattcttcaccaaaggaatgtgtattaataatcctgaaggacagccttcagcttaatcttctttcctgagaggcactttgctgcgtgaatgactaaacggaggagtgaatgaacttgggaacggccccgatgaagaggtgagtcagactggctcagcccacaggcttccatcatgtttatggaagccaggccccatacgctccacataagaacgggccccttgttcctgaatgatgcgttttgttgatctgccagtgggtcccgcctctccccaggtcaccgacagagcccgtctcagcgccgtctcgccgtgctgagtctaagagttatgcagagagccctccaaaaacccaccctttgaaatgaaagaaactggatcttaaaatcccaaaatagagtgtggaaaggtacacatcacgtctgccttctcctttttttttttcccccttgtggcaaaagtgactcagaatttttggtctgaatccagagagacctgcacagtctttggtgtgggggcggaggtgtcattcgattgggaataactcaccttttttatgccatggctggctcggccggctgtcctgcatttcctcagccctagcttttgcctcttcaccatcttggggttctttttcagctgtggctgtagtgaaagaggagaggccagagcttatggctcatccagatgtctctggtggaacattttttcaaagctgaactgcagtttcctgggaatgtttttgttttttaatttaattttattttaagttccgggatacatgtgccggatgcagaggtttgttccataggtaaacatgtgccatggtggtttgctgcacctgtcaacccatcacctaggtattaagccctgcatgcattagctctttatccagatagtctctctgccctggctcccgcagaggaatgtcttaacaatgtgttctgaagcggctgccatcccagcatccctggggcattcacacactgccatgctgggcacggtcagggccagatgcttgcacggagtttctgcaagctgcattccccagttgccgtctcttggggatcccctgcttctcccagagcccaggcctctgcagatagtagataccttgtttcctaatatcaggtcagtgtcctgagtgagaaactccgggagaaatgtttctgaaggatgctttccccttgtgttctggtcttcgggtaaacacttggcagcagggagcactgcgcatgcctcacttttccctcgccatctccatgagctgccaggctgctgtgctttcaattcaatctcaagattgtaaacttcatttttccagcccaagttagtctgctcttctgactttcagtgtaattggcctggtataatatgtctctttcatggtgagacacattcctgcagactggctcaaatgatagtgagcttaggcagactccaaacgtagggattctgttccagacatgaatgagcctcctttctcagagtcgctggagaatgaatcactcggcaatatgtggatccacataggaacctgagaatcaatctattcgtttatttattcagcaaatatttattgaacatctactgtatgccaaataccgtcggaggtgctgaggcatggtgatggacaagcttacattctagtggggcggggggtgggaacaggcaataagcaaacacataaagtaacacttagcacagtcaggaaggaaataaacaggaagacatggtggaatgatgctagaggagctctctttctgccaggctacccagggagggccctgcatttaggctgagacctgaaggatcaggaggaaccagctgtgggaagacccaggggaagaatgttctaggccaagggcatagcatatgcaaaggccctgtggcagaaacgtggcttgttccaggagcagcaaggaggcccctgtggctggactggagttggggagatgaagctggtgatatgggcgggggtctgatcatgcagttttgtcggctgcaatgggcagtttggattttcttcttcttttttttttttgaggcagtgtctcgctctgtcacccaggctggagtgcagtggcacgatcttggcttactgcaacctctgcctcccgggttcaagcgattctcatgtctcagtctcctgagtagctgggactacaggtgcacgccaccacgctcgggtcatttttgtatttgtagtagagacggggtttcaccatgttggccaggctggtcttgagctcctggcctcaaagaatccaccctccttggcctggatcttattctaaatgtacctgaagatcatgacatgttagcactgaaagacaaccttcaagatgatttcttccaagaactgagaccagaaaagaggcccttaattgccacaagtcacccagccatagatgaaaaaatatgaatgaaagttaatattgatcgcttgtgacatgctttatacacagcccacttgttcctgccaacagcctagtgaggtgtgcagggtcaggagccacatttacagatgatgaaactgaggcctggagatgtaaagtaactttcccgccatgacacattaagtgccagtgccaggatgtaaacctagatggttggactccagggctcagactcttgatctcagtgttacactggttctgcgcaagaggaatatagacagaagatgtgaaaagcacttgtatggcttcttaaaaaaaaaaaatcaacaagaaaaagcccaacttcaaaggtcaactcaaagaaggcttgcatattttaatcccatacttccagacccagctcctatatgatggtggggacgggaatgttggtagggagcccgtggctgggttgacatctctgtccaggggaccagaagctggaagctgagagtggagaggggcagctgagagcagagaagggaaggttcatgcctccagcccccaaaggaagggacaaaatgatccaggttttttatttaaagaccccatgggggaccatgagtagagggggctggggtgcagcgtttggtcctgagtcctgttaggctaatgtgccttgtctctgatctctccacactggtttctagggcttcctcagggtttcaaatgtggacatggtaattggaaacaaatctagcatgtttcgggccatcaagtctctcttgagtgagcgtgcttgctatgcggtagatatgtctgtttttaattttcagtgatgtgagaaatatagaatgacttgattcttaatttagaacactgagagagcctgacttgtttggttttcaagcctgtccagaatgtctaattctttttatggttccctgtgtaatttcaaaatgtgccactatcagcagggcggctgatcacagtggcctcctgcaggactgaagacacatccagccagtgggatcccagctgggtcagaaagcaggcgcagggctccttcttcatcatacctggagatgctgtcacctctgttcggaacagggcagcccaggtaccagttgtccaaccagctgagtcgtgcccacaccgagcaggacaaggctctgtgacacaatggtcgctgtgggccgggaggagaattgcccaagctggagagaagccggtgtgggcgtataacagctctttgtcatgggagaggcgtaggtctggagagactgcagctgctccggcccctcccatgatgtcacagactcttccttctagccttgctcgctcgttggacacctgtgtggtgctctaggcattgaggctgcaccatgaacaggaaagatggggtgctgcccccacgggactgacattctagtggggaggcagcaaagagcaaataactatcacatgtggggtcaggtggagggaagcgtcaggtggatgatgcaacttaaggcagggtgtgtggagggacagtgggaagggcgtggggtgtcacattggggtgcggctgtctgggaaggcttctctgatgagaggtcacctgaggacaggttccaatgaagagtggggtgagccctgcaggtcatggagggagagcatttcaagctgagggcatgataagtgttgggatgcagggacgggcacctgcctggtgggtgtctggctctcttgagggtgacaaggccagtgtggctgtcatggggggcagcagggagggaagaagggtgggtgggagatggagaagcagggccagatcatatgggatcttctgagtcatggtaaggactcgggctttttgatgcaaggaagatgtttgctgttggggcgattttagcagaggtggcaaaagctctaacttaccattttaaggatctttctagctggactgctatgtgaagaagactgtgtgtaggtggagggagaggggtgggtaaggagactgggccccctctttgaccagggcactagagtggaagtgatggagagtcacaggtggcaaatttgagtgggatttagggaatggaattgacagggctttgagatggatctaatatgggatggaggcagagagagttaccaagagttagggttgttattgaagtgattaacacacagtcatggcttgttggaatgggtgagagtcaagtcacggacgaagtgtgcctggtctgcttgtgtgtgtgtctgtgtgtgtgtgtgtggtgggggggagagggtggaaggtggggttaggatggcaggtacgtgctgcaactttagcaccccaaaatagatactgaattgggatccatgtgtgtttgtaaaaattttctccccatgtgctgcatggccatggggaattgcagtcctcttccccggtaccctcccgctcggccttctcccccaccctgggctttttctttctttcagagtgaaatctttgaggatgatagcaatttcctaatatttcaaattcaacaaaatgctacttaacatcgttaatgttttattttagtaaaattcaaaactgtttggcccgttgccattttgaaaatcagtctcacattttggattggaatcgtccaactgagagtatttaaaaagccctgagcagagttgatagcagagtcgttttcagagacgtgccacttgcaagggttcttattgcagtgtttgtaatgggggaaagttgggaaccatctaaatgcgcacctggctgcagggatccacaggcagaacgggcacgcaagggctggggctgggttgcgggaagagaggcaccagggggccaaatgtagagtggggctcactctcaggagcccaccttgcatttgctggaccttgatagtgaatgccccctcagatcgcgtgtcctggggacctcactggccttgggctagtccgaaccctgggatgtgccatgtagttctttgagattctcataaagcaagattcaatgacaagaggacatgaccatcttagtcaatggagacagtacataaactcgaatgccaatatgttgatctgtgtgcctggaagaaaagtctgaaagcgtagataacttcagttagggggataagctttagtgatctcttgtacagaatggtgactatagtaaataatcattgtctatatttcaaaagtgctaagagtagatctgaagtgtttttaccaccaaacaataagtatgtgaggtgatggatgtgttaattagcttgatttaatcattccacaatgtaaacacatattaaagcatcacatattgtaccccataaatatataaaattgttatttgtcaattaagaggaaaaataaaatgaataataaaacagtttggaatgaaagaaaagtttggaaggatgtacactcaaatgcttacttattttcaaggggtattctttttgtgatttatcttgtctattttttcctgcaatgagtgagctcttagtactttacaccaaaaaaaaaaggaacagcaagaatcaacagatattgatgcctttttatctttgtatcaggacagttaagttgccactaaaaataggcagatcttgaatttggtggcaggcaggggtgagtctgaataaccttctctttgacgctgagggtctttgacacgtggaggccatgtttgtgtgtctctgggttcttattgctgagctggtggggtggatttgcctgtcttaaaatgcataggccagacttggggggctgggggtggggggattttgcctttttctgaatcaggaatcagccatacaacagaagaaacaaacagggccagtggaggctgttgccacctgatcacttatgacctgtaggatagtgagcaagttagttaacctggttgagcctcaccgttctcatctaaaaatgggataacactgctcttctctgagcattgttatggagattacattagctatgtttgcaagcgatcccaatacactgtgtagaaaggtcttcacctatggagggtgcaaagttttccttgtgatgaggttggatggcgtcatttatatagctaactgtggcgggatgtctaaatcacacgtcattcctcagatccggtttttcaagtagctgagctgacaaggggacagagtggattattaatagaacgatgcccccaagcctgcagttggcttcttgggtccctttgatgggaaggttggtggatggaagtcgcaccaagctgcagcctgggcccccacccccgcagacgccacagacactcccctcccgtgcattcagcccttcacggtgtgcactagaagcactgcttcttcctggaaccttttcagctgcctgggaaattacaagaagcagaaaactttcgctctcaccttggctgcaggaagtggcgtttcctttgctcgggaggccagtgacgtggagctcctgtattgcagaatgtgtctgctgtgcctggagtgtgatccggctggtccaggccaccgagaagacctcacctttggagaagcctgaaaaggccgccccaaagcctcctgaccgaggtctcccgaaaatggggatggtggggagtttggaacctgaagggtagatcatgtcatctcaaaacatcaagttctatttgcaaaacccaaatcactgagtttttggagaagcaagtaaatggctatctgttcttctcatcaaacctccagggacctggtgaggaaggctcttccagaatgaggcagctgagcagttgggattctgggcacattctgtaccttttgtaggaggggaggatggagggtggacgggaagtattcctttcatgaaagatggtgaggtttcttcacctggcccctctttcctctgacactccaagccggcaactgttgagccagcccactgagaagactgcaattagtgcctgggctttcccatatgggaggccttcacgttggttctcactttgttcacattcattcttcacccttccattcagttctgtaatatcacctccctgtttcgatttgcgtcatcctccgatgacaaggaaagttctcgtttcatgggtacctaccgtgtgctgtgctttggtgcccaacaaaggtcaccttatttcgcctttcagaagaggcctgcagggtggggggtgatgtctcctttttatctgagcatatggaaactcaggggtggagcgattgctcacagtcacacagccatcaagaagcagagctggcatcgaaattcagatatgtctgacccaaagtgaaaaactttgtgctttcagctataccacactgctttctggtgttacccggggaggcggggaagggaccctcaccagtgccaggtggattctatctgctcacattgtataagccagcccagctcaacccagaggctgctcttcaactcagagaggccattcttggctttcctaaagaggtttttctctcaaggaactaccgtttttgtttgtttaggttgctgtttgtttctctccctccatctccctctgtgccccttcttttctccctccttcctgccccactctctctcctgtgcggcaggaagcacattctattttttttgagacagagtcttgctttgtgacccaggcgggagtgcagtggtgcaatatcggctcactgccacctccaacccccgggttcaagtgattctcctgccttggtctcctgagtagctgggattacaggcacgtgccaccatacctggctaatttttgtatttttcacagagacggggtttcaccatgttgcccgggctggtcttgaactcctgacgtcaagtgatctgcccacctcagcctcccaaagtgctgggattacaggcacgagccaccgcgcctggccccaggaagcacattcttgatgttgcaccttagcacttgcttattttgcctttgaggacctgccctttctgacctgtagtaatcagagagcagagtggaatccaccaagcgctgaggacagagagagggtggcagggaagcgggtgggttcggagcctgagaggctggagtttggagcctggctctgccctatgctcactgtgttgactgggacaagttgccagaccttagcagcctcagtttcctcacctgtaaaatgtgggtagcagtgagcccatcttacgtggaattgttgtgagatgtgtaaaacatcaagtgtggtgtgtggcatgagggaaacagatgctttcactgctgcattactgttttttgttggtttatttgtttgagacagggtcatgctctgctacccaggctggagtgcagtggcacgattgtggctcactgtagcctcaacctcctggactcaactgatcctctcgcttcagccccacaaagcagctgagactacggacgtgcgacactatgcctggctaatttttgcatttttttggtggagacgggtcaggccatgttgtccacgcttgtcttgagcttctgggctcgagagatctacccaccttggcctcccaatgtgctgggattacaggcatgagccaccatgcctggcactgtattactgttgatggtgacagattattcaacaaatgttcattgaccatgctaacaaaatagcaaggtccctactgctgtgaaactcacgttcaggcaggagagagaggtgttcagcaaataactaactaaacaaggaaatttcagatgttaatgaagtaaatattccagtgatgtgctagtaaacgtttaacatccagttttccagggggaaaaaaaaagccctgatctatagcatttgtcaatttttgtggtgtaaatattcccactacggctggaaacgtacataccaaagtggtgtcaactggctcttaaaattcctataggtttaacgattggttcttgtaatgcctaaagagctggctttagcactgaatgcatctaatctggttcaggaaaaacctgaagatctgaaacccaaatgtgctagtggaagaggattctaggtggagaaaatggcttgtgcaaaggccctgaggtcagaaagaccttggtgtgttcagggaacaggaggatggctggtgttggcaggagcctagtggggtggtggaggagaaggcagaggctgggctgtgggaaggctcttagactatcacacagagtttggattttaatataaggccacaggaagtctttgaagggttgtaggcaggggagtatctggatctgatttgcatttttaaaagatcatcgagctgttctgtgaaagaccagccagaggtaagctgggcaatcagtgctggtcactctaataagggttgatggtggcttgggcaggtgtgccaacaagagcggggatggaaatggctggattcacatggagctgtagggacacgatagatttttatctccaggtgttccctgcctgtttaccttgagtacacccagcaggcgatttctgctcttctttcattgaggaggaaacagctccacatcatcagggctcactctccatcctacctttcttcttgataccaactcttgataaatccaggagaggagatgaggaaatatatttgtcttgggctcaaatgcaaagcaaaaacaacaaaaacaaaatctcttctcaatgctgcccttattttgattttcgtcactgagtacagtagctgttcttcagataagaggcttctgacttggatttccatcttggcccaaggccgcctctcaggtgtgtgtcagacacttatgtaagtgtctggcaggttatgaaaaaaggtgatcatctagcacagttccactcccagcctctctctttgtatggcttttagaaggggacatgagcatgccatctttctagaccagcattgttcaataggactttctgtgatgatggaaacattctgtgtctgtgctgtttgttcattgtggctgccactagccacatgtggcttctgagcactgaaatgtggctagtgtacctgaaaaactgaattttcaattttacttaattttaattaatatatacatgtggttagtggctcttgcattagattgcacaattctagaccatatgtaaccattcatcaccctgcaactttgccttttggcaggtgactggagatcctaccgaaggatctccagagaagagtggggtcttcgtgagttgtcacctgtagtcccactcaattagtggagaaaggaatagaggcacagaaagattaaatgatttgtctagtgtttctccactcaatgacaagacaggaacacatcatcaaactctagaccaatgtccttttgtctcttgttattttatatatatatatatatatatatatatatatatatatatatatatagacacacacacacatatgtatatatatatgtgtatatatatatattttaaatatttcacaggtttctaggaatctatccttcctataacatggcatataaagtcaaagtcctctttgatcaccttctcaatcttgagcttcttctccattcacagaggtgatgatgtggtcagtttggagcacatcctttcacacctttttctattataactggatggatggaaaacattctgcatttttttaagttgtatcatgctgtatgtatttttctacacattgcttttgtttttcaacagcgtgtcctagatctttctgggtcggttcataggcttctaccttactattttttaaagtgcttcttagtgtatcacagcctaggcatgtcctgttagtagtcaggctattgatgtaactcattgttcattattctgtttgtttttgtaaacatttttgtacgtgtctcctgcatatacagtgtttctccaggctgcgtatggagaggtggaattactgggtcaaagagtgtttatttatgtagttttactaaagctgttgctctgatactctttaaaatagttataccagtctatattgctcttacctgcataaaagtgcctgttcccccacaatctccaaaatacttgatattatcaaatatctacatgtgtgccaatctaacaggtgaaaagtggtatctcatggctgtctaatttgcatgtttgtttagaagtcaaactggtcatttgttttctctgaatttcctgttcaaatatcttactcactttttttctgttggatagccttattaattcactcatcaaatatgtactagaatgcctactatgtgccaagcgttactctaggtgctagagattttgtggcaaattaactagacaaacatctctgctctcagagaggtgacagtttagttctgggagaaagacttaggcaaaaggaatcaagaaaatgtatagtgtgttggactggataaaaagtaggagagagagatagggaaagccattgggattaggattcaattctaaatagatggccagggaatcttttacttactcactataggcattcttcatatattctatgtgctaatcttttatctgttatatgttgcacatattttctttcagtctttatcttttgacttagactatggcatttttgtcacactcttttttaaagttacacaatcaaactttgttcattggaatatagtcatataagaagtgacagttctacatggacacaggaaggggaacatcacacactggggcctgttgtggggtggggggaggggggagggatagcattaggagatatacctaatgttaaatgatgagttaatgggtgcagcacaccaacatggcacatgtatacatatataactaacctgcacgttgtgcacatgtaccctaaaacttaaagtataaaaaaaaaaaaaaaaagaagtgacagttctttcttctgatcttctcaggcaatcactatcaagagctctatgtttgtcctttcagtttatttgcagttaatttcagttatcctcactactatgcaacactccttccaccctcagtcatcaattaagcacagtttctggctgtttctccataaatgcagttctgacttactgtattctttctagtggctgcttaatattcagcattagaggggatccctgtaatttatccaagcgttaccctctggctggacatcaaggttgtttccagttctccattcttccagatgctgcagaaatcccatagtctctctactgcccatgagctctctggtctttttttgtttattggattagagccaccacaccccgcaccttaatgattttgttttctcccccaccagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaacgtaagggctgggagctgagggcggcgggtcttcatggagaagcgagcagggggcaggtggcagggatttgggagaggggactctacagaactgatggaagcagctgttgatggcagttctcagtctgtgatccatcgacccgttgtgatttctgttttaaatgtttccattttaaaagcataatatgtaggccgggcgtggtggctcgcgcctgtaatcctagcgctttggaaggctgaggcgggtggatcacttgagatcaggaattcaagaccagcctggccagcatggtgaaaccccatctctattaaacatacaaaaattagctgggtatggtggcgggcgcctgtaatcccagatactctggaggctgaggcaggagaattgcttgaacttgatgcgggcaggttgctgtgagccgagatcacactactgcactccagcctgggtgacagagtgagactctgtctcaaaaaaaaaaaaaaataaataaagtataatatgtcagtattttcatgtgcctcgggaggaagaactcgtgaatatttgtgttatgttgcatgggatcaggttaaatttacttatatttaaaaaattaatttgacctagagagatcattaagtgatgatgcagagaggcccaaattcacaaagctaatatggctgtggctaaaatctgggaaccattgcacacattttggggttaaaaaaacctttggatgggaaaataaattcaaacttacagaaatactgcaagaagtgtacaaagaactcctgaatcctgccccctcggctttcccaggcgttaacatgcttcacctgtgctccagcactttctttcccacctctccgttttttcctgaactgtttgagaggtatttgcagactttatgcccttttacttttaaatacttcaggatgcatttcctaagagcaaggatgctctcatacacaatcacagtacatttattcaattcaagagatttcacgttgattcactactcttatctattgaatagtccacaatcaatagtccccagttacatagagtttttcagatgtttttgagagtagaagagttggcatgaaaaatctccctagacaagtaattttcactggggaatttctctaattgcttttgttaagtattttttacccccatcttggtatacattcctggctgaaatgcttatgtgagtgtattgcagtttcccccagtgactggctgtagactggcagctttgggggtgatctttcctgctcctgaaggtagttggtgacaatggggttcttaacatcctggcagcatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctgtaagttgggccctggggcccggtctttcttcagaaagcgtagggcacgtgggcttcccccgggagcagtgtattctgggcgaggtacccggggtggcctgcgggaatgtgtgggacccacagggttacactggcccaagatgaccagaggggacagagacagagcacattgcagtgttctcttgctgcttctattgacttctggaaggttttgtggcctcacaggaaatttaaaaataatagggccaataagtagcctaaagcttcattcagaagacttgaaatgtgtaaatatcattctggtcttaaaggatagatgcatttggagtgagtttgctgtgcatggtgcccttttttcttttccttctttatcctttcaataacaataacaaaccacagcagctctcactcattgagctttgactctgctggtcacagtgtgaagtgctccgcatgagtattcacagcagtcccgggagctagctggtgtcagtgtgcccatttcacagatgagaaggtggagtcacaagggggtaaactgtgcacacaaccaaagagtggcagggttgggattggaactggggcttttgcacgtgggaggcatgccctgtcccccacccatgccctgtcccccaccctgtccccgcacccatctctgcatgttgactgaggtctgttttttatcctgcactatgccaggggttggggatccatagatgagcaggacactttctctggccttaatgagcttacggtctggagaggataaggacacccagacagatggttgtatcattgcagaagattttcggagtctgatacgaagtgaccaggatctgccatttggaaggacactgagcagaaacctggcacatttctaccaggtttcaaaacaaaaagtagctttgagctcattcttacgtactttatacctaagtttaaagtctacttatacattaacacagttttgtagttaatctctgcaattagatgtgacaacacttattatctgctcagtgtttgaaagtttagaagttattttagaaagcatgaagaagaggcaaggcgcagtggctcacacctgtaatcccagcactttggtggatctcttgaggtcaggagttcaagatcagcctggccaacatggtgaaaccccatctctactaaaaatacaaaattagccgggtgtggtggtatgcgcctgtaattccaactacttgggaggctgaggcaggagaatcacttgaatccgggaggtggaggttgcgatgagctgagatcgcaccactgccctccagcctgggcaacagagtgagaccctgtctcaaaaaaaaaaaaaaaaaaaaaaaagaagaaagaagaaaaaaataagcattgttccagaaacaaaaactgtttctattgttttaaagtctctttcttctaagaacatttggtttcatgctgttctaatcatgttccatattaaattatggttcaggattttttttcctttttgctggacattttaccataactaggtgtcacaatatcaacttcctacagaggccagggaggttgtgaaaatgaatggggtaggttgggtggcagacgtcagggaatagtggagattggggacattcactatctaaatgcgctgctgctactcaactgcagccagtatttccacgtgggaatatagactcaatgtgatcaaatattttggttattttattttattttattaagaaggaatctcactctctgatccaggctggagtgccgtggtgcgatcttggctcactgcaacttctacctcccgggttcaagtgattctcctgcctcagccctccaagtaactgggattacaggcacccactaccacgcctggctaattgtttgtattttttagtagagacagggtttcgccatgttggccaggctggtctcgaactcctgacctcagatgatccacccacctcagcctcccaaagtgctgggatcgcaggtgtgagccaccacacctg

SEQ ID NO: 16162 - DNA, 8488 bp, Human
gtatccccttcgcaaattaaccttttgttaatatagtagcagtacttcttgttgccaagagtacataaatggacaatcttgtgtgctactggtgggaatataaataaaaacagcactgactttataagtctttctgccaattttttgtcatcatgaataccactgtgctatttgggaaggcaactgggaaatgtgtcaaaaatctaaaaattatttcacccttccctttagcccagcagttctacttctagggatatactctcaggaaacaattagggatgggcacagagactttcataaagtcccagtgctgtgtgtggcggtagaaaacagggaagtacctctgtgttcatttctggaggcctcatcctagagtaaatcatggcccatccaagcatgctggcacaaaattcatgtggagggagacttagtgacatgttctaaagcgtcccaaagagtaggctacaaaacacaacataaggtatggtcccaaatcatttctaaatgtatgtggctcttctttatatatgtggcactcttctctcctttctctagactgtgttaccaagcaccagggctgttaactgctgtctctgtagtaagaactactaatttattttttctttttttcgagatggagtctcgctttgtcgcccaggctggagtgcagtggcacaatctcggctcactgcaagttctgcctcccgggttcatgccattctcctgcctcagcctcctgagtagctggaactacaggcgcccgccaccacgcccggctaatttttttgtatttttagtagagatgggatttcactgtgttagccaggatggtcttgatctagaactactaatttcatatctttcctccccactccacctctcttctgagctccagcctcctagttccatgtacctagcctacctctccccttggagggctcacaggcatctcaaagttaccgaataggccaaacaggactttatgccctcaaatattcctcctttgttcttccatatgtcagcaaaccacacttctgtccacctacttattcacaccagaaacctaaattacctgtcaatccaacactacttcttgttggttcgatttccaagttatatctagaatccttcccactgcccccctcctccacccaccatcttggcacctgaacttcacaggagcctcctaacttgccccttcccagcactgctgtgcccggccgccacagtcacctttgaaaatgcacggctgctacttcatggccttgcctaaagcccctcaggaaccaagttccagatgtggtctggctcctgcctacctcagcagtgtccttggtgtcattgtccctcttctgccatgctcccgcctgctggctctttctgtccttccaagccctcatgcctccctccctcagagccttcacacatgctgttcccctctctgtagtgctcttcccctcactcttcatctgcatgacgcctcgtcctccttggttctcagctaaaatgtcactttgtgacccccagccttgatcaggtcccagtgatcactccagcaccctgcattctcccttgaagccttgagcaccaaggccatgacttaggtacgaggtgactttatgccacctgtagtagatggtaagctctgtgaggccagggaccatggccagtttgttcatggtggtatctgtgccagtgcctggcgcatggtattaataaatgtgtgtacatgtttgtcaataattttatttaaagaaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcaggttagagccagcaggtccttggcactactgcatgccagaggccctctgccgggccccgggctagcctccaagtcctagactgcccatactttcttagagaagaaaccacatttaagtcaggcctgccccatggtcagtggcagagtccagcaatctctaggttggaagatgtttgagtctcaggccccaaggactcctctggacaggcatccgggactcttcctgtccccctgccccctagcccaggtccctccacttctcgctatccccacagctatacctggctctggccactcacagctctcacctggctgactttagcggccggcttccctgggctccctacacccatctccgcccttcctgttcagctctatgcagcagccagcagaccccatttaaaccattctgtccatcatgcttctgccaaaaaaaaaaaatcccccagtggcttcactgagtgaagctaagcttgtcacattgccctggggcagtcctgctgtaggccgggccctgcccaagtctcacccggtgccactcctctccctgacaccctccagctacatctacctttggtctgtttctcagtcaagcctctccaaggggccttctctgagtgctagatcagccttccccaatcacatgaccctcatcactctctgacaaggtctcaggggtctaaatgtgagcgccgggagggcagaggccttgcattctgtttggcacacagcaggtgcttggtaaccacagaccgaatgacaaaaggaaacagcatccacccacccaagtcctggctggaacacccccaccccctccattcccccagagaaccccttggctcaagtccacagtcagcctgggaatttccttgggaagcttccctgacccctgcacggctgaggcctttccctcctgctctcacagcgccacagaggccgtgtgtgcttctcacagcacagccatcaggctgcaactgtctccccgtgggctgtccggagggccacagccctgcccctccctgggtagccctagtcttcttgcccctcactggccagaagtgaatcaaaagtacagaacagagaagactttgccggggcttggacccagccctctcatgttacagatggacaaactgaggcccagagaagttggaggacttgctctgggccacccagggagttaacatagaatctggccggcttgagagagagcccccagcaccctgtcgacggaaccccaccccaaaagccttccctgtcccataatctattcattctcctctgtcacgtggcccaggcagaacctccacaggctcaccctgctcgcctctccagcatcaactctcatcctctcgccagccatagtcaagtactttgatcgctcagaagcccctgtgggccttcacacgctgcacctctgtttgcttctcccctccctccccttgcctggctgggttctcttcattcttagagacccaggcatctgctcagctgagaagccttccctgaccgcagtacccctcccagaccggggaggcacctcttctccctgctgcctccatgagcccactgagcataatggccctgctctagactgagcttctccagcacaggctctgtgtcttgtgccctcggtgcctggtggtgtttggcacatgatggaggtaccgagtcaatggctgttcattgaccgactgaatgaccagcatgtccagctgccacactgggcacgctgccctgggctctctctcaaggcttctgtgtcctcaccctcagctctggtgagctctgttctgtctctctctccctcagcagttgtagctgctggcccatgtgcccaggctctcctaacacctgttttccctgactcagattccctaaagtatgggtcctctggctacatgacattcacctgccagggtgactgacatttaaaaagggggcctgaggaaagaacagtgctcactgaaggaaaggaaacactcacggtggcgtccaggcaagagtgactggccaaggagccttccaggaagcccgcagggagcagttccgtttcacaggcggggctgcgggccacgcccactccagcgactccccaaggcagggggagtacagagttccaggcgccaccccgctgggaataaaagcaggctttccaggcagcgggctcggaatagggtcccgagctaccacccacttcctagcttgccgcaggggcacagtgaggcagtgctgatgtcaggcctctataaaccttcaggaatgctgcttattggaggaggttaaatttggtagaaggggtactagccttggtggcaggcagggctctccacccttgatccaggcaaatcagctcacctcgctgggcctcggttttctcatgcatatcatgaccctagttacacctccatgttactgtgtgcattgcacgagaaagtgcccatccatctgcagaccctggagcttgctatagggtggtgattctcctggttctgtgaagggcttagcctgaaggataaaaaggtgtggtctggttgggctggatttgaactcaggccctcagtgagcttgtagggcacctagtaacattgcacagtgtcactggggtttaagaatgtaccacctattgagctctgcccacatgccaggccccacgtggtgcaccttatgaaaagacacctgtttatcatgcagcctgaggaggaaagcatggagactggggcctgggtgtgagtttggcactcccctcaacctgcactgctggtccagtgggtggcaggagctgcctgtcccaccttgcacaggggggctcaagggaagctgaaagtgaggagacttggcttgtatcctgactcccctcagtgaggtgctccatctctgtgagcctgctgctgcccctcaccccaccaagatgtctgacaggatggatttgagaaggaggtacaacacacaccccatgatgcacggttggcccccacagactctgatgcaggccacaccctggcgctccctgagctggcctggttcagtgctctttactctcttagaagaacattggccgggcacggtggctcacacctataatcccagcactttgggaggctgaggcaggcagatcacctgaggtcaggagtttgagaccagtctggccaacatggtgaaaccccgtctctactaaaaatacaaaaattaaaaaaaaaacaaacaaacagaacagctgccatttgctgagcacctgtgacacactggggacttaacatctggcctctccctctggggaacctgcacaaacaaagcaaccttcaagagcccttcacttgatgctttaagcacccatccataatggcccttaattgactcttaattatactaacaaacactatgtgtatttccatgtaaaaagatgttacagaccaggctaaagtccataggccaccaccacctcagtccagctccagctcgtcttgctccccagggcatatccactgctatcagtttggctgggccctttcacacctccttctgtgcattactttgtgtatatgtgcccaagaaaaacctctttctctcctctccagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtgactggtttaagattatttctccttaaccttgcaaaaacaggggttgggccttattttccccaagtccacaattagccggacttgccccaggcttctagaacatacgattctgagaagatgctggcgttctgcagaggccagcaccctccaaggccagtgtctgatgagccctcttccatctcatctgctctcaccccaactgccagcttcaggaacccaaaaggaagctttactccttaaaacctagagttaggaggggctgagagttcagggaatgtttgagcaacaaccagagaagccttatttcttctggaaggaggacagcctctggacccctcttggcccacagcattgggatctctggcctggcattcacagccacccttaggctcaggccctgctgctgagcaggctgacccagctccctccatgctcatcctgcccacatcggcccgcccaagaccaccaaattacatgccacctgctgcatgccaccagccatgggcttctttattgagcaccagattttcagtacaagttgccacagaaggagggtttcagattcaaccatgcccatgtgcaagggcgctggtccctggccagggcacataatcagagaagtgacgcggccatgccgaggtatacgtgtgtgcagaaatggacacatagggttcaggagcatcagtaactgactattgagatcatggtcttcttggaaggaataaatgtaaaaatgttgctcagccccacagagttggggtgactccacagggtgaaggcttggaggagtggcgtcttcagaggttctgccctgctcgttggttcagagaagcaaaaagatcaggcaacttgtagtacccaggatgttgtaaaaatcatagaacaccagaaccagaaaggaactccttcctatgatggcaagaagatgccttgccaagaccacataggaagaaaggagcagaacaggcctgggcccctctccctgcccttggctttgggcagccatggaggtgtccccaactgcccagacctttgggactgggcttcagaaagtctccccttagaacagcctctcaagaacttttatagaaaacaaaccgatctaatgagacgctgctcccagccagggcccagaaaccagggagtcatcacacattcatggcgctgcccaagaatggaagggcatcttgctagaagtcccacagaaagccacactggggccaggacagggcaactgcccagaagcccagacaggaacctacctgcagaggctgaaggtggcatcccataggctttatagagcaggtcgagaagctccctcttttcatcttctgggaggaaactagatttggccgcattgatgttctggaaaggccagaatggcagacaacatggaaccagagaacaaagaaggcagctcttagcaatgtagtgatagtccatcctcttcactcaacatgggcagatacgcttagagggggaaggatttgtccactgtcacacggcagcaagtgccagagtagagaccatgaggtcgtgttcttaatttgtcattacatgaaaaagggctgtgagaaggaagttggagaaacctttgagagacagggtggcatgtagggggccagagacacctcgcagacacgtgcaggaatggacttattcagcctgggatttaagaacaacctgaagagagtgtgcaagacttcatagctgctgcacacacctttctggggagagggttgacagctttcactggattctttaaaggcactcaacccaagcaaaggatcaaaaacctggtcctaggtcaggacgtcaacacaaagatgtcttctctgtggaaagtgtctaggttgggcttgtcttggactgttgaggcagactcactccctctctccaaagattccaggccccggactggacctgtagataccatactcccaaacccgagtcaaggccagtatggctcacacccactcaccagccttttaaactcctcttcag

SEQ ID NO: 16163 - DNA, 36181 bp, Human
gtgccctgtgggtgcgaaccacctgggggtcctgtttgtataaaatacagattctacttcagtaggtctgggatggggtctgaaagtctgcatttgtagtcagctcccaggtgatgtgggtgctgatgatccctggatcacactttcagtagctggagaatattttttccaaataaaagggtgattttgtctcgcctccacttaaaacactccactgacttcctaggaatcccacaccatcgctgggtcccacatccctggcaggattcagctcccatcagaccttctagccccttgctctccactctcccactctctctttcccccttgtttatgggtttgttaatttatttatgatgaaatgaaatgaagctaccatccaccccagtactggaacattatcaataacctgtgtgtggccaggcgtggtggctcatgcctgtaatcacgccttgggaagccgaggtgggtggatcatgtgaggtcaggtgttcgagaccagcctggccaacatggtgaaaccccgtctctactacaaatccaaaacttagcagggcacggtgccacgcgcctgtaatcccagctactcgggacgctgaggccgagaactgcttaaaatccaggaggtggaggttgcagtgagccgagatttcgccactgcactccagcctgggcgacagagcaagagtccatctcaaaaaaacaaaaacaaaaacaaaaaaacaaaaaacaaaaattagccaggcgtggttgtgggcgcctataatcccagctactcgggaggctgagacaggaaaatcgcttgaaacgctgggggtgcgggggggcggtggggaggaggcgggccagaggggcagaggttgcagtgagcccagatcgcgccacttcactgcagcctccgcgaaagagcgaaactccgtctcagtaaataaataaataaataaataaataaataaataaataaaaaacctgtacccgcgtgttatttccctccgtccttacctcctcccggctccttccctttcacctgagataaccactcttctcgtatctatgctcatctttcccttgctttacattttttccaccgatgcatgtgtctaaacatacatacttttggttttgcttttacacattctaaaagttgcaccattgtatgcagttttccgcaacttagtttttttcactcaacattgtttctgagacattgtttctgttgttgtctggctgaagttcattccgtttcactgctgtctaacgtttcatggtgtgaatattccggtttatttgcccactcgcccgtggaggggcatttgagggtgtttccaatgttcctgttattcggaatagcgctggtgtgaacattctgcacaggtctctggctgcgcctgggcgggtttcttaaaggtgaatgcccaggaggggactgtctgtgttctccctccctccgagctccagccttcctcgcctcctttcactcccagctccctggagtctctcacgtagaatgtcctctccacccccacccacccctgatgaactcctgcaggttctgcaggccacggctggcccccctcgaaagttccttaactatacaattatggtgtgtgtttctgcgacgagcgtccgtctatccggtggaaggcacgccgctcgaggcttgcgatgctcccggggtccccgcttctagcttgggcctggcgcacagcagcgcccagactgcagggggacgcttgaaagttgctggaggagccggggggaaggcagcgcccagcgaggcggctggagcgcgcgcccacaggtgggtccggtcgggcgccgcggggccgtagttttcgggtcggcgggcgaggacgccgggtccagaattccaggaaatgcgcgatccaggccggcgggcggggcgggggctccggcgagagggcgggccccgggaacggcggcgggcggggcgggaggcggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtgagcgcgcgcgggggctccggggacgggggtccggcgcctgggcggcccgaggggcttagcggggcccagcccggggcgtccaaaccctgggaacgaacgggggctcctgcaggcgagttcttccttcggcttaggccgtggcttgcttgcgggctaatcagggacaatggggcagagaaggtccagaacccggaggcctccagagtctgcttctgcccctgacttgacccctctgggtctcagtttcgctgtctgtcaagtgggcatcctagcaccgctgagcgctgtgtgggcctgggcagggacttgaggtctctgaagctcagctgtatgatcaggcccgatgtctacgccggataggcacctagtgctgtgccccgcgcctactgagtgctcagtgaatggaagcagctttgtacgccagcgttatggtggtgagcgccaaggagctcaggtttgtggatgcgccccggggaagaaccgtgagccctgccagaaaggggagggaggggagcagagcaccccccttcccccgcgcgggaagaacaggagctaggtaggccctgggtttggggccctagcagggttcactcgaggccaagccatggccactggccccaggggagaatccccttgtttctccgcccaccagctgtggcgtcttgggactgttggggtcagggagggtctggacccccttggcctgtctcagagtccgagaggaggggcccaggagtctgccaagcagggtgagtcagccagtagggtgtgagagtggttggggaaggagtcagctgcagtcagcctcaacttacccttctaagaaataggtgtgagtggcccaggaggttggctcacgcctgtaatcccagcactttgtgaggctgaggcgggaggatcatttgagtccaggagtttgagactagcctggacaacaaaactagaccccgtctctccaaaaaataaaaaaagttaggggaagtgtgtgtggtggtgcactcccgtagtcccagctactcaggaggctgaggcgggaggatcgcttgagcccaggaggttgaggctgcagtgaggtgtgatggtgccactgcacttcagcctgggagacagagcgagaccctgtctcaaaaaaaagagaagaaaaagaaaagaaaagaaataggtgtgaatgatgatgacagctatcacaaaagtgccggtgagaatccagtgagtgtgcatgtgtcagtgagggagacaggctgtggagagcccacctaccttctgaggagggtgaggcctggcccccactactgatgcccccagcccagggaaaatgctcagctactccccgtcagaagctggaagcactgaggtgctgtacaagccctcctacccccacccctgcctccttcacgtcttactggagctggggcccatgattggcgcctcccctttgcagtctttttattaaatgctctgggctccctctgcccttgggctggggacccactgtaccctgatgtgaatcctatggcagtagcaaagctctttgattggcggggtgcagtggctcacgcctgtaatcccagcactttgggaggcaaaggtgggtggatcatgaggccaggagttcgagaccagcctggccaacatggcaaaaccccatttctactaaaaatacaaaaaattagctgggcatggtggcgggcgcctgtagtcccagctacgcagaaggctgaggcaggagaatggcataaacccgggaggtggagcttgcagtgagccgagatctcgccattgcactccagcctgggtgacagagtgagactctgtctcaaaaaaaaaaaaaaaaaaaaaaaggctccttgattgcgaacatgttgggagttatggagagaacagcagggcccacttctagagcacttgttgcagacacccattggatccttgcagttcttctgtaacagcccatcaagggaggggctcatattattatccccattttttggccttgctcagtcctcccatctgattcaagctggcagatcattttccctattgggacctcagtgtccacacctggaggatggaacatcagctgcttatgtgggtgtcccgtgtcctgagtcccaaggccacaaggtgatgcttgagagtgaaggtagaatgttacctgccatgtgtttgaggcgtgacaaatcttgtatgattgtgaggaggaacttgtgtgagctggcaggagaagtgggaaggagtgtgaatctcagagccactgtgaccagagccagctccctgccctcttgtgggagggacagatgacagttataattattagcattactagctgcagctaatggagtgttgatgtttctgtgccaggcaccgttctaaacacattatctgcattttttatttaatccaggcacagagaggttaactaggcccaagatcacacagctaggaaatgtccaatctggggtttgagtccaagggaggctggcttcgaaatcccatgcctctaaccatctttcctaaactacctctgcagaagcctttggggatagaggtgccagtgccccaggtgcaaacctcctgagacaggagcctttgctgtgtccttcagcttctcatacctgccaccagctgaggcctgggacctggtcagctagaagaaagcagagcagggcagcgcttttcaaactgcactcaagtggcctgacttttaatgttcacactgtgattctgtgtgggtcgggttggggcctgcgatgctgcactgctgaccagctcccaggaaatgctaatgtcaacgatccaggaacacactttgcttagcaaggccctaggcagctgccttctgttgtgcgggacccctattgactccaatggatatagcaccaggttcaagaggctaccttctttggaagaggtagcaaacaagatacggggttttactgggggcttagacacagggaagagagtccagtggcggcagactgagcagaagaaccgcaaccacttgcaaatcatgcagtttatgtagcattttcatttaacaccttctcccaaccatctccacctagtaaccttcatttaacccaaaacaaagggcctcggtccctatacccctgtatggtcagtgtcccgtgggaatggggtggggctcagatgttcctcatagataacgactggatctccaggttggccactcttggattccttcgctcagaactctgaacacccattcaagtgtgcctgccatgcagggtcatcgtcaggggatgcccaagtcaagtttgccctgtcgggtgtgcctcccatacccccacctggtttgacttagcacctgctgggcactggaagaagtggaaaggggggttgcaggggtggcccttatcagcctatgttcacaggtggcaccaggcactcaggcattctgcatcctggaggccagtgctgatcacatgcctgttacaataatcataacaatagctgtccttgaagtagtcctgggtaccaggtgccttcagtgactttttcttttttgccagaatctcactctgtcgcccaagctggagtgcagtggcaagattttgggtccctgcaacctctgcctcctgggttcatgcgatcctcctgcctcagcctcccaagtagctgggactacaggcgtgtgccgcagtctcactctgttgcccaggctggagtgcagtggtgtgatcctggctcactacaacctccacctcccgagttcaagccattcttctgcctcagcctccggagtagctgggattacaggcgtccaccaccacgcccggctaatttttgtatttttagtagagacagggtttcaccacgttagccagctggtctcgaactcctgatctcaggtgatcctcccaccttggcttcccaaagcgctgggattacaggtgtgagccactgtgcccggctagtaacttttatctcacggaatcctctggacgacttgacaaggcatgggtcttcatccccatttacagatgaagaaactgaagcttagggagtggagggacttgccagggctacacaaaatctgagagccttgaagctgtagactggcaagtgaacaggtacaggctgggacagcagtttctttctttttttctttttttagacagagtttcgctcttgttgcccaggctggagtgcaatggcacgacctcggctcactgcaaccttcgcctcccaggttcaagtgattcttctgcctcagcctcccaagtagctggaattacaggcatgcaccaccatgcccggctaattttttgtatttttagtagagacggggtttctccttgttggccaggctggtctcgaactcccgacttcaggtgatccgcccacctcagcctcccaaagtgccgggattacaggcatgagccaccgcacccggccaagggacagcagtttctaaactgtccctctctgatgcagaggggaattggggctaaatcagcaatgtgccttttctgtctcatatttgaatgtctactctgcacgaggcgctgtcctgctttgcatacagtgactcatttaatgtttatgtcagccctctgaggaaggtcctgtcctattattaacttcacttattatgaggaaactgagactcagagaggggagggaacttgccaaagtcacacagctggcaagcagcagagctagacttgaacccagatctgcctgcactcaagtagaagctgttcattgctttgctcatttgccaattccactttatgcaaaaaagagggggcagtgtggggggaagagttagaatcagggtggcagggtgggccagtgcattagccctgggcttcagatgtactggggttgaattcctgcctgccgcttagcagctagggtacctcaggtagacaactcctgaaactcagcttccccctctgtaaaatggggtgacaaaaccaagatcttggggttcttggggaaactgacatgctgattggtttttgtacagtgcctggctggtaacagcaggccctcaggggtgcgtttccttcctggggactggagtgggggttgcagtagactctgggaggcctctccagctgcagaatctccctcctccctcctcctttttgtcttcctgacacaaaacccaccagctgcacttctttgggcttgcagtggctttcagttaccagagccacctgttaaaacaaaaatgtgcctaggaagagcctgccttacccattttgactcacatggcagttggtggtggaggggaacaaaggagactgagtttcatcgaagccttttgcttcggaggaggaagggaggatcagagagaggaagtggtctgtgttcacacagggaggcaggggaggccaggcagcttcccaatcctgcattcaacctcagggtgggcttgacctgggtggctgggggccctgtgatccaggagagacttgtccacctgctcaggtgtcttgaaggggtccctgtggtaccccctggggcggggcaaggtagtaggaccatggtctggctggggaggtggagaggagcaggctgtgggcgcagagtgaggttggaatctgtatttacccaaggtgttgggggtaggcttgccctcagcccttaatgttctcaggcccctgagcagttgtgggggataacctctgcactcctagtgaccagggagctagaacagcaaggaatttgaacttggacaccagctggggtcaggctctctgggtctgagtcctgatttcccactttccagctagaggagcttgaatgagtcatttaacttcacggtgcctcagtttcccctctctaaaatgagaattatacccatacccacctctcaaacaccaagtgcaggcctggctcagagcaggtgctgcagcaatagctgccattggtcagcatcatcatcatggttggtaatggtcctactttgacttttgagacagagtctcactctgtcgcccaggctggagtgcagtggtgcaatctcggctcactacaacctctgcctcccgggttcaagtgattcttctgcctcagtctcccaagtagttgggattacaggtgtgcgccaccatgcctggctaatttttgtgtttttagtagagacagggtttcaccatgttggccataacaatggctgtccttgaagtagtcctgggtaccaggtgccttcagtgactttttttttttttttttttttgagctggagtcttcctctgtcacccaagctggagtgcagtggcacgattttggctcactgcaacctctgcctcctgggttcatgcgatcctcctgcctcagcctcccaagtagctgggacttgggatacacttgcccccgctggtcctcccttccacctctgtgaagaggaggtctcaaactcctggcctcaagtgatccacccacctcagcctcccaaagtgctgggatttcaagagtgagccaccgcacctggcccctgtttagatgttagcatcagtgacccagcaccttgctatgtggcatgcagggagcgtgctgctagacctccgggtttagagtcaaatagcttcctggctgtggtatgcattagactttctaactcaaggtcctcccactctctgagcctcagtcttgttgcctttaaaacgagtttaagtgtgctgagtccctatgctgtggctccacaggaatttccccaggtggaagacacatcttgccttctgtgaaacctctcagcagcagagctgtcaggccccgtcagcaggagacactgtggggactgctcagtcccttccactgtgtacctcggagctggcggagcctagatgaggctgagcatagagggcttcctggaggaagtggagctgaaacagtttctcagcccagggctgctctgtctcctggcctcacactaaaagtcagttgagaggccatagtggcataagtcactgaccctggcactgcccagctcatcaccaaaagcagggctagggagggaggggacattcgattggcagtgggcacctgtggctcatctgggttctggccacggtgctcaggttctgtgagctgaccaggcagccctggctcctctgcccccgtgtgggttctgccaggtcccatgggggcaggtcagccccttccttgttgcagggagagcacccagcattgctgacatgggacagggaaacgaggaaataacggtgtggtcattgaacacagagagcactaggtgctgtgcgaggtgctgaggacacgacatgatgacacagacaaggtcccccctctcagcaaacggctcatgagggagacagacatgttacatacatgaacccaaaaagtcagacgaaaacaaaacagagcgatgtgtttgggaggcaaacccaactgccggagggcgagcagggcgtctacctccaaggtaaacccagtcagattagttgtccccaaggctcaccagggagaactaatctgactaggtttgccttggaggtagacggccctgctcgccctccagcagttgggaacgtggaaacatgagtcagatctgggagtatctgtcccaggagtccaagacctgggtcctcatggtagctctgccaccgacacactgagtgaccttgggtaagtgaacccaccgccctggacctctctggcacgcatctcttgagagcagggacttagtgcatttcccgagggcctccacggtgcctggcacatagtggggcttagtaaatatttgttggtaactgaggatgcttcctgttcacatcagcgctgggaggatttcctgctgttcagacaaatgctgggctggctgtgagtcagccttgcagagagcaaaggcagtgggaaggggcgtgagattcccctctggagaggtcaggaggccaggcactgtctcgacatgagtgccagggagggggtgtggcctgtgggcagggcttgggctgaggcagagggacttgagttccaccctagctctaccaccatcaattttgtgtaactctggacaggccactgaacttctccgggcttagcctggcaagtccatttccccatctgtaacatgggccgatatgtacattgcctagggattaaatgagataaagggtctgaaaacagtaggtagctgctttatcattattattatttctgtattattgatgtctgaggctaggcccacagaggcagtacagtagagtggttaggagctcaagaatcagactagggttcaaattctgactccatcactgactgttttggggtacttctttgaacctcagtttcttcatcagtaaaatgggagtgaagtctctaccttgctggttgtaaggatgaaataagataatgcatatagatggtctagcacatagtagatactcaaaagtttgaggccactgctgacccttttccctgaaaggagacaggagagcggggtcgccaccccattgtcattgtcatctggaataggctgacagacttcccatggtgtgttgcagttttctagaaaattcagtaggaggcctgcctgagcttgagccacctgtggaggtggcttcctgcctctgctccacacctgaaacgcgtctgggcctcttctcaggcagccgtgagaagggatgagtgctactggtcatggtgggcagctggctctgctttcccccttcccagaggcgctcctgcctcctgcccagctccctgaacccctagcttctgcaccccggcactgtctggcttctgccccgctgagcacccactgtctctgacgctgccttgagtacttcccgcatgttattcaaatcccaatcagatcttccctcccgcagtagctggtcttctgttctggcttcctgccatcctgtcctccacacagcagccgggaaaggtttttttaaaggggactctccgatttaacacacttgggtggaaaaccctttgcttcggcctctgcaatctccctgccccctctccactttgccctggcctcatttctcaccactaacctcactctgcactctggccaactccccgcctgcttcctgattcagacactaagcacacgcagctcccctgcctggagccattctccctctccttctttcttctccctggagaactccccctttaagtgatcttttcccaacacactttctaaattgcccccaccccagtgtgatttttctttatctcatagcacttggtctgcttcttatcacagtttgcaaggctgagttcagaaaggtgtgtttgctcattctgaggcaggagaggctaccttgtgctgctgtggtaacaaacagcccccaggtctgaggggtctgcagagacccaggttgacctcatactgcttgtccctccagggcctccagtgaggtttcggctccttggatcactcagggccccaggcagatgggaagattccactctgaacattgccaattgttgtgccagagtaaagcagagctgggaggtgggctcttgaattggcatttaaatacttttgccaggcagggtaaggcagctcacgcctgtaatcataacactttgggaggcctaggtgggtggatcacctgaggtcaggagttcaaaaccagcctggccaacatggtgaaaccctgtctctactaaaagtacaaaaattagccgggcatggtggtgggcgcctgtaatcccagctacttgggaggctgaggcacgagaatcccttgaacctgggaggcagaggctgcaatgagctgagatcttgccactgcactccagcctgggcaacagagccagactccatctcaaaaaaaaaaaaacaacaacaacaaataaataaatgaataaatactttagccagaagtagccatgcagacctccccccaccagtcccacccacaagcggacgtgactaccgcccccattcactgcctgatcctcctgttctcaggggctccaaggccaggcctggtttgaccttctgactttctgacttcctcctaccttcccagtaacctcatgcaactcctttcactcagcctcaatcatccccatgggtgtttaaacttgcccaagacatgcccctttgaaaaagcctgccattctcttgacccacatgcacgtcctgccccctccaaggctgctagttcctttaggggcaaaattgtgaaagagtagtctaaaccttcttcctcttcttacctccacttctttcttaccttattcccatgtggattctaccctcactcaggcctctagaacggttcctctacggcagtggttcccaatcttgactacgtgtttttttaaaaaaagtcctccacctgggcctgccaccaaggatttttctttaattgacctcagatggggttgaggccttgggaactggccagaacttcccgtgctcctaacttgcagccggggttaagaactactcctctgaagcccccagtgcctgcgcttttagcccgacggacaagtttctgcccttccatcctgtgacctccagcagggcctgaccatgtgagttttctgtggctgccgtgacaagttgccacaccctgcatggcttcaaccaacagaaacgtgtgccctggcagttctgggggccagaagtccaacatcaagatatcatcagagccacatgcccactgaaggctctcgggggaatccattccttgcctcttctggttgctggtggctctaggcattccttggcttgtggctgcatcattccagtctctgcctctgaggtcacgttgctgcttcctcttgtgtgtgtttctcttaaaactctctgcttctgtcttataaggatacatgtgattgcatctagggcccaaccagataatccaggataaactcttcctgtcaagacatttaataatcacactttgccatataaggtaatttttttttttttttgaggtggagttttgcactttcacccaggctggagtaaagtgatttaatctcggctcactggaatctctgcccccaggttcaagcaattctcctgcctcagcctcctgagtagctgggattataggtacctgccaccatgcccagctaacttttgtatttttagtagacatggggtttcaccatgttggccaggctggtctcgaactcctgacctcaggtgatccacccgccataagttaatattttttttttgagagggagtattgctctgttgcccaggctggagtgctagtggctcaatctcggctcactgcaacctccgcctcccaggttcaaatgattctcctacctcagtctcctgagtagctgggactacaggtgcatgccaccatgcctggctgatttttgtatttttaatagagaggggatttcaccatgttggccaggctggtgttgaactcctaacctcaagtgatccacccacctcagcctcccaaagtgttgggattacaggcatgaaccaccacgcccgacccatataaggtaatatttacaggttctggggattaggattagcatgtagacagctttgtgggggccaccattcagcccactatgctaaccctgtgaaccgttgctcgcttctccttgacatctgacggcctggccttctgcataccacacaccctcccacctctctggccacagttctgtaggctcagcctcctccgtaaggccattaagtgcttgtgctggtcaaagtttcatcctaggccttttccttacctcccttgatattttctccctaggtgagctccttcaagcccacagcttctgtgcttacccacactcctacctacattcccagcttgggcttctcaggccagctctagactcttgtatcccactgggttcttccacttacctttggatatctcaaaggcatctccagttggctgggcacgatggttcacacctgtaaccccagcactttgggaggccgaggtgggcagatcacttgaggtcaggagttcaagaccagcctggccaatatggtgaaaccccatctctactaaaaatacaaaaattagctgggcatggtggtgggtgcctgtagtcccaactactcgggaggctgaggcaggagaatcgcttgaacccgggaggtggaggtttccgtgagctgagctggagccactgcactccagcctgggcaacagagtgaaactccgtcttaaaaaaacaaaaaacaaaaggtgtctctagtgtaacataactaaaaccaaaccaatcatgcctccctcccccgcatcctccctcctggagggagctccaggacttggtcttctcttccagagttctctgtctcaaactgcgggaattgctccccacccaggcctaacctgaagtgtgagccttggcatctctttctatccacctgtttttcctctatgcacctcacaaccctggtccaagccaccgtcatctttcaaatggctgcagtagcctctaactggccttggaggagccatcctctttctctaaccagctgccaaccctgcaatggcctctgtgtgctttccagataaagcctgactcctcgtggcccgcacagccctgcctgggtggtcctatcctgcagcctctccagtaccatgaaccctcccttctctgaacctctatttaatccatttcatataccccgttttctcctgccatagggccttgcacatgctgttccttctgcctggaattttcttcctgcctccctccgcacccctgccttgtgttgtgggttcctcgctatcctctagcttttcgctcaggctcattgttggccctctagatgtattcacttctcttgtttgttaccctctgtcataggactgtgttcgtacttcccaaggagtcgtcttggtttgtgactgtacattttcccatgtgacatttgcttaatgcctctcccactctggggcctgtacaagccccaggaacaggacttggaccctcctgtttaactctacaatctagcatccagcaggcgcgcaggccttcgttgacttttattttattcttattttttatttttgagatgcagtttcgctcttgtcgcccaggctggagtgcagtggcgtaatctcggctcactgcagcctctgcctcccaggttcaggtgattctcctgtctcagcctcccaagtagctgggattacaggtgtgcgccaccacgcctggctaattttttgcatttttagtagagatggggtttcaccatgttggccaggctggtctcaaactcctggcctcaggtgatccacccacctcggcctcccaaagtggctggattacaggggtgagcccccatgcccagccttcattgacttttagttgacaactatttagcatttgctatgtgccaagaactccctgcctactaatgcagttaaccctcatgaagcctagaaggaaggactgccattctccccacttaacagatgaggatgccgaggcacaggaagtgaagtgactttctcagggtcaagcagggagtgagtggaggagccgagattccagctctaaccgcatgatgctctatacagtgtgactccggctctctggctgggccctctccatagccctgtgagggttaaggatagaaaacagaggctcagagagttgaggtcccttgcctgaggtcacacagctggttggccgttccctgggctataagcttcagtattcccaatgctgagcatattttgagaacccgagaaacagacgtttggctgggtgggaactgaactcattttgtcagggaattcaacaactaagttggccctgagactgggtgtgaagaccgctctgtcccctgccagctggatgacctcaggagagatctgatgactctgaggtcctgctgataggacctctggtgtctctgttccctgctggcctcccctgggcctgggttgggtttcctctgcaggaggcagctcatgtatgtgctcctagacgcccttgggccagcagctccttggctgttcctccctgagccagggcagccaactttcttatccagctctccatgctccccaccccagcatgagatgtcagctgagagttttctggatctcccctagctagggggaaagcttccatcatttggaacaggaacagcaggaacagcaaagtccctttccccaccatctcccactgcctgctgtgcttctcctaacagctcatggtaaacaccctgactgagcggcaggggctgtttcctttgggctatccatgtccacctacactgccctttttaatccttacaatttttcttggacacgggggcataatattccattgtttttcagttgaggaaactgaggctcagagaggtcaagtgtcttgtctgaggtcacacagcagaactgggagtcaagccagatgggctgcctccaaggatcctactcttaaactctagagtactagaaagatcttccgttgcctaatattgattcctgataggctatgcttgagtagcatctgcttttgaaaatggagcctgggtcggttgcggtggcacatacctgtaatcccagcactttgggaggctgaggtgggtggacacctgaggtcaggagttcgagactagcctgagcaacatggtgaaaccctgtctctactaaaaatacaaaaattaactgggtgtggtggcacctgcctatagtcccagctactccggaggctgaggcacaagaattgcttgaacccaggaggtggaggttgcagtgagaggagatcacgtcactgcactccagcctgggagacagagcgagactccatccgtctcaaaaaaaagaaaacgaaaatggatcctgaattttgaaatatgctgtgactcttccctagtttgggacatctgggtcaatcccttttgttaaagtagtttatttagttggctgagagcgggagctgcctacgtgacctggagcacaagctttggaattgggcttgggttagaattccgcctctgccactcaccagctgcgattaagaacaaagatactgggttgggctcctgcctctattacttgcaatctgtgtggccttggatgagatatttaacacctccgaacctcagtgtcctcaattgtgaaagagatcgagataacagctgaacccacatcccaggagcggattaaatgagatagtgcagtacagagtttaccgaagtatatggggtcagcagccagccagtaaaatggtggctaatggttatcatgattaatgttaacattaagctctgaaaggtccttcgtgaactcataggtatttgttctctctctccctttctctctctcttccccctgcccccttgcaggtagaactgcatgtccacctagacggatccatcaagcctgaaaccatcttatactatggcaggtaagtccatacagaagagccctctctccctgggatttgagtggggtccccagctccacccagaggcccctggggaattccagggtcactgttccttcctgtctccctgtgggaatcaagccagctccaggccagaagtgggactgtgaggacatggaggcctcggcactgagctgcagacccgcagaccaactcctgagctttctgggcctctgagtcttgtcctcctggtgtcaggtgagccaggcctgagcctgctctccccacccacccacatacgtgcatgaaggtagttcccagggctgaatccgtctttttttttttcttttgagatagagtcttgctctgtcgcccaggctggagtgcagtggcatgatctcggctcactgcaacctccacctcctgggttcaagtgattctcctgcctcagcctcctgagtagctgggattacaagcacatgccaccacatccagctaatttttgtatttttagcggagatggggtttcacatgttggccaggctggtctcgaactcctgacctcaagtgatccacccagcttggcctcccacagtgctgggattacaggcatgagccactgtgcctggctcctgtcttttgacttaactgagagcctatatatagcaggtgatgtgctcacatgagatgccagtacaatttcttgagcatctcctagagctgggctgggctttatcagctcattgaattcctccacgcttggaagaggaggatacgctctctgcattttactgaggagggaatgggctcagccaagacagttgtccacggtcacacaaattaatagcagatcaagagttgaacccaaggctgtctgacccctaaggctttactacatcatcagggtcataacctgctaggagtcacggaaaagtggctccccaactctgggcctaaatctctgcatcttccaagtgagaacacacttcctgcctcagctctcagagatgctagggggccagagggtccccctgttccccagcgaggaaggttcttcccttcctacccagacctcaagggctcacagcagctcctctcttaggaccagcttttaagggcagggactttaaaggccagtggatctggattcaaatttggacatattatctcctgtctgcgaacttggtctctatcaactgaggctaagaacaggccctccctagagagatgacctaggagctaggggctccttgtccacccagccctgcccccgcagacctgtgttcctcggatgtttgcacaacactcattttgtttggagctgaaagaactcagcctctctgtcacagtcttgaaattcagctcgggacccaaatttgaacatttctgctccataagccagaatcctgttattcagaggcctgccctcatggagagaatgagggatcccggggggttgcccccaactctcgggagcatctccaccaactccctgagagatttctggtaagtccactattctccatcttttcacacttccagggaccttcttctgccccaggaagctgccattgatttaattcctatttaactgcaaggcataagcacagtagcacctcctgtgtgccaaacactcctttaagtgcgttacccgggttaagttattgaagcctcacaacaatttgtaagataggaactctattgccgtcatttacagatgaggagactgagccgtggtaggtggagtaaggtgcccagtaagcacagggcggaggtttgaacccagatagtctgcccccgagtccatggccctggccattaccccctgtcagttagaggttttggtaagtgatgcccgtaaaatgcttagttcagggcctagcacacattaatgtgctccataaatgtcacttaatgataatattcttattaattggagcttatatctctaagtggggtgaaacctcttggcttatctctgcctggcctttgcccatgtcaagccgccaacttgccacaaggcccctaatgaggtcgttcagtggggcaccaagatgagatcgaacccaggcactcattaaggggtcacggagggctcatcagctgcagccaggggctgggagcgccgggtggggctaagagaaaggggaaaggagccgccgggaggggcactggtctgatcgtccattcctcacaccacctctgggccttggagatggcgtgcggcaggtgccagctggagcttggcctgaagtcagcaggcaggggactggggagtttgtcacactcagatatgggtgtctgtaaatgcacacaaatatgggctaagaatggaaggaggaggggagcccctggcctgagccctgctaggcccaattcagtggccctttttccagctctgggactcaggcctgcctcattaactgtcctcacccatttctccttcctccagttcccaggattctggccttttcaggggcctctccaacctctttctcagtcttgtttataaccctgtcaactatttctacagagattctgaaactggctgctctttcctccgatcactgccctggtctgggccaccactgcccctccctggtgctgtggcctcctgattggtctcagccatctactctggccttcctctctacgggccctgcagtgctgtagttggagcaagagccttaacccatggtcttcccagctcattccccagcttccccatctcactcagagtcaaagccaaagtccacacatgggccttaaagttctgcaaagcctgcattgcctctctgacctctctaaggctccttgcttagtccacactggatgtttttcaaacatgccagacctaggaaacagagagtctgggttacttgcccaaggtcacacagcctttaagtcacagagctgggattcaaacccagaccactgggcttcagagtctgctctttctcatgacacacaaagtttcatttcttcctctgtgcacccctacatggaaaatattatgttttactgacaagggcaccaagggccttagaggggagcgctcctgcctgggatgatgtggtaaataggggtgggagatggacttgacctgcaacccctgcgctcatcctccctccctccctgggctcctgatggtgggcttcttgtgactgtgttgcccaccaaggccggaagaggaccagacagtgccccagcacagcagctgtggctgaccagggagtagggatcatctaagaacagagcgtgcatggtggctcacgcctgtaatcccagcactttgggaggccaaggcgggtggatcacctgaggtcaggagttcaagaccagcgtggccaacatggggaaaccccgtgtctactaaacatacaaaaaattagccaggcatggtggtgggcatctataatcccagctacttgagaggctgaggcaggagaatcacttgaaccagggaggtgaaggttgcagtgagtcgaggtcgtgccattgcactccagcctgggcaacaagagcaagactccgtctcaaaaaaacaaaacaaaagaaaaaacagagggtggccctatgaggagccttcgcttgtgtgggtggccagggacagcaagaggtgccagggccctaggaacagctctttcctgcttcaactttgggctccagatgggcgctttccagctcagtctgagcagcttcgggaagctgtgtcccatgggagacactgggagtcccctgtgctctttgtctcctgtcgggcccccacattagctctctggcctcagctctggcttccctccaatttgtttcccacgcagcagccagaggagctttcaaaaaggtaaattatttcatgctagtcccctgcttgaaatcctacagtgccttcccagtgctttcagccaaagccccagtcccttcctaagcccagcctggccctgcctccctggtgcatcatctgcacaaatgcctgctctctgacctccagccaccctgcacttccaatgcccgcggcttcctgcctgcagctttagtacagacccctcccctgcccagaactgcccccaccccaaggcttctgctgaaatgtcacctcctcagagaggccttccctggctgctctgtctaaactctgtgttgagaagttccttcttgatggttgttgaggagggaggctggagaagaagaatcaaagaggagaaatagaaagcaaaataatttgttcttggggacgggctggtgctgggcacggggaggcgcccgtctctggtgtgggcagctgggtagatggaggagccgtatttggaaatgtggaacccaggaagggagtgatctagagggaggggaaaggtggcgcgagatgcctgcctctcaacaggtagccagacacatgggtctgtcttggtcactgctatctgcccagtgcccagcacatcacaggccctcagtggtggtgtgtgggcatagagaattagaagctgtggacctctggatccggagctgaaaaccaccaaaggagatgagttggcctggccaggtgtgtaaaaggcagagtctgagagagaacgaccagagggcagagcccccgcaggtggagtcctgggggctggagggagaccattaggagaatcgcacatggctggcgcagcaggtcccaggcaaatgtggccactgggtttggcaatatgggagccagagccctagtgtcatctccctgccttctacccagcagttcccagagtgatatccccaacagtgtttgacaactggtacaggctcttcagcggccacagttactgggcaaggccttgtgagggtgactttggggcagctggccagcagtgggaggggaagcagtctcaggggtacctgaggcactgagctccgacctccaggtgccaatgccgcaccagggcaccgttcccctgcaggctcttacagggattaggggctggtaaggagcagtgattaggggctgactagcaggctggtgggcaccagcatgaccccttggtggtaccctctgggcactcatggggacttgggctaacagatggggaagggagcacattcagggggcttaggaaacatatttatgtagggaagcattttaatattttagtaacagaagctattaaaggacttacaaacttacttacatacactaaaacactatttggtcaaacttctgtttctttggcactttcctcctttattcttttttatttttttgagacagggtcttgctctgtcacccaagctggagtgcagtggtgcaatcttggcccgcagtagccttgacttccaggctcaggtggtcctcccaccttagcctcccaagtagctgggactacaggtgcacgccaccacgcctggtgaatttttgttttgaaggggtttcactgtgttgcccaggctggtttcaaactcctgggcttaagtgatccgccagccttggcttcccaaagtactgtgattacaggtatgagccactgcacccggcctcctatttttctgcttctgctttgtggataattggatgcttggacctcctgatttaatcttctaatttccttaactgtttactcctatttttcatcatcttgtctttttgttctactttgtggaggatttcttcacttttagcttccagttcttttcttacatcgtgacagttgctgccgcattctcttgtaaatttccgagggctcgttcttgggttctgaatgttccctcctttcaaggatcttctcatctctttgaggatattcatgtcttttttgttttggttcttaggttttcatctgttctctgtgctgtttcctcggagtgcttttgtctattctgttgttttgtccctcatgttagaagcatttcttttttttttctttttttttttgtgatacagagtcttgctctgtcaccaggctggagtgcagtagcatgatctcggctcaccacagcctctgactccctggttcaagtgattctcctgcctcagcctcctgagtagctgggattacaggcacacaccaccacacccaactaatttttgtatttttggtagagacggggtttcaccatgttggccaggatagtctcaatctcctgacctcatgatcctcgcaccttggcctgggaggccaaagtgctgggattacaggcgtgagccaccatgcccagcctagaagcatttcttaatgtctggtgttctctggctgttgtatcttaaaaaaaaaaggggggggaaactgaggctcgaggtgaccttgtgagctggagcagagccgggatgggatgaggaggcaggagcgtgtgcagaagagagggagcccccctgagctcgcaccctgcttcccgtggctgggaggggaggccgagatgcttggggagaaatggaggctccaagccagaggggctgtttccagcacgctcttactgagcgctgctgtagtccagcttggtgtggcggctgtgggcagggaggggagagaggtctgagctggctggcggcccactgggcccctcccctgagcctccaccggccctctcccagtgcgctgggctgggcaagcctctgatgtgccagccagatggagggtgaagtcctgatgcctgcccctaccctgggaattgtgatgctgcagttactgcccctgataacccctgactgggcataggaccagctggctgagccagctcctggggctgaggaggaagccatgaacttgacctggcactttccttgtctccaagcatcagtcaaccaaggatatggagggggtgtgtgcatgtgtgcacacatacacacacacacacacacacacttcaacctgtttatcccccttgagatttgctgacttgtgcattgggggtagaaggtgctggaaaaattccggtcctggttctcagtttccccatctgtccagtgggagcagctggactgagagacgcccatgtctcctgctgtggtcctgcaaggaggctggcgctcctgagtctgctccatcctggcctgtcaggcctgcctggatcctgccccgggttggtccaccactcactgttttgtttccaggaggagagggatcgccctcccagctaacacagcagaggggctgctgaacgtcattggcatggacaagccgctcacccttccagacttcctggccaagtttgactactacatgcctgctatcgcgtgagttgcccccaacccacaggtcctagggcagcattgatccctatgactaggaccaggcctgtccctcagcctgtgggggccagagaagttgctctgaaaccacagctgtctttctcaccattgtgtacacttagtgagtctctccagtgcctttaggcctcagttttcccttctgagatgtgggtgtgatggactgaaattgcttcaagttctacagagaaatggcagaatatgggagctaagaacacagggtcagaggcagtgcagggcttgaacccgggccatctatctcctagttcagggcttcgtgttgtgaggggaggagaggcctgaatatagggtgggggcggggagatgtggggaagattctccaaaaggctttttctttttcttgtcttgagtcgccagggaacagcactaggtaccgaaaaggcccagaaggggtatgggcgagtactagagagaaatttccatgactgctttatttatttatttatttatttatttatttatttattgagacagagtctcactctgttgcccaggctgaagtgcagtggtgcgatctcagctcactgcaacctccacctcccagtttaagggattctcctgctttagcctcccaagtagctgggatcacaggcacccaccatcacacccaactaatggttttgtatttttagtagagatggggttttactatgtttgccaggctggtctcgaattcctgacctcaggtgatctgcccgcctcggcctcccaaaatgctgggattacaggcgtgagccactgcgcctggcctccatcctcatcctgaagatgcaagaacttctggtgaccccttctcctgagagtggcctgatctcccctgggcagggcactttcttcccacgctgggctctcccagcacttgtgtgccttccctcacacattctagtaaccacttcattttcactcttcatggtgggaacttccagctaagcacagtccaccgttacgtgatcaacacagtggccctggcaggccaatttgtgccttgcttctggaacaaacatgcagtaataacaacgaaaatgttttgagcatttgtccgctctgctccaagcactgacccgggtggggtttatgaagtttgactcatttgtccccgcaataactccttgacctaggtgtcagagggtgactaaccaggggtcacacagcagataagtgtgggcacaaggatccaagtccatgactgtatcccacgtgtctcccacatccaggcatccctctggacttgtccagctgtgtccttttctctcatttctcttccctgccagccttaactccatcaccaacaaatattgggctactctgtcctaggcatggtcctcagctgagaggtcgcagccatcccaagacagaggggtccttgccacatggagactgcattctagtagggaatacagcaaactggctgataagccatatgacacacaatgttgagtagtgataaggacctgggagaaaaagaaagcccaggagaatggtggaggggccgttttaagataaggcggtctgggccaggtacagtggctcacgcctgtatccccagcactttgggaggctgaggtgggcggatcatgaggtcaggagatcgagaccatcctggctaacacagcgaaacgctgtctctactaaaaatacaaaaaattagccgggcgtggtggcatgcgcctgtaatcccagctacttgggaggctgaggcagacgaatcacttgaacccaggaggcagaggctgcagtgagctgagatggcgccactgcactccagcctgggcgacagagcaagattctgtctcaaaaaaaaaaaaaaaagataaggtggtcagggaaggcctctctgaggaggtgaagcttcagctggctctaaaccaggggagcgggagagacgcagtgtaggacagtatcggggaagagcaggcctgtgtcttctccggtggcctcagggaatgagggagaaggaaggtgctggggaggctggcaaggcctggaggatgcaggccttgtgggcaggacctgggagttgcgatgtcactctccgtggcaggaagctactggggcttcgaggggagaagtgatatgctttgatttaccttcttaaaagattgccccaactgctgggtggagaacaggatgacaggggcaagcatggagacagggaggccagttagagatggcgtgattcaggccaggatggaggggtgagaactggtatgcagttccaaagtagagctgataggacttgcccagtgtctgggatcttatccagtggatgcccagagcttgggtctgggggatgaagtgggtttaatctgccaagggttggggatgtcatttgctcctggagctcccaagggacttggggaaggttgttcccaacccctttcttcccttcccaggggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgagtgagtgatgggcctggaaggggccatgctgagggtgtggctgggaggctcagctctgagactggaagggcgaactgctgggaatccctgacccaagcaagaccttgttcttgcccccagtctggtccatggcctcagaaagatgggtttaactctgtcacaagagacgtggttcccatcctccctttgccgttatgttcttaccttgggcacaagtgtttggctgtgtcttgctctggccacaggcctgctgtccaggaatgttaacctgcttagccacccaggatttctgaggggtctcccttgtcactgatgctgatcagatctctaaaggccctaaaggtcctgctctaacttcataactgaagtgagtctggcccatttctagccccctgcctgggcccccatggatctctaagtggtatcacaaaaccaccctgccccattttctgagccatgattctgatacatatagaatgtgaacatcatggcaggcccaagcttagcaatgctgtccatctgggggtggggagggccatgttgacaccccacacctcccactaagatctaggagcacccagctgctttaagagctagagggacatgctagggcctgggggcatctctgccagtctttcctctgaggcagtgggtcagtgggggaggagggtcctccccaaagcctcctcttcctcctctgtcccagtcccagagctgccctttaggccttccttttgcctcaggcccatccctactcctctcctcacacagaggggacctcaccccagacgaggtggtggccctagtgggccagggcctgcaggagggggagcgagacttcggggtcaaggcccggtccatcctgtgctgcatgcgccaccagcccagtgagtaggatcaccgccctgcccagggccgcccgtctcaccctggccctgacctcctggcctagcagtggggctgtacctgatctcccctgtgccccacagccccatggtgtccccttgagcccactggcatgaacttggggcttcatgaaacaactggagacctcctaggcaggctcagaacttctggagatgttctccccagggacaccatgcctttatagccaccctgcaggaagctcaacaccaaataggaacgtaactattgaaaaaaaaatctaggctagattctgatcagcccatagtcctccctcgagacccagtggaccaggccccatcctgtctgggcctgaataggtctgatttccaagatttctgaggggtctcccttgtcactgacgcagatcagatctctagagtttgtgcctcatggtgcacagcctcactgtgtgatattgggcaggtcacactgctgctctggttatgcaccaagacacctcagttgtgcactgtcacaaggagatgatcacacttacttcattcctctaccctcaggattagtaagaaccaaagagctacctgcacgcatttcctctaatcctcgcagcagcctgcaaagcagaactaccattgcttagtcccatttgacagatgaggaaactgaggtggagtgaggtgcagcctcttgcaaggcacaaaccctggatttgtatccggggacatctagttccaaagcctgtgttcattcattctttcttaaacacttcagaataactttattggttaagagtacctaatacattagcgagatacttcccaatactagtgtgagttctattttagatgacgtgttaaacggtcctccgtttcctcatctgcgcatgggaataagcctaccatgagtgttgttggaaacaccaggtgagagaagggtccgtgtcatttactgagctcaggccccgtccttggtgctttacacacatggcctcggcaaagcctggccgtgaccctgtgcaatagctggcagggttctttctgaaaagggcggaaactgaggccataagcagagcagttttccgcaggccatgtggttaggacatagcagttaggatttgaagacactgagccctgttttgtgctggcctcccatggggggtttgggtgggacagcaggcaggtaggctgggaggtctctccatggtgctggtgacagagcctgggtgggcatctcgcccacagactggtcccccaaggtggtggagctgtgtaagaagtaccagcagcagaccgtggtagccattgacctggctggagatgagaccatcccaggaagcagcctcttgcctggacatgtccaggcctaccaggtgggtcctgtgagaaggaatggagaggctggccctgggtgagcttgtctcccacccatagttgggagaaatcacaagaaccagggaccatggtgtctcctgagttctgaagtgtgtctttgttgggtcttaaggcttggaactggaatccccctgggccaggcgtggtggttcatgcctgtgatcccagcactttgggaggcgaggcaggaggattgcttgagcctaggagtttgagaccagccagggcaacatagtgagatccatctctgcaaatacaaaaaaaagtagtcaggcatggtggtgcatgcctgtagtcccagctacttgggaggctgaggtgggagaattgcttgagtccaggaagtcaaagctgcagtgagctgtgataatgcgactgcactccagcctgggtgacagagggagaccctgtctcaaaaaaaaaaaaaaggaagaaagaagaaagagaaaagaaagagaaagaaagagaggaaggaaggaaaaagaggaagggagggagggaggaaggaaggaaagaaggaaggaagggagagagaaagaaaagcctccacttggtgttgggagtcctgtgctgagcctgcttctggctgtgatttgctgtgtgaacctgggcaacactgtgtcttctctgggcctctgtttcttctattgggatgactgagttggagccgacatctcaaaagtcgcttccagcgtgatgatgaatgggcctcctgtggagggtgcagcatggtggagaagtcagggctctggagtcccactgcccgggctcagagcttggttccacacttcctgtctgaccttggtcacattacttgaatctcctgagcttcagtccttcatcataaaatgggtgggataatagttgtgaatattagataatgtatacaagtcacttcatatactacctgacacatggtaactggctaatgagtgacagctaccacttagataaggacttggagggtaaaagaccaggtttccccatgctgttgaagcaggcagcatgactaggatggttcaatctccacagcatggtcaaggcagggcctgccggggccctcccgctagggcacccatgacctggctctcccccttccaggaggctgtgaagagcggcattcaccgtactgtccacgccggggaggtgggctcggccgaagtagtaaaagaggtgagggcctgggctggccatggggtccctcctcactgcctcctcccatacttggctctattctgcttctctacaggctgtggacatactcaagacagagcggctgggacacggctaccacaccctggaagaccaggccctttataacaggctgcggcaggaaaacatgcacttcgaggtaagcgggccagggagtggggaggaaccatccccggctgtcccaacttcctgtatagagaggcagaaagcagggcgggtcccaggaactcgaggggtggccccaggcccagacatggggggaggaatcagcatggcctggggccatccctgccagccacacacctgctcttccagatctgcccctggtccagctacctcactggtgcctggaagccggacacggagcatgcagtcattcggtgagctctgttcccctgggcctgttcaattttgttccaggaaggccaaagagggaagaaactttagggattgggcatcagcccatgccgcgtcttttagatatgaaatctcttcgacaccctgggaagcaggcattgccgtcctcatcttacaaatgaggaatccgaggcccagatgtgctgtggcttgactgggattacccagctgctaaccagcagagctggggccctacagctcatcagctggagcagaacgctccattactctgagggaagcttccacacttccaattctcccaactctgccccctgggcatcgcataggaagcaggagtccctctggccagcatgttctctcttcctgacacctggcccttgggacccctgggcattcccctgagcgccatcttgaagctttccaccggagggtctgttccaccctgcctggctcccatcctggagtctaaccagggtcaaggccctccttccgtcctgtcgccaagccacaggagcagtatcaggccttaggaaaaagccgccttccccaagacaaggacagcaagaactcagggtgaccatggtcaggccagcacttatccatctgccaggcatatgagaaggggaggggcttcggctctgatgttctgatgacaagggggtcttggggcttgccttagggacacgtggcacctgtggaggttcttggaggcatgtgggtataccatgggctggaaaaagatccaggagtcatctgcacagatatggtggctgaaggagaagcagtggccccaggaggtggtggagcaagaagggcctaggatagaacccagaaggacaatggtatttaagggaccagcaaaagagacaagtaggaggaaagtcaaaagtgtggtgtcacagaaatccagggaaaaggtttcaagaaacagtcaacagtgtgaaattctgctatgcaagtcgattatggtcagagctaggaaagatccattagatacaacaagatggtggtcagggatcgtgccaagaacagcttccatggtatgttggagtagccagctcccagtgggactgaggaacaagcagggtagggtgcagaggggaaggctggagagggtggcagccggagggggatgttgctttcttggctcccacccccacgcccccaccggctgccattctgcctggttcccatgtctggcccctctgctgcctttgcccagctctggtcttcaggatgggctggattctggactttctggttacatagacttgaacaagtcacctaagttctgaatttatttccccctctgcacaaggatcagatctttcagatctgtttgaggctgctgtgaggatcaaaggcgggtgaacgtcaatgtgttctgactatttatgtaagagtaaaaggaggctgattctctcctcctccctcttctgcaggctcaaaaatgaccaggctaactactcgctcaacacagatgacccgctcatcttcaagtccaccctggacactgattaccagatgaccaaacgggacatgggctttactgaagaggagtttaaaaggctggtgagtgggtgtgagccatactggccttgactcgggtttgggagtatggtatctacaggtccagtccggggcctggaatctttggagagagggagtgagtctgcctcaacagtccaagacaagcccaacctagacactttccacagagaagacatctttgtgttgacgtcctgacctaggaccaggtttttgatcctttgcttgggttgagtgcctttaaagaatccagtgaaagctgtcaaccctctccccagaaaggtgtgtgcagcagctatgaagtcttgcacactctcttcaggttgttcttaaatcccaggctgaataagtccattcctgcacgtgtctgcgaggtgtctctggccccctacatgccaccctgtctctcaaaggtttctccaacttccttctcacagccctttttcatgtaatgacaaattaagaacacgacctcatggtctctactctggcacttgctgccgtgtgacagtggacaaatccttccccctctaagcgtatctgcccatgttgagtgaagaggatggactatcactacattgctaagagctgccttctttgttctctggttccatgttgtctgccattctggcctttccagaacatcaatgcggccaaatctagtttcctcccagaagatgaaaagagggagcttctcgacctgctctataaagcctatgggatgccaccttcagcctctgcaggtaggttcctgtctgggcttctgggcagttgccctgtcctggccccagtgtggctttctgtgggacttctagcaagatgcccttccattcttgggcagcgccatgaatgtgtgatgactccctggtttctgggccctggctgggagcagcgtctcattagatcggtttgttttctataaaagttcttgagaggctgttctaaggggagactttctgaagcccagtcccaaaggtctgggcagttggggacacctccatggctgcccaaagccaagggcagggagaggggcccaggcctgttctgctcctttcttcctatgtggtcttggcaaggcatcttcttgccatcataggaaggagttcctttctggttctggtgttctatgatttttacaacatcctgggtactacaagttgcctgatctttttgcttctctgaaccaacgagcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcagcaggtggcatgtaatttggtggtcttgggcgggccgatgtgggcaggatgagcatggagggagctgggtcagcctgctcagcagcagggcctgagcctaagggtggctgtgaatgccaggccagagatcccaatgctgtgggccaagaggggtccagaggctgtcctccttccagaagaaataaggcttctctggttgttgctcaaacattccctgaactctcagcccctcctaactctaggttttaaggagtaaagcttccttttgggttcctgaagctggcagttggggtgagagcagatgagatggaagagggctcatcagacactggccttggagggtgctggcctctgcagaacgccagcatcttctcagaatcgtatgttctagaagcctggggcaagtccggctaattgtggacttggggaaaataaggcccaacccctgtttttgcaaggttaaggagaaataatcttaaaccagtcacacaaatcatcggcatttatttcctgggtcctaggtgtcacttatcctggtggacagggcagaggtggtcagatcgttttgagccaaaatcccttccctaaaaatggatctgtggagctccatgagggaacctcagagatgcacaatgacagtttagctaaaatggcttaaaaaatgtgaattgattgtcagctctctccatatctgctgaaaaaaggtttaaaatttttaaaaagtttaaaagtgttttctaaaaaagggacaagcaggtctggacccagaagattgggctggagaggaggtgttggtgttgggacagggtccctgcccgggccgctcgcgagaggagcgttcctgtgtgggctgctcactgtagggcaggccccgcccaagtcccggcgccagctcaataaataacatcttgtggttacagtgtcttgaaagtgtacctgggcacggtgcgaaggtggtgggaatgtgaagcctgtgggtgtgggcagagggctttcccggagtggaggccacagaggcctctggggagccttctcagtctggcctggtttatctgggacatggagctcagagaagaggctgctgggccagtgccagggttccccctctgggaggggacagaaggtctctcgtccagccttcttggacaaggtcagattcaagacgaggtggtcccatcgctgctctggggctggttgccagcttccttgtctggggcgcttccctccacctgtccttctggagaggagagaaagaggtttttcttgggcacatatacacaaagtaatgcacagaaggaggtgtgaaagggcccagccaaactgatagcagtggatatgccctggggagcaagacgagctggagctggactgaggtggtggtggcctatggactttagcctggtctgtaacatctttttacatggaaatacacatagtgtttgttagtataattaagagtcaattaagggccattatggatgggtgcttaaagcatcaagtgaagggctcttgaaggttgctttgtttgtgcaggttccccagagggagaggccagatgttaagtccccagtgtgtcacaggtgctcagcaaatggcagctgttctgtttgtttgttttttttttaatttttgtatttttagtagagacggggtttcaccatgttggccagactggtctcaaactcctgacctcaggtgatctgcctgcctcagcctcccaaagtgctgggattataggtgtgagccaccgtgcccggccaatgttcttctaagagagtaaagagcactgaaccaggccagctcagggagcgccagggtgtggcctgcatcagagtctgtgggggccaaccgtgcatcatggggtgtgtgttgtacctccttctcaaatccatcctgtcagacatcttggtggggtgaggggcagcagcaggctcacagagatggagcacctcactgaggggagtcaggatacaagccaagtctcctcactttcagcttcc

SEQ ID NO: 16164 - DNA, 32310 bp, Human
ccccaggtctcctgacgtcaaatctagcctctcttgtcctccacaacagttgctccctctcccctttccctacaggcaatagcactccccagtcatctcagcttcagaggtcagatcaagtggacagaataaagctaagcagggcagagaaagggcttctagcagtggaaagaacatgaagatgcctcctcataccactcgaacacacatgccctgactcccgatttgctcactcattaatccacccacacattcactcattcactcactcattaattcacccacccattcactcattaattcacccacccatttgctcacttactcagtaatttaccctcattcgttcattcactcactcattcatgcattcactcaactcactcattaattctccctgtctctaattcactcactcctaattcacccactcatcaattcccccacacactcactcattaattggtgctcccactaattcgcccactcttgctcacaggtgtcaccgaggccctccaacctgcccttccagccagcagtggaggacaggctcccaggcctcccaagtctcaggcttttcttcctctgccctcactctctgccttctacatcaagactttacttccccagattgattggcagcccttgaaaatgtctgcacagaaggcaatgagggctggagggagtgagaagaacagagtgcaccatgagcttcagacagccaggaccagctgtgtaattttcagggccccgtccaaaacaaaaatgcacaatcccttgttcaaaagtcatgatgaattttaggacaaccacagcagagcactgaaccaggaaccaggactttctaagggttgggttgcctgtgactgcactggcgatacccccacaaagcccactctgaaggtaggagacgggtggagagaaacagggggatggcaagggggatacgaaacagggagagggaggagggggaagaggatggacgtctaccaggccccacttggtgcttgatttatgccatctcatttccttctcaaaccaccctttgaagttgattgtacattttacagaaaaggaaactgaggctcggagaggagaatcatttacccaaggtcccagttagtagacggtaggtgcctgaatgtaaatccaggtctctgcctgctccgggagggggtgggggtgagggaaacaggagaatgtgatgggaaaatccgagatggagccagcctgggccagaaacactgggagctgtgggagacggagaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtggactgtggtgtgtgtggtgtgtgtgtgcttgtgtgtggtgtgtgtgcgtgtgtgtggactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacagggagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacccatccccttgagcccattgttgtttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcaaggttcccaactcagctctaacaccaaccagcagagcgacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagcatagagaatgatattgcaaacatctgagtactcactatcccaactttacaaaagggacagccagaggagcccgatgcctgagcttccggtcccagggacaaatgccccagttcccttagtattcattcgtgggtatcacgtgatctccaaagtcttcacattctagaaaatgggaacaagaccccagacccatcctggacaaaggaggagaagaccagagcacaacatttattaaggtcttgccaggcttcctgctaccagcaggtatcagtcactgggctgtgctttttccacacttcagtaggttgggttcatttcattttcatgacaaccctatatgggaaaatgttgtgaaaatgaaatgagcccagcccattgaacctattacaattcctccctttttgtggatgaaggaactgaggcccacaatggttaagcaacttgcctagggccccacaactgatccttggaagatctgaagtcccagagcttctgctatttggaccacacttcagcactgtctattattttatgctctccagataccagggacatttaaaattgttttcagcccaagcaagggaagcaaaaatcttttaactgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcaaaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgttttctctgccccctcccttggaaatatcttctatgtctcatccttatgggaccttagtctgggctcatgagctgtcttggaaaatctgggcttgctgatcccgatgcaggagtgggtggtccccaaggcctgctctgaacgctgcaattctaacatctagatatcagtggttctccaagggcaagaggggctttttaagctgcaaatactccctcctctcccaaacccagttttcaatggggttaagcctgtctcatccacttcaacttccattttgtggactgggaaagattatgaatgggaacctgatgcatgtgtgaacagttggaggcaagaaaaagattgagaactacagtctaaggttccaacatttctgtggttgtattagtcagtgattccattatcccaaaagcctaagattttaggcactatgattcctcataggtgtcatccagagggcactgtgtttgagagaacagctctctcacagtgaaagttcaggtctgtgacaggcagatgggagaggggttggcagccctcctgagtggatggctacccacctccactgcgtgtggcctggtcctgcgtgtggtcagttgttataaatgtcttttattagacatccagagtcattttcacttgtgtaatttagggacatttctgtctcttctgggctctagttttcccatctataaaatgaggacattggataatgaacccttcagccctatgagtctcgctcctcactccctgacctacctgcacaagtcacactgcccactaggatgggtgtgtttgttccctggtcccttctttttttttttttttagatggaatttcgctcttgttgcccaggctggagtgcaatggcagtatctcggctcactgcaacctccacctcctgggtgtgagtgattctcctgcctcagcctcccaagtagctgggattacaggcatgtgccaccacacctggctaattttgtatttttagtagagacagggtttcaccatattggccaggctggtctggaacccctgacctcaggtgatccgcctcggcctcccaaagtgctgggattataggcatgagccactgcgcccggcccctggccctttcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggcgagtgagcgtgggttagtcgatgctagtgtttgtttacatgcctgggttacctggaagatcatgacacatgcagtcacttggttgttttgagaacgggccagagtgacaaagtgttcagttgccactgtggtcaagccataggaaatgagggtattcctagctgtgcctgtcttctaggccccaccacccctcctcagcctgctgggaagctcccaaagccaaaagaaagtctcggtggaagtctcactggccaggagagttgggacaagtttttatttctttttcttgatgaccttaggagaatttgaggactgaaaccctaaaatagtccctgagaaccagaaagtgtgagctggaaaggtaggatttcaagaccagctgagtctataagaggtcatcaaatctacctgctccccactttacagaagaggacactgaggctagagaggtgatgtgacgggtcaggggtggagtcaggtctagaactcaggctccccagagctgagcagacaccaagctccctggagtgaaacttgcagtgatcagcttgggaggcacatttcttgatctagatggctgaaactttctctcgaccacagagaggggcttcaggtctcatgggcctataagtctctgccacaggatagtccaccatggctggaaggggctccctggaaggccaaagaatccagggagaaccctgggggtcagtgggccaacagcaggtcaagaattctttcctgcaaccgaaagccagggagacagacacctgccttggcctaagctgtcaggcccaggacaaatattcggctcctggcatcaaaaacccagcccagaaagcggacccagagttgcaggaggtgagcgtaggtgatgggccaggggccatctgaagaggccttcctcggaagcccctgccctgctccccacagccccctacccaggagttccctgggaagacaggctcatcacctctccgcctctgcccaggtcggttaatattcaatagaagttacattaggtccccgaccctgctaatactgagcaaacatttggaaaacatcattccgtgactgagctcgcgccgggcactgataacgcccgcctaaccttgaggagccctatccgcagctgctgacagcagccctttcattccgcccgccggccactcggcgccctgatgggtgggtgcgggtgctggcaggaggctgccgtgggaggggtgtgggcgggtggggtggacggcccggtcagggaagccgtgctctgagctggccccgtccacatggtggtctgagaggaggttgcttgcctctggacttctgttctatccactgactcccgggctcaagtgcaaaggatttgacttttattctctgattttaacaatgtgtcaacatcaagagaaagttgaatagctggggtgtcaatgttccctggagaaatagggttcttataagaattagagtttatgaccaggtgtggtgcctcgcacctgtaatcccagcattttgtgaggctgagtggatcacttaaagccaggttttcgagaccagcctgggcaacctaatgagaccccgtctctcaaaaaaaaaaaaaaatttagccaggcgtggtggcacacgcctataatcccagctattcgggaggctgaggcaggaggatcgcttgagcccaggaggttgaggctgcagtgagctatgattgcaccactgcagtccagcctgggcaacaaaatgagaccccatctcgaaaaaaaaaaagaaaaagaattagagcttgtctcttccaatgccttcgttctctcactgcacaaatattcattgagtacctactgtgaaccaggccctgttctggtggctgggactacagcagtgaactagagggatggagttttggccttctgaagctttccttctcagagagagacagatagtaaaggaagtaacaaataattctacaataagtgacttgaagaaaaataaagcatggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggcgacatgacttgaacggatccctctgtctctgagaggaacacagactgcaggcgcaaggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttggactccaagggctatcccatccactgtcgggatggtggaaggatcatcttctatctcaggccaggactgacccagatgggagcaggcagtggagcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctccattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcctgtcccgacaggtaccggggtgatcctgccacccacccagggatcccccacactacagaggagctcacctcctccacctccattctccccagccaggccctggagcagctgacgggaggggcctcagatattacagaagggacactgagtccggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccccacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcagccagggggctgctggcccacctgggatatagccgtggactggcttgattttattttatttaacaaaatatgtagtgcacacacgtgtctgaaactttaaatcaccttacaaatattaactcagttagctcctccaacaactctatgaggtaggtactaaggtactattattactgccatctcataggtgaggagattggggcacagagaggttaagtaacctgctcaaggtcacatagctactatccagcatagctgggattagaacctggcaggaagctccaaagtccaagctcctgaccattgtacctgaggctctcccagggggatgttgacagggaccctaggacagggatcaggagattttggcttaagctatggctctaagactggttgtctgcctaatcctgggcaaatgagttcctctctctgagcctcagtgttctcttatctgtaaagtggaaatgataatatccactttagagtgtggttgggaggattgaggacattggtgtctgaaaagtacaaaaatcaggtgatggggcaagctgcacagtggccagaccagagctggtctccctaaacattagtttcttccttgtttcccaccaaaacgattgaactcagcatcgtgtttcccaccaaaacaattgaactgagcatcatatttcccaccgtacatttttttggaatactgaaatgtccctagggggaagaaagggttgaaggaaggtggcgtgtgtctgaggacagatgaatttcggagatgccacctatgaagctcctgcccagagcacccctgggcctccaaagagatgttacccatctggggaagaggagctgggctgggccacctcctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactcctttggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgttaacctcgatttcccacccaaacctccctggctggggctcagagcattctcagagagcaatgatgggtggccaataacacaggacaatcattaacacaccaccccgacctcccggcccaccccccagaacagctgccatatcagggggttgaacctgggatcagaagggttcccagctccccattcctggtatatgaggagcccagcttgcccaatgcaggtggggcatccctgggaaagtcgggggcattgtcctccaaagggcttcccaattttgttgacattgccccagaaactagattcccagttggtgtgcttcttgggcctggatacaattgcagaaagagattggggcttagagagagacagaaatttgcctgaagtcacagagcaagttagcgacagaactgggattcaaatccaggtcttccgcttcgcgatgtgaaggccactggagtgactgatgaaagacttgcacagtgcccagtgcgcaggaggcgcttggcaatcagcatcctcggcctccctccatactggtcatggaaagtggattttccctcccaggcagtttcctctttttctgttttcctcacaggtttctatccatggggaatagaaggggcaaggacaagtggctgcccaggagcagctagagctagagaggaagtcaagatgtttgctcattcattcattcatttcccctttccttccttcattcaaatatttattgaaggcttattttgtgccaaatatcttcagacaaatgccttctttcctctaacaacaatttcacctccttagaggccttctctgacctccccatctaacgtagccattcttgccccattgctctcaccatcctttccactcccctccctccctccttcccttcctcccaccttttctccttccttctttcctttatgctgtgatcaccctgtgtcctctgtacttatttgttctctactatctgttcatcctctctcctataaatgttagttcgatgagattagagaccttgtctctcgtttttaaacattgtgcctccattgtcttaaaaagtgtctggcatttagtaggcatttaggatttgataactgaaagaatgaacaatcaaattaatgaacaaacaaaggcattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaagggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtggttcacacctgtaatctcagcactttgggaggctgagttgggctgatcacctgaggtcaggagttcgagatcagcctggcaatatggtgaaaccccgtctctactaaaaataaaattagccaggcatggtggtgcacgcctgtagtctcagctactctggaggctgaggcacgagaatcacttgaacctgggaggcggaagctgcagtgagccgagatcatgccactgcactccagcctgggtgacagagtgagactctgtctcaaaaaaaaaaaaaaaaatagaatctgtatttttacaaagcacccttcataattctccatagctggtccatgggtgggaatttgggacccacagttttggaactttttgggatcatagacctttttgagaatctcaaaaaagaaaaaaaaagcacacagaatgttgcttacagtttcatcaggcacacagaagaggcccagcacgaagcagtttcttgcccaaggacacagcagttcaaggacagagtcagcgcgaggtctctcagctctgagcacatgttctttccccttccaggtttctagttttatgggtagtagttttatgatgcccatttcacagttcaggcaggtagaggcagaggggagcattaagctgacttgcccagcgtcactgagttggctacgggcagccttcccaagggtacagatggcaaacactgttccttctctctttcaggtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattggagggctccaggactcagttttcaactgggtaccccactcagatgcaaggaaatgtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacgttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcatagttattattttaaacgcttgtacagcacacactgtgtgccagggactgtgctcactgctttgcaaacactacctattttaatataacaatgctatgagggaagctcgattatttatcctcatcttatagataagaaaactgaggcacagagaggttaagtaacttatccaactataaccagctatcaggggcagagccatttaagcagggcagtgcagttccagaatctggtcctttaaccttgatgctttggtgcctatcaggtgacctttgaatgtcatcgatcttgtgagtcatgttggtaaatggagcttgggtcatgtgaaagaggtcctagaaagccaagttccaagctcagccggatgactcaaggcagcttatcttctgaatctgggcctcagcttccttacctgtgaaatgggagtcaccatccctgcaggtcctcctcccacaggcaccagctatcttgccaacttaaaagccaaaactagaggagaggggtcaacccaaggtgacttcccatcctccctccctcccaacccttccaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacaatatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactttgggaggcagaggcaggaggatcacttcaggccaggagttcgaggccagcctggccaacataacaagacctcgtctctatagaaactaaaaaaaattagccagggatagtggtgagcacctgcagtcccagctactcgggaggccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagccggggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaactgcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttccaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgacacaagtcaggggacatctgggtcttgactccccagatgctccagctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctctttgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctaccccagcctttcaagtagctgggactacaggtgtgtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggaagaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatcgcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagttggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcaggtgggcaaactctgggattttaccttgcaaagggtgaggatggggcttaagacaggaggcaggagaaagtggagtctagaaggtagaaccaggatgcaacagttttctgggttccagggtagggaataaagggcaagattgtccatttgttgaggctgtttattcagtaaggtgactgacagcctttactgaatgaagccattgttgggatgaggcaatccactggatgaggtaacccattgggtgaagatgttcttgggtgagaattccattagttgacattgtccattaagtaaaagtggtcattgaagtaaggctgcacagttgggtaaggctatccattagacaattatatgagactacccattgggtcaggatgtctgctgggctagaccatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagaatatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctcgtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaag

SEQ ID NO: 16165 - DNA, 16438 bp, Human
catgttggccaggctggccttgaactcctgatctcaggtggttctcccactttggcctcccaaattacagacgtgagccaccggcccagctgtatttctgtgtttaaacagtagagtgaaatcaactatgaacgcagaatgatgggaaagatgacgataagggtatttcaattttgtcattttacgaaactacttggagttttgatttgtatttacagtttttaaaagagtaaaacagtgtgaactgtgaatggtaatgattttgtttggtaagtgcaaattttaattcatacatgaaaaatatttgttttgtttcatgattattactgaaaataattttgtactatgaaggaagaggggtgttaaaaatgatccactgtggatgtaaattattctaggcatgcttctgactaaaacattagcatttccacaagaatcccaaaaaataaaacaaaatttaaaagatcccttctgtttcttttcctccaagtttccagacccccatctccaccctggccacctcttcctgccataaataatcaaatcccacactttcatcttcaccttccgtttccattgcctcttccgatgggacagcacccgtggggaatctcctccatgctcacaatccccgtcttgccactatatcaagtcacacttcttcctcaccaatcgcccattctggaacctctgctatccagctagatcactttgaggtttggacaactactggtggaggtaatgggggccccagacagcccttgacatcacctcttttatctttgccaaattctacaaacaaagcccatgtctttctgtcccccgcccccatggctggcacatagtagatgtccccaaatcttggtgatgtgaacttgtgtgtctcacccttcacagacatcaccatttcccgttgcacagaaggctccactcataccaggcgctttggctcccagaataagcaggctatcatgctatgtccgacatctaggcgttggtacgtactgttcccttggcctggaacattctgccctctctcaccctctcttttcttggctttctgaaatggcacctccatcagaaagtgtccctcactcttggtctgagcaagggaccttgcctggtattcctgaacttccacctgttttccctctgttttctccctctctgggccttgtcctcaggtcagtgttgtgcctccagctcctgcagaggcgaactcagaggcggccgaatgaaaccaaatggatttggcttgaccccatcatctagcggtgcccagcaagcgctggcacatagtaggtccagcctgcccggactcgcccaccacgggcccccttccagagccgggaggcaggccaagggaggccccttattgccaagagcaaacaggccgcccagggaagttttgctctgggtcacacccacctctgggtggctgccaatctgcctgccagaaaccgcaggctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgtgcgcgcgcgcgcgcgcgcgtgtgtacgcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtaaggaggcccgggccctggaatgcactgctgactatttgggtgtggagggggtggggatgtaaaatcgcagccaaggacccccttggcagaattcctccagggccccacattgggcacagtctggcccccatgcctaagcagggcttctctccctggaactcagagctgcctccggccagccctgctgtgtgacctcagatatgtgtcttgccttctctgggcctcagcatcttcccaggtgaagggtatacagtttgtgaggcctctgtgaagaccattcatgatcattcatcaaacttaccaggcaaattgaagaggactttaatgtatcctcattatgaatgggggcactcaagacatgacatgcttggcctaactctgagccagcatttggatggatgcctagctgattggaaggttcattctgcaagggcatcaatgctgttggactcttaggcagtgagtgacccgcccgccctagctagaggggaacaggagacacctctgtggagtaatggccttatccctgaatgctgcatgggacattcaccaaagagcctgtgggacatctaccttgtctaacatgcacaacaatcccataaggaattttcagttaagtgaggctcagaaagggtaagcaacttgcaaccccagttttcagtcaagtgaggctcagaaagggtaagcaacttgcccaaagccacacagcaaagaaaggtcagagcaatagaggagagccatggtggagcccagaatgacatggatgtagggggagaagcactccagtctgtgcctccccaagcccaaactggaccaaggccacagctgctaagccttgtcatcccctcggcaaatgctgagttcccagagccatggaatcggccccaccacaagccacgatctcactgtattttcacgctcctttgaggagcacgggcaggagcttctctccctcaggctccaagtcttcgtgcctgggaagcctgagaaccacgctggcatcctgtcctgctgtttgttcttccaaaggggatgggtagggcatgatgccagtgtgggtggcttgggtagttggaataggggacttggggctctaggagggagaaggggcccaggattatacgagaacaaagtaaagctgtcctagacttgccattagggtgagacttacgggaccattcttccctggtcccaggaagcagggactgcacagaaacacagggacttagtcaccacaacatggaaagccacagcaaccctcagagggagaactgtaagtcttccaggctggccgttggctccggggctcctggctgtggaccggggcaggaggcagacacctggacacaagcaaaatcacattgatcaaggactggccagaacctcatttaatctccatcatcactcagaaacaggttgtctctactccagtttacagaggagaaaactgagcttcacctccaccttccaaagccgtttgtccacatgttcagtcacgtagcaagtcactggcagaacttgaatctcaactcttgcccaaaaaactccatgcccagtactcctgccccagatatcatgagccttgccccccaccaccagatatcacagcaaggccctggggaaactgaggcacaatgggacaacttgagtttgggccttggatgtcaacttgaacttggatgtcaatcctgattctgtctcttactggctgtgttactacacgctttgagctccagttttctcatctttaaaatgggcataatgatggcacctcacattggaggggtaaatgagacaacagcacttggcacatgacatacatatggtatcacatgagataattgtacactagaatagttgatatcattaatagcctctcctgggtatcggggcctacagagtcctgccccctgacaagcatggccagtagaggggtccacagtgggagccaaggtgcacagctgctggtctatttcctggcactcctgttttcaggtgggagggacctgagagtcatttctgacagtcctccctccattgcccacaagccaagggagctgaacctctgacttagaagggaacccaaaagcctagaccgtttctatgtgaatcacctgtggatttatgaaaatgcagattcgggctgggcgtggtggctcatgcctgtaatcccagcactttgggaggccgaggtgggtggatcatgaggtcaggagtttgagaccagcctggccagcatggtgaaaccccgtctctactaaaaatacaaaaaattagctgggcatggtggcatgcacctgtaatcctagctacttgggaggctgaggcctcccaagaattgcttgaacctgggaggcgaaggttgcagtgagtcgagatcgtgccactgcactccagcctaggtgacagagcaagactccatctcaaaaaagaaaaaaaaaaaaaagaaagaaaaagaaaagaaaatgcagattcggatttattatataaaaattcagcttcggatttatagaggggctccagatgctgcctctctgacaagctcctagatgacgctgctgctgctagttcagaccacaccttgaggggcgaggctaggccatcgtctctagaatctgaacagcctgcagcgatgggatccactcccttgtgaggcagccagacacctagctccgtgtgtccatctgctactcagtgctgtctcagtgggggctgtgatcgcctcctactttgtggcccccaccagaggctggtcagccagtttgcaatggctcctagtggccggcgtgggagttgccgggaactgaaagcaggtttgcaggattgtgggtagtgggggcactgggcggggcagagggtgaggcagagcaaaggggtcattgcctgctttggggctgcacaggagatatgaggtcattaattccatcattataaactgcaagcctccattcctctagatgaaaccctcatcccctaaggatcctactaaactcaaacttggccccccaaagatggggccactggaagcatcttgaattatacttccttcttggtccccaccttcaaatgggcagacagggagctcacggcacctgctgtatgctttggttgtttctctgatgtgggtggcgagggtcaggcaggccacatgggctgataccctgatcctgtctctggggagtgggtccctggcttacggacacagtctacccccatcccgtgtccctgagtcctcacttgggaagcaggaccggggacgctcccagccctgaatcgaacacactgacgtgtgctaagttcctgtccctctctggagctcagtttccccatccgtacctggcagggggaggaggttagactggggcagaggtgctgaaaacctagctgagcttcagaagccactggacagcttattaaaaataaagattccaggtccctgactctgggacttctgattttgtaagccccagagtgggttgggggtctgtattttcccaagtctcctggctgatgtgatgtacctccagagctgggacacatgctgaatggatcgaaaggccaaaaacatccatgatatggttcaatttattcagtcctaagataagtatccgtatgctggaaaatgtaccagaccctaccattttcatccttgacttgttgcttttgcctttctgtaagctcccagagggctggggctgagccctctgccaccattaacaacaaggatcatcaaagctaagtgcagtgagcgcctactgcatgccaggccctgtgctgagggtttgctgtgcagcatttcatgtactcctcagagcaatcctctgagttagatactttgaggaaactgaggctcagaatgcttaagtaacttcctcaaggtcactcagctaataaggggcagaattagaactggaagtctagccaggtgcagtggctcatgcctataatcccagcactttgggaggccgaggcgggcggattgcctgagctcaggatttcaagaccagcctgggtaacatggtgaaaccccatctctattaaaaatacaaaaattgccaggcatggtggtgggcgcctgtagtcccagctactcgggaggctgaggcacgagagtcgcttgaacccaggaggtggaggttgaagtgaggctgggatcgcgccactgcactccagcctgggcaacagagccagactctgactccaaaaataaaaataaaaaataaagaactggaactctagtccagagtccttgcccataactacatgccatactgcctcttagggcatgttgtgggactactggcctttgaggccaggtctgcatggctctgaggctaaggtgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaaccatctcactaccccaataacctttccccatccctacctgtccaaatcattgccaactttcaaagccaagttcaaacagcttctcccctgagaagcccccccagattcttcaaaccagatgccaccactcccttctcaggatccttacaacactttggggaaaataaaagtgcaaccttttagggcataatatgtgtccagaactgtgctaagcacttactacacaagtcacatcatcctcacaataaccctatgatgggaagtactttcagacctattttatgaatgaggaaacaggttcaccagcattaagggacatgcttcatgtcacacggcacgggaccagatccaacgggctctaaggaacagtttattctgtcttctcccatagtgggggccctcggagcactgctgggatcctgggtttgccatgtattcagcagtcacccgagcatgtgacattcctcaccactcttctaggccttggtattctctgatgcttcggggcagggctttgcaagctggctccagtgactgggtgccagagaattagttgttgtgggagggctgtcctgtgcatggtaagacttctagcagcatccccgaactccacccactgtatgccagcagcactccccatcccccaagtcatgacagtctgtcttcagacagtgccaaatttccccagggggcaaaatctccagttgggaaccatcactttagagaaatgcaaagaggcaagagattgttcttcttttttcttttttaataataagccttgtagaacaatttgcctctttcatctatgtgcatgtcacacttttataaaaataagaacgaaagagagagagagagaagctcatgaatcattgataatgaattcatctgtaggaaaagccttgttaaaaaacaacaggccaggcacagtgactcatgcctataatcctatcagtttgggagactgaggcgggacgaccacttgagcccaggagttctagtccagccttggcaacatagtaagatcctctctctatcaaaaaaaaaaaaaaaaaaattagccgggtgtggtggcacatgcctgtggtcccagctacttgagaggctgaggtgagaggctcgcttgagcctgggtgtttgaggctgcagtgagccatggttgcgccactacattccagcccgggcaacagaccaaaccctatctccaaaaaaaaaaaaaaaaaaaaaaaagtaataactccatgtgaaatgctttatttacaagtactgtaaggataaggagggtgattcgttacactgactgagggatgattgcttatgaaaatgtatctgaagaacaattgagataagtaacacttcgcttacaaagctgttatttacatttgctgtgacacgtgtaaacagcacccacagagtttattttacacttgcacagcccttaccacgtgtaagacactgagggtttcacaaatataaactcatttaatctcacaaccacatgaggtaggtacccttctcttataaatggaaaaaaggggtacagagaggctaagcaacttgcccaaggtcacacagctcataagcggcagagctgagatttgaactcagggagctggctccacaagctccattgctcaactgcctgacatgcagcagttgattagtacataggctgtgattgttaataactgtattaagggatttttcttattccatcttaattcagacttcaaacacctgcaggccaaaggcgtacttgggtccctggtccttcctgcaacttcccaccttggtctgtcaacatgatgggtgctcaacagtgtttaatgatttaaactgaatttagaggccgggaactggtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctcttttttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtattttagtatttcagtagagacggggtttcaccatgttggccaggctggtctggaactcctgacctcaagtgatccacccgcctcggcctccctaagtgctgggattataggtatgagccaccacagccggtctagacatctctcttttctcacctcccacataccacccaccagcaaattcatcgtgtatttccagcatccgacactcccatcccttctggtctgagccccgtcatcattggcctggattttgcagtagccccataatcatctccctccttctgtcgttgcccctggtctattcacaacacagcagtcagagagctcctgggaagtcataagccagatcacctccctcctctgccccaagccttctggtggcttcccatctcagaggaaaagccaaagtccccacagtggcctacaaggccccaacaggatcctgttcatgcttcctctctgacctcctctcctcctgctctctgctccagccacattggccccttgctgttccttaaataccccaggcacactcgtgcctcagggcctttgcactggctgttccctctaccagcattatttctcagcaaggccttccctgctggaggattagatgagctaggggacttacagcattttgccccaagcctggcacatagcagatgctacgtggaagcataaccctctcctgtttattgagcatctgctatgtgccaggcttggggcaaaatgctgtaagtcccctagctcatctaatcccccagcagccctgtgagccgggtaccaaggctcagagaggcaaaataacttgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacgcttcaccagcgctcttacttcattctgtcttggagatgatgccctcacacccgtccccctttcccaagcccatgagtccctcgaggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggccgccccagccctcaaggagttcatgtccagtggaggaagtggcaataacacccatatcttgagggcttcattgaaagagtgttccctgagcacctaggccatgcctagcactgtgtgctagagggtacggacatgtcatcccatggaacctgaagttacgattactgagctcatcattgctgtagttcaggccactcagagaagttaagtaacttactcaaagacacacagccagcaagttaagccctgacctgacagtgatgacagcacaagtggacaacgactttgttgcatgaaatctcagcgtgtatagaatacttaaactttattaatatatagtaactatactaatgataataacagagtagctaggacctatggaaggtctcttttatgttgtgatcattacgcctatcattccgagtagtctctaccaccctggaaaataagtaccattatatcccagcttgcaaatgtggaaactgaggcaagaagaagtgaaatcacttggcccaggttcacagctaagaaagggcagagtttggggggtcaatccaggcctgtcttcttgcaatccctgtgccgggatccagggtgccccagcaggctggtggagggctggggagaggtgcatatcctgggctggagccctgggcagggcccagctactgtgaggcagctgcctcaggcagcgggatctgggcagctctgcagagaaggctgtgccgctttgcgggtcaccgatgggggtgcggtttttcctccgcagtggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggtgagcgcagcggtggtccaggtcagggcaggactgcctgggggcgccaagggccacctagggggtggggtggggcgcggcttcctgggtaccaggacccagggacacatcagaagctgggaggggcggaggctgaggagggagataagaaagaggagtggagggccgggcgctgtggttcacccttgtaatcccagtacgttgggaggccaagacgggcggatcacctgaggttaggaattcgaaaccagcctggctgacataggaaaaccccgtctctactaaaaattcaaaaattagcctagcatggtggcgggcatctgtagtcccagctacttgggaggctgaggcaggagaatcgcttgaacccgggaggcagaggttgcagtgagcccagatcacaccactgcactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtgacagagccgggagaggaaaggtgggttagggtatgtgaaccaaattctcacatttcagagatataatagagctaagctcttagaatatataatattatcgtatttataatatattgatacatattaatatatttagtaatttattattatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccgccatcccctttttgctgtgtgactctgagaaagttgcttaacttctctgtgtctcagtttctccagctgtaaaatggggacaataagagcatccacttcatagcgttgtgagaactacttgagtttgttcaagtcaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaactaagtgtgtccctatgcacgtatacaggtatatctacacatacacatgcatacacagcacacacatgtgggtagaaatcagggtttctcaacgtcagcactagtgacaattggggcaagtaattatttgttgggggggttttcctgtgcactgcagggtgcttagcagcattcctgacttctactcactagataccagtagcatccccccagttgtgatcaccaaaactgtctccagatattgccaaacctttcctgggaggcaaaattaccctagttgaggacttctagtgtaagactagaaggaaggacaccaaaatactcacagagggagacttggagcagagaaaaagctagaccatggtgaacctgccatcttgttcctggcacaagaatcctggaatctttagcatccttgccactgggccaaagcaccactccacacaggctgggcaccccctgcctgtaaaatgctgtttatccaaagagacgagaaaaccatggttcactgagggaccatcgtgaccaacacactctggttgccaaataactaatatttatggaaatcttacaagtaccaggtactgtgctaggcacttcatgcccattattttattcaatgccatccactgttaagaaatttacataacaagaaactgagatgcagagaggctgagccatttgaccaagattgccgtggccgctggcaggtgggttgattgagctgctgagccctggctgctcagtgctaactcttgttctttcccccctaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgatcttgtgtgtcaggcctgtgttttctgagaaagccctcccattatccggggcagaattcaggggcggagttctctgtgaacctcacaaggtgaaatcacatggtcttaaagaaagccagaagacaggccttcaagtgatccaagaaacccaattcatattaataataattaacttttttatttatttatttttttgagatggagttttgctcttgttgcccaggctggagctggagtacaatagcacgatctcgactcactgcagcctcccgggttcaagtgattctcctgcctcaagactcctgagtagctgggattataggcgcatgccaccatgctcggctttttttttttttttaaatatatttttagtagagatggggtttagccatgatggtcaggctggtctcgaactcctgacctcaagtgatccgcccgccgcctcggcctcccaaagtgctgggattacaggcgtgagctactgcgcccagccaataattaacattgcttgagcgcctgctatgtgctaggcactagcactttatacagaccagtgcttcccagcgtttttgaccagagaagagcagggagaatgaaggctgcctcccagggactggggagcatagcctgaaatcaactaacccaagggtgaaattgttcgaagtctcatgttttattgtttacaaacaaaacaaaacaaaaaacaaaaacaaaaaaaaacacccaacaccaaatacatatattttacattttcctccatggtctacctgtgtttgtttaaaaagtaaaactgtatttccattaggatccaagcaggaaattagaaaacactcttggtatttaaacagggatttcttcttattaaactaattttattaaggtataatttacccatagttaaatatacagattttaagcatatggtttaacgagtcttcataaacgtacacgctcatgtaaccaactcctcaatcaaggtataaaacattttcatcatctcagggagttccctctggctctgttccagttatccccctgctccccaaggcaaccactgctctgatttctatcaccatagatgagctttcgtgttcttgaacttctcattaatacaaccatacagcaggtactctataatgaatgacgtctttcactcaacataataaaacaaaaggaatttaatgagaggacttagtcacccatctgagaggccaagtaggggaccgtgtgatgcaagaggagaaattcaacaccagaccagccctcggggcggaggggcagagggagggcagagcccagagctggcaccagcaggcagaggaagaggacctggcaaggctgtctgctgggagctgcagccgctaaggagacacagcctcgcagacctaacaaaaagtagatggaggtggggagacctgccctggcttctgcctgctgctatcccccggtttccagttatgcctcccatgagtcgaacctgctgggaaggtggaagagaggggagcctgggagatgcaggacaaggaagggcaggagggttctgagaatgagggcaattcccagacacagtgtttgtaaattacccaccccaggtacggttgctggtcacagaggcccctgctgcccagcccccaacacttatctcaggtatcaccccctccagaaaccttagtttgagaatcacatgctgagtttgagccatgtaaccttcacagagcccctgcatggcaaatataactaactccagctcagggataaggaaacacccgggaaagcgagctgtctaaaagctggtctgcagctggggtgggatgctagtccaacctgagtttatctgactcttgagaatggctgttggtctctcacagattgagaatttccatgggtctggttctgcaaggataaaccctaaacacatttccaggcaaaattctgataacatcccccaaaacagggagaacacggacaagaatgaggaatgtgcaccgagggactcccatacat

SEQ ID NO: 16166 - DNA, 4888 bp, Human
gaaaggaataaagtggaatgatatatctttgcccataactcattctaggaaaaaggaactatgctggttttctttttcctccatttcaacctatccaatctacccaaatagttcccaatcattatcacctcatcccaaagcaacagacgggaaagaggaacagggcaagaaagcagacaggctttctggagtgacttttatccccacagagtcatagatgcagagttggaagagatgaattctctcatttgggagataaggacaccatgcagataaagagactctgtatcttctgcttttcctgctgctgcagtgcttcctccaggcaggcttccttagtttttcttggcttcctacccttccaacctacgccatcataatctggactccagccctttattccctcaaaggctgactcaggccatgactgagggaagaagcttggattctgtagtggaacagcattgtccatggggagacacggcttccatcccaggcctttggttccattacttagtttctcacttgcctgtctgtcatccaaaggggctcacaaggaggggaatgcagggaggagacatctccctaataccattggagtttttttccaggttaagatggtgcattgaatccacccatctacttttgctcctcccaaaactcactaaaactattataaagggattttgtttaaagacacaaactcatgaggacagagagaacagagtagacaatagtgggggaaaaataagttggaagatagaaaacagatgggtgagtggtaatcgactcagcagccccaagaaagctgaaacccagggaaagttaagagtagccctattttcatggcaaaatccaaggggggggtggggaaagaaagaaaaacagaaaaaaaaatgggaattggcagtcctagatatctctggtactgggcaagccaaagaatcaggataactgggtgaaaggtgattgggaagcagttaaaatcttagttcccctcttccactctccgagcagcaggtttctctctctcatcaggcagagggctggagatttcacctccggagagagtaaaaaggaggatctctgggctggggcaccaggcgtggctgaggacaaaggtggcatgtggagaacaggggcgttaagtgactatttcctcactgcatgctgagaacctcagctttcttctctgatcacttcccaaatcactggcagctactctccacctctcttctctgagcactctgaccagccaaaagggaaagaatgaaggatactggcattcagatttccagtaaacgaccatccatgtctccctacggtgaatcacagttgacaagcccagttcctgcactcagggtttttcatagtcctttactcttaatcaagagcagagagctaaagattatgtcttaggttccctagaaacagaagctgtgatgcagattcagatgcatgcgatttattgcgggcgggccctcagaagaagctcctttttccacctccagaaagagcatggaaaggaactgagcaaggatgtggtcttggctggagtctagcctcagtctgacccacagggagccctggagcatgaattgcaccacagggttgatctcaccttgaagcaagagggccagcttttgtatccatatattgatcaatcactggctgtgggctgccagggaggaagccatgaattcccaggcaaggtagttcctacttgaggacaattctttagataaagtggcagctctggtctatttatgaccgagatttatagcagctgaaggtatgggcagaacaccaataacatctactgtagattaccagattaccaaatatctgaggaaagctgctaacatggaagatagaaaataaataacaataaaaacaagtcaaaacaagcaagcaaactaataattaaaataaacagaaaaaggcaagttggaggaaaccaagatttatttttaagaataagaggtgataggcagttcggcggtccagtgggtctgtctcttgcttcaacagtgtttggacggaacagatccggggacggtcttccagcctccgaccgccctccaatttcctctccacttgcaacctccgggaccatcttctcggctatctcctgcttctgggacctgccagcaccgtttttgtcgttagctccttcttggcgaccaaccatgagctcccagattcgtcaaaattattccaccgacgtggaggcagccgtcaacagcctggtcaatttgtacctgcaggcctcctacacctacctctctctgggcttctatttcgaccgcgatgatgcggctctggaaggcgtgagccacttcttccgcgaattgaccgaggagaagcgcgagggctacgagcgtctcctgaagatgcaaaaccagcgtggcggccgcgctctcttccaggacatcaagaagccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgaggaatgtagggggaatagtccaaaaggtttaacatctgaataacaagcatttcagaaaaggagggaaggaaatcatcaatgtgataattcaagaaaaatttcccaaattgaaaaacataaattgccaggtcaaaagggctcaccgtttgcctagtttaaccaaggcacataattgtgaaatttcacagccctaaggataaagagatgattccacaagcttgaacaaataaaagaataagtcatatactaagtcttaagaatcagcatggctccagacttctcttcactggaattgttccagcaacactggaaggtagaatactagagtaatatcttcaaaattctgaagaaaaattgtttccaatctagaattctatatacagtgaaacaatcaagaaatgagtggaatgaagacaatttcagatatgcacatcccatgtttccttttctgggaagtaatttaaggatgtgctccaccaaaccaagggagtaacccaaagaaaaagacacaacatgtgggaaatgggagatccaacacaggggagagggatgaggaatccctatgaggctgagatgatgaaacttggaggattggagcagagagactcaagagatagatatgttaaagactgtcatcaccaaagtgactactgtcatattgccatctttatagccactttttgttagaagcacagacttttgaggtaaattagataaaggacagagatcccacatactgttggaaagaggactggcctaatactgttgaggcttgggttctagtcctgacttactcttgaagtaggtataagatctgggtatgtcatttttcctccctggatctcaggattatcctctctacatgtcaaggataggctaagtgaattacatgtatttttaaggctattgtgccttagtgacatgtattcttcatggcactgtatacggttatatggcttttgaaaatgcagagtcatgtaactacctccacagtcatgctacagaacagttgcatcaccccccaaaaatctctcatagctcccctttgcagtcagcctcttgcctcccccttaaccctgtcaaccactgaccttttctccctccctatagtcttaccttttctagaacgttagataaatgcagtcatacagtatgaagcctttcagatctggtttctttcatttaacacagtgcatttagttttatgcactaaccagcaattaccactgatcttgttttcagttctctcccaaagcagatgctaagacaagaattcaagtgcaagtagtttatgtgggaggtgatctcaggaagcaccagttagcggagtgagacagggaagggaaagaagccaatacaggatatgtcagcaagcaagctaccactgtgggaaacaagctcaccctgctggagactctgggatccagtgcagagcacacatctcagctctatccagcccaaggagcgaaaaagctgggatttttatctaccaactccctgtccatcagtggttgagtgctacttcttagggccttcactctccagcacttctggcttgccctgtgcacagaccaagcatgttcctgtgactagaaataaaagcccccaggcagaaagcaacagatgttcacattaagcagctttccatgtgcaggggcgaatgccaagggtgatgtgtaagacactggcagcgtcagctgcttccaacccaacccaaatatttttattgttgtatgtgaagggaagcaaatatatactataaattcttaaattcattctg

SEQ ID NO: 16167 - DNA, 17836 bp, Human
aattttaaaagtatttcagatttcagaaaaatgcaaaaatagtaaaaaaaattcccttatacctttctcctcaattccctgaatgttaacattttgccatacttaccttagcattctctttttctctatctttatatttttttctaaaaatgtgaaaggaagttgtacatatgatacccttttacacctagttacttcaagatgtgtttcctaaaaacagggacattttcttacataatcacagtacaattttctttctctctctctttctttgtttttcttttcttttttttctttctttctttctttcttttttttttttttttttttgtatttttggtagagacatggtttcaccatgtttcccaggctggtcttgaactcctgagctcaggcgatccactcgcctcagtcttccaaagtgttgggattacaggcgtgagcttccacacccggcacacagtacaactttcaaaatcaggaaatcaacactaatacaatacaatacaatacaatacaatacaatacaatacaatacaatacaatacaatacaatacaatacagtaacctatagatcttattcaacatttatccattgttccactaatatcctttttaagtccattcttttaactgttctgtggctgtggtcttggtgaaatactttccagctttttcaggaagatgtagccattcattcagcacatacaaaaagaatttgaacctcattaattttcaagaaaagtaaactgaaacctcgcttgagctgtgcatgcagacatcttcattccctgaatgaagagaacccagtgaagtctcactccgttccacaaagcctgtgttattcctattctgtgcaggtcacctgcctgctgctgcttcccgattcctcattaggctgagggaacccacatcaaaaatatcctggaagatgctttcgtctttttctcacacatcataacaaaaatactttactgtctcaatttgaaagcaagagaggatgcacagggtttgtagcatcgactatttcttactagcaggttattacacgacccacccctgagactaaggctgtgttgtaaaggagtaaagaccaaagggtaacaacctgaatgaatgctcattagaaaaggaactggttaaatacattctattgtatccattcaatgtaatacatcattcaaaagaagatgcagctgtatatgttccaaaataagtcaaacctaaattataggagtagtaaagttgtgttgactgaaagaggaattgaggaacttgagatttggaaataaagggagaagggagacttttatagtaaatccttttgtaccgtctgattttttttttaaaccatgtgtatatgttatgtattcagagagggaggaggaagagagacagagaatcatgaataggagatataatcatggataggtagatggatatgcagacaaaaagaaaagtttgagagaacagcaggtcccatattctccggctgcacttttaacttttaaagctatcactgtcttttccattttccctgaccaaccatttagttctctctcggtagcaggagtgttttcctcagctaggtcgaggagacacaaacagacctcgtcacgcacacatctcagcacacaggcatatagtctcaaacacacggttttagatttgatggtgtgtggggggagatggggagcaggctgaggcactcgaagcgggacctcccgcctcccctaccatctcagatctgcactactcccctcggccgtccattctttggcccgcctttcccccacccccgctccagaccctgcacaccaggcgactggactggcgtaaatttccgcccatttgcgtcgccgcctgggggtgctgcttcgtgacgtcagggctgagctagggggcgcccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcgggtgagtgggcgcggcgggccggtcagcaccgcggacagcgccagcctcgctcttccccgccgctcccgcagccaggctggcggatcccgggagagagggagggttgaggggaaggtttacctcttgcttcgtttcttctcctccctgggtgttttccttcagctcctcccacccgtttgacttggaaaaagctagagggcttcctagcccaaccaggggagcctcagtctttctgtatctgagttttcctctagataggaaggaagaaaacgtgccatacctgcaaggaaacctcacattttgtattcgcttctaagatgtcacactctctctgcccgtctagagagattctgttgtctgattctgtatctgtttggctttttaaagccaggcgactacagagaggcaggaatacatgtatgatgctatttagtgcctgcataatttcccttattattgttattgtcatgtaagtatgatgagataaaagtgagtcccatatatatataagatatatcccttttcttaacatgtccatatataatgtgtgtgtatgtgtgctcatgtatgtacaagtttaatataatatgttcctctattttgtatttccatctctagggacaggtaatttctaatttcacactcaaaggaattatttttttttaacctgtgaaagcctcagcagtcctgagaacatgtgctcctcattttttagttatgaatggaaaccgcagtattttgacttctgtactccaggaaaattattagagtacaaaataaccacaaaagttcctttggagtagtaaaaaaaaaaatgttttagccaatttaggaggattgaattttaagtagtagatatttgactgtttcccttttgtagggaagattgtaggattaatctttcaaactaccctgaatctcaaacaaatgatctctgaagatctgaagtgtgtgtgtgtgcatgtgtgtgtgtgtgttgaagtcgagtcacctaccggtattgagatattgagactattgagaagtaagtatactagcaccaaattaaactacaggttttcttcagctgttttaatgatttagaaaattgtccatatctgagattgagactcctacctagaattgagatactgccatccatgaatatgaagcttttattggcagcaattactagatccaaaaggtagaaacaaaatgaaagccagtcgtaattaattttattgtaagctatatacattcagaatttgctaaaattcttgtcattctcacaaattgtcaataaatgttctcaatttcattaaagaaaatcaaatgaatatttataattatttctggtcaaaatactttcagaaaagaattgctttgcttaggaggctgtagaccacaaaaacagtgacatttgtgggaatgatttaactattgtggtacaatacttacagatctcttatgtaacagaatattttaaataaaagtttatattttaatagcagctaaaatgaagacataatctttttaaaaattgagcttaatttgtatatcatataatccacgcttttaaattatatagttcagtggtttttggtatattcgcagattgtgcaactattaccactatcaaatttcagaacattttcatcaccccagaaagataccacaaacccattagcaagcacctctccattcccacctccccacagcctctggcaatgagacatgttagacttcaagtagagctggtaatttgcaaaattacagggctgggggaagcctcaagaaaccatctagctcattcacttatccttaagaacttctgaaagatatgcacaaccttctatggaagctattgtgcactctaaaaattaatataagggaagtagtaaaatgatatccatattattctaggtaaaatggtttctttatctttctttttcttttcttttcttttctttttttttttttttttttgagacagagtcttgctctgttggccaggctggagtgcggtggtgcaatctcagctcactgcaacctccatctcccgggctcaagcaattgtcttgcttcagcctcccgagtagctgggattacaggtgtgtgtcaccacgcccagctaatttttttgtatatttagtagagatgaggtttcactatgttggccaggctggtctcgaactcctgacctcaggtaatccgccagcctcggactcccaaagtgttgagattacaggcatgagccactgcacccggccgggaaaatggtttctaaattcagaagagcttatttaacttattttacagttatattttcaatccagtatcaaaccttaacagtattagatattaatacatcagaagttgctctcagatttaccagattatttgataatttttctaccatttgattgctttacttttaacacgagcagtaggttttctttttttttcgtatatacctacagagagcattagattttctgttgtgccacctgaatcttactgtatgcaaaagtaagttgaactactttaaggatgacaacatgcctttggctattaccttgttgtcacaaattttaccggaaaaatacagaagcacctagatgtctcaccaagatgtataatgtatgttcaaaagcagaccctagtttttttttccatcaaaaagagatctgaagagcctcagtcagagaaacaacggtttcataaatacaaacctaagctacaagttgtctagagtaataaaagaaaaatctttctctgcccccaaatctggtaactattaatacttcagcaataccagtagttaataaaaacatctattttacatttgtaaaaaaaaagggaaagtattagcaagaaactgcattatcaagaaggcttagtaaagctgcattttttaaaagtcatctgatttattaggggagttattctctcgcagtcatttatttgcagaagatattacagatttccagcggaaagagaaagtgctgaaatgggtgtgttctcaagtagccatttggaggatgaaagaacagttgagtatattggaccttgggtaccaaaagtgggccaactggatcttgcctgataagcatttcaggaggaacttggggtcttcatagcataactttgggcttcttgaaacagttgaagtgatcccagatcatgctttgaaaagaaaaatttggtaaagtaagtaaatgaataggtgttttatttccaggttgagccccatgatatgtaattgatagggggtggggaatgtttaaagaggcttagagcaaagcattttgcaaggaaaggtcaggttgctgcatttgaatagctttcatgtctgatgtctgagaacttgccccagctagctctactctcttctcagggacttagaagaattttctgcactagcttctcctgctcagttgcctgctacaggaatgccaggagaactgtagagatggacttacatgtaaatgctttgggctgttctaatagaaagggcttagaacaaagtcaaagtgaaaaaagaatcaaagcagctttgagacagaaaaaaaatggcactgaaaaattaaaattacctgaagcatttttgaagaagacaaagcaacttcaaacactgttttaagataggcggaatcccatgaaattttattgaaataaattaaaatttttcttttaaaatattcttataaaccaatggttaaacaccaatttgcataaaatattatggacttgatgctgtactaggagggttagatatctgccatgttctttacatggttgcaaacagtgtggagaaagagaaacacaatgttgatacggatgcataaacgagcttgttcaggcaaaggccttgcgggtgaaaaatgaggtaattaattatggaagacatccataaccatgtttttgtcaaggaagtaagttttgggaggatatatttttggaaacagagatacggagagagagccacagatctttacctatttggggtaggcagagaaggaccaaggagggcattcttgttttattagacttagtttggtttaaacttttttttttttgagacggagtctggccctgtcacccaggctggagtacagtggcacgatcatggctcactgcaacctccgcctcctgggttcaagcaattctcctgcctcagcctcccaggtagctggcgcgtgccaccacgcctggctaattttttgtagttttagtagagacagggttttgtcatgttagccaggttggtctcgatctcctgaccttgtgatccaccagccttggcctcccaaagtgctgggattacaagcatgagccaccgcacccagccctagcttaaacttttaattgaaataaaatatatagaaaatggaacagatcatgagtatacagcttaatacgcacacctgtgtaaccagcactgagattaaaaaatgggacatttctggttccccagaagtcccctccttgtctgtggtctagatttgatttataccggatctaaaatagcatttgtttccaaatatatttaagacattgccaggggaaaaacaacaactaatgtggggtgattttgtcagttggggtcacacagctttcaaaaaccaactcaagtcattttccattctttttctccttcaaagctgtcaattccatgccagtggataacaggaaccacaatgaaggaatggtaagttgcaatgtcaatcttagaatctagacttgtgtctagactctagattctcccagtccctattataccaaaccaaacacacgcatgacataatcttacaaagccaggttttcattgctgacagaatgtgagcaagggatgcccctcctgcactgagctcctatctcctgtcaggatggtttagcacccctgaggatagctgtgccattggttcagaaatgggtgtttatttcccttctccagataatcccaactcagtgccttcttgcattattctgtgtagaagtttggaagatttcattctgttcctgtaaatctgtatctccgccctaagaatactgcatcagcccaggtcacgtaatcaagtcttccttgacagcagctctgggttgagtagtctgtcatccagtgataccagcttctccaacctgctttcgggtttccccccaggtgactcgctgcatcattgaggtcctctcaaatgccttgtcgaagtccagcgctccacccatcacccctgagtgccgccaagtcctgaagacgagtaagtgtcccacacggcaggcagatcttggtcactgcagtgatccttgttcctactccctccacatcaccttctactttatctacaaatgacctgggggcataatgcactaggaagagtattgattgactaggccagtatctgggagacagaagatatgactcctagttcctgctttaccacttcgcagctgtgtgactataggaaagacagtttgcctctcttttcctcaaagtaaaatgaaggagttgaactcagtgatagtctttcagatgtctatccgttcttaaattccttagttccatactttggatttttagaaccggacttcctttgggtggagggggtttgggaaatgctggtttgtgattagatgaggaggggggttatggaagtgttggacaatgacagagggagatttaaaaatcattcttctctttgccttttgctcttctgacagtgagaatcaggaagctgagaagcaagaaacttagaaaggtgacttaaaattctggcctatttacacaacaaattagctaagatattttaatgtatagcttactagaatagaaggtgccaccaaatggtaccaggagttccaggcctgagaactggaagggtttcaggtagaggcagtgcattccagtgaggcagactaatggctttctgagtccagcctgtgaagtgttctcaatatgaaaccatttctgctgaaaataaaatttgaacagtaatataagcagtacccattggaaattgacattatgaggtcaattttacaaaactatgcagtctctgttatgcatgaagccacactgattcaaacaaatccagaaaacactgccctcttcaacactgtcctctgcttttaaacttttagtcaggctgggaacagtagattttatcttattttttcacctttaaaaatctttcaggtgggcatagtggctcacacctgtaatcccagcactttgggaggccgaggcaggtggatcacctgaggtcagcagtttgagaccagcctggccaacatggtgaaaccctgtctctactaaaaatacaaaaaaaaaaaaaaaaaattagccaggcatggtggcaggcacctgtaatcccactactcaggaggccgagacaggagaattgcttgaacttgggaggcagagactgcagtgagccaagattgcaccattgaactccagcctgggcaacaagagtaagactccatctaaaaaaaaaaaaaaaaaaaaaaactctcattgccaccagcctggccaatatggtgaaaccccatctctactaaaaatacaacaactagttgggtgtggtggcgggcgcctgtaatcccagctacttgggaggctgaggcaggagaatcgctagaacctgggaagcagaggttgcagtgaactgagatcgtggcattccactccagcctggatacagcctgggtggcagagtgaggctccatcaaaaacaaaaacaaaaacaaaaaaaacaccaaataaacacctctcgctgccagacaagactctcttgctatagctatacatgagccctcatgcatgaaatggtaaaaagcaaatagtgattggccaaaagagtaacctgaggccaggcgcagtggctcacacctgtaatcccagcactttgggaggctgaggcgggcggatcacaaggtcaggagatcaagaccatcctgtctaacacagtgaaaccccatctctactaaaaatacaaaaaattagccgggcgtggtgacacacgcctgtagtcccagctactcaggaggctgaggcaggagaatcgcttgagcccaggaggtggaggttgcagtaagccgagattgccccacggcattccagcctcagtgacagagcgagtctctgtctaaaaaaaaaaaaaaaaaaaaaaaaaaaaaaaaaaaaagagcaacctgaattaattcaatctttgggggcttcaggtaacaatggtagctgtgggggcctgagcctttagggaccctagaaacagtggatggaagctttcctaccactcccagcccacatacctctttctgagtttctttccaacttcttttttccagcagttacaggaagtgagtaagagcagagtgggtcactaggcagagagtaaaggctgctccttttggcaaacccatcttggtatctccctttccctttctttgtttactagaccaatgcaaaagtgaggggcctgtcccatcagctcactaaagaaccacagttgcttaggaaaagttgcctatgcctgcctgccaagatcttagcccttagattatggcatagtaactctagcctctgctccagccctgattatgccctgaggtcttttgatgtctgttgagagagacgtagggaaactgggaaaaatcaaatgtatctaaggatcctggagatgttatacccagagagtgacagaatgctgagatggcgaaggtttaagagctcttctgtggttgagccttaaacaccaggcagagctagacagacaaataacacaaaagagtaaggcaggacaggaagtgactcacagactggagggcacatgccttttctgagagggagcaggtaattctcagctctaaacccgttatggagaaatacagactatgttgtcaaatcttgggatttttcaaaagaagttaaaattttgatttttaaaagacatctcctggtattttcatatcgcctctgaattcagatgtactaaaactgctgtttaggtcaaacagaatttacctctgatgcaccagtttgcaacttttatcctattctagttctctctctcttgttggcatgtcgtaaactgatcagaagactggtggagcttttgcccaactggttggatgaatgcctttatacagcctctgttccaccccacgcccatctccactcccactcctacttgcatgtctcagagtcagcatatactcactgagcaaatgagtatttggggagtaggacagaatcattgttttatggatttgagagacctcagggaagacgtagtctaatttcttcacaggtacaagaatctctttgactagggttgatctggtcatccttacagcatgacagatgcatttccctgttttcgcttgaaagtaagtgtgagcttcacagcttgattttacagcttgacagtgagtgtgtgctgctatcacagcctcttccaggcccacctgcggggcttaaagctaaatttagtaggaagagctaagcctcaggcacatgctgctcaggcagtacatatttaattgggaaaaaataaaaatacttctgttcctgacacttaagactcacaaaccagtaggcagtaggaaagggaccacagtgactcggcccctggaggctgagatcttgtctgatcagctctatttcaaccaactctcagaatgacatcagtatctgtctgtcttagtcagcttgggctgctatatcaaataccatagattggatggcttaaacaactaacatttatttttcacagttacagcagtcggaagtccaagatcagagtgtcttatgagggcccacttcctggcttgtagatggctgccttctgtcactgtatcctcatctggtggagacagaaatcatctctttctcatatctcctttcttagggcactaatcccattgtaagtgctctaccttgatgacctaattacctctcagaggcccccacctccacgtgctatcacattgaggattagggcttcaacattttggaatcacacaaacatttagtcaatagcactgcccagagccaccatgcttccctgtgcccatctggctagccatgccccaatgctatacacaccaccactggcttttaagaggcaaagagactggtgacagatgggccttctctcagatgtctggaaaaggccagggacattttcattgcctcataaacatgagaatattattatcatgccagactggactttaaacagagaggtacagagagtccactatttcttggacatttttacaaaataaataatttttttccattttgcaaatatcatttcaaaataacttatcagtgccacccaatagaaatataatgtgagccacaaatataatttcaaattttatagtaaccacatttaaaaagtaaaaagagacaggtggaaattaatttcaataatatattttatttttatccaatttttttctgatatataattttataaatctgatctatttgaaatatatattatccaatacatccaaaatattatttcaacatataatgatataaaaattgttgagattattttacattattctttattctcagaagtctgatgtgtatcttacatatatagcatgtcccagatcggaccagccacatttcaagtgctcaacagcacttgggcttatggtgcctgcagtgtagacccagagctgtcagtggccttggcttcaggcattttatctgaactctgtgacataggttgaaatccaagccctcccagctaacaactgagacaatgctaactgcctatctcctttcatggggtgcccttgagttaaggaggacttagtaaaggagctattgatatttggaaaagatggacgagaacagcattcaattaaaatatcagttataccatgtactctgactctggaaacacaaagataactcactgtgctgaagtctgtccccaacatctgagaacatgttgggtggatggaacctgagtgaagaaagaaatggccctttccactgatgtgcagttttctcaggcaagaaatgtacacccttatcaccagctactaagttatatatcacatactgctaggttgagcctacagttgattggataataaaagtctgatataaactaataatttcaaatgtttaaatcctcctttgaatcttgatatttcttattttggctagttaactatctagctggattattgttagagccattcacatagtgctaactttttaactcctacttgaagaaaatatggaaagaatggtcttggattataccatgctgagtctcaatgtctgcaaaaagaagaggttggactggattagatgaattctaagatgtttcctgcctctaaattctaatatttcataaatctatatctcgatttcagtttgatcattggtagtaccaatgagagaagctggctgggcattatgaagacataaaaatatagacagtttattaccagatttaaacacagtcaaggagctttcatagcatttactttcaaaaggaatctgagtatattcttcattaacttaaataattatccaagcaattttcagtgtcatcaggatttgtagtgattactgaggctggtgcttgtggaaccacaagcaattctgaaattatacctactcttcattttcattataggtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgaggtatggtctagggcttctgtttaaaagtacttactctggtcaatgttagcacattatgttcaagactatccgatattcacggggagaaattggtgggaattaatcactatgaaaatggtgctctagtaatggagtggaggccaccttgggggtcggtttccacctacctctagccatcgtccacatccttgtccacctcactcggttgcattgcttctcaaccttgtctgcacactggggtcacctggagagcgtgaaaaattactgtgttagagattctgtctacttagttcctagggtgctgcctgatcatcagaatattttaaagcttccagatgattgcagcgttcagccaacgttaacaactgctgttctggtatcttccccttggtcctcttattgttcatcactctctccctgaggcagggagaataggtgatagagaagtttacttgcttgcctatttagtttgctatctttattatttcatgccctactgccatcagaaatttgtatctgggagaggtaacactactggagctgaacctacccaaacaatgttttttttcctaatattgattatgtaggttggtgcttctcaaagttgaatgtacattaggatcatgagggattcctagcccccagagttcctcatttagtaggtcccaagtgagaccccaatatctgcatttctgacaagttcctggctgatgccactggtcaggggaccacactttgagagttactgaggtaggttgactaatgcagcttctaacatgcctaaaattcccctttgcactcatgctccatcaaactacagcaaaagaaattggttcgggacctcatgcctccacttttctgtattttccagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatatacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaagcttcattgttctcagcttcttttgggcaaagagagaggtgtgtgacttttcaaatctattctttgaagtaaattgcaaaagatggccctaggatttgttgggttttggatgcataatagaataaaaaagcaaaccttttgaagtaatgtgcaggatataaagagaaatagattagaaaaagacatctactcccccatgctgagagagattacaggggcttgaagaacctgtttcaaaaacaatcataagatattactttaaaaattcctttatctaaagagctctacaagtagccagccaaagttcatttttcagggctgagaagaaagcttggataatgggaagaattccggggtgggagtgaaaacatctggattgtcaagacagatccctggcccctcagatcttgtctgatttctactccttaagaagatagaggcagctgggtgcggtggcttacagttgtaatcctagcactttgggaggcccaggcagacagatcacgaggtcaggagtttgagaccagcctggccaacatggtgaaaccccatctctaataaagatacaaaaaaaaaaagctgggcatggtggcgggcacctgtaatcccagctacttgggttgcagtgagcgcagatcaggcattgcactccagcctgggtggcagggcgagactctctcagaaaaaaaaaaaaaaaaaaaaaaaaaatatatatatatatatatatatatatatatatacatatatatatatatatatatagagagagagagagagagagagagagagagaggctaggcatggtggctcacacttgtaatctcagcactttgggaggccaaggcaggtggtttgcttgagctcaggagtttgagaccagcctgggcaacatggcgaaaccccgtctctacaaaaaatttaaaaattagccaggcatggtgttgtgcgcctatagtccctccctactcaggaggccgaggcgggaggatcacttgagccctggaagttgaggctgcattgagccgagatcgtgccactgcactccagcctaggtgacagagtaaggtcctgtctcaaaaagaaaaaaaaaggtagagcttttactctgctgactctgttactaagtagctctgactttgggcaagttacttttcctctctgaacctcaagatcatcaatgaaataagatatttgtctcattgagttgttacaaggatgatagagttgatgcaaaacagagcagtgcctggtgtatatcaacggcataggaagtgttagctgctgccgtaatcattcttgcagcttcttaggacaatacagttggacaattccccttctccctttttttacctgtcatttaattcctcacccttggtggcttctacttggttgatttctactgttttcacagttttggtaaagagttattctctggaaggtggtgcagaagagagtaagaccttctctttactctctgaaggttggataattaagtctatggaataaactgaccgtaggcagattaacaggagaaaaaaacattttaattacatgcataggcccaggagtcccacacaatagaagactcagaagggccagatgattgaagtttttatagcatcctgagctacagaagagaatagggggcttggggttcctgggggacacagttatgggaaggtagcaggaggaattgtatgataaataaaggttgtgttgttatgcagataaaatctctcaggtaatcaaagtgatccagcagccttcttttttttttttttttaaaagcttaatgaaattttattttgaaaatatggcaaaagtctaaggcacttcaaatatttaaatacatgtaggaccaaagtaaatgtgacacagtataaaggaatccataaatacagagaactacactatatttctctagaggcaaatacatagccaattcctctaacacaattcaacctttatcattagatacagaattgtgcaattatta

SEQ ID NO: 16168 - DNA, 40265 bp, Human
ggatggtctcaatctcttgacctcgtgatccacccgcctcggcctcccagagtgctgggattgcaggcgtgacccacagctcgcggcccattttacttttaaaccgttatttagcacccaaactcagggatacttgggagtagaaattagaacgggacagataagtggggagactggtgttgatggaaacctcagtgagaaaagtgtagatgggattacagttgacaactggttgccttgatttaggataattggggaaagggaggctggggcacattgaaacacccaggttgtcgctgcctaccccagctgctaacatgaccagctgtaaacttgctctgttcttagaaacctcccttccaaaacatggattctcccgccagtgctcaagatgggacacattaccactaagtaagcacttttcttaggagcatttcttaggctgttaaaatgccaagactcctaaccatccttggtagctttgaacctatgtaaagaggtcagttagctgccctagtttattcctcagaatgatgagatttggcactgaaaatattgttcatactgagcctcccatcaaatgcaataagtagataaccacaaatacccacccttttatgctcataactcagcatgttggaaactattttcccttgacctattgccagcccatcacgccccacacccaggagaactcaagccccaaaccggccgctgaatagtcacgcttttctgcaggacatacctactattagggccaaaactttgtccacccttcaaaggaagtcgatgtttccatataaaggtcccctcaaatgcaacagcaagcccgtgggagaggggttagcagaggctacggccagcccacgggctttcttcgaccttgattatgaccaggagtgtagctgttaattgcgaggcttgcctcaaggtggaaaacagtatcggtttccactgccaccccagagaaggcaagttccgcggctggcggtgctggggacacggtccctcccaggcccatctcttgccacccagagagctgctcggaggccgcctacaggtgcaatcccggcactgcggccggggcgtcgggccggggagggcgtccaagcccaccagcatctccgccggcccttcccaaagcctgaacagggccccggcgtgcccgccgccttctacccccggtttccccgcgcctctgccccggcgcggtttggataggaagctgggagccctcccaggctccgcagactcggatttgggagggggtgggacgcggccgaggcttcccctcgaatctgcggcaagcctggctccaggaaagtttttcaaagttcccagcagcgtctgcccaggtcgcctccgcggggcgagcagacggcggcaagcgcgccagcctcgccgccgcctctgccgccagcagagcgctctgggcggctcgctcgcgggaagcgggccgaactcccggcgggcaggcaggccctcctcccggggcgaaagccgcagctgacgcaggcggttcggaaggcggaagctgccccgctccgaccgctcagtcagcgccgcggcgcctacacctggggccccgacgcgcgggcaaaggcgcacggcccggggcgcccgagggggcggtccccgctgggggcctccaggcgtccctgagcaacgatcccttccaagtacctccccgcactctcccttccctcctggcccgaagctcccgagggcgggggttggtgtggggccctggttcttctacgccgccctgagcatcccgctgcccccaaccccttccaagttcctcctcgcactaccccctccccagcaacgtgaaggggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtaggagcccttctccgggcctccctcccagccgtcctctccctcccctcgcggcgccctgggcggttgagccccgcgagcaggctcggcagccctcgagcgcccgactcctcgcccctgcgcccgagcggctgcacctgggctgagcgcgccaactcccccacgggagcccctgcctcctgagggtgacccctccaggccggacaggggcgcgttcgctccgctgttgccccccgggaagtcgtcggatttcttccgcactcgtgcatttttttttttttttgccccggaatcatgttgagtccttgaacgtagtttcgcaaaattattttcactcggcgaggagggctcgtcggggcggggagtgggagggagtcgccacctctatactcgaagaaaacagctttctcccgcgctgacctacctccttccctcgccggcaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccggtgagtgactactcgggaaggaggccgggcggagcctcacacccgcgcctggccgagccctgttatcccttgcgagagggatttaaagggctttggcttgaaactaggcgctaactggggaaatctctaggggtggcgggtgagggagccgggacactatagttagatctcggctggggtagtcgaggtgggtcccattcctgctgctatttgcttagtgcacaaaagtggggatcccagagggtttatgggaccaggctcctaggaaggccggtgtaaacttgcaacttgaagttcccagagtaactctcccggccccaagccaagagatcgttgtagctgatctctttgcttaactaattaaacctggtgcgccgtggaaggcgactcggcgcagttctggcctgcgaacgccgtccaaattggcaacctcccctttcccgtgaacggccgggagggcgggtgtgtccttcctggagggtgtgggggagtccgtttcccgctgctccccgggagattttagtgtgtgcgggggcgctctccaggttcggcttaagggccgggggcggccgccgcaggaggaggttcttggggccctcacaggagctgtagacctgggaacccccgcccgctgctggccccttcctgcccccgcccccgagtggtgtagctcttgtggcctcacttccagcggttcccgggctctggaacagctgtgtttgcagacttccccgggaagggcgggtgcacggcccccgcaagccttcgggggccgtgccaaggcttggaaggggtggtcttctggaggtagtgcctgagggtgtaagtgataggccctcatccccccgccccattccgcccccaaaggagctcgaggcccgggcccagctggcagatcctgcagcgaggcccttgcaacatcccaaaatgggtggaaggaagatgggtgcgattgcagaaggggaggaaagggaaatgttgggggtgtgccctctgcctggctcctgctgtccaggaggcatgactcattgccaagactggggcttggcctagcctgtgctgggagggtgggtggtgagagggggagctcggtgccccagagcattgctttccaccacgtgctctaatggggtgcactctgctgcctcctgtccgccggcttaggttgtgattctgggaggagacagaggggagactatctggctgtgtctgtgtatgaagcttggggtggctcttaaaatccacgattacaggagctggcattataaagtgccctctgctgtgggtgagataagacagttatcaaaaactgccatgaaaaggggtttataaaaagaaaaattaaaaccaacgctgtctgtgaagctctcttgaggtccaagggctgtttctgttgtgggatttcatttttaccaagagtatttatcttgtttgttaatcccctattagggagaactttaagctaaagagtctggctgcgtttaaatctggctggcccaagctgactgtgaatactcaaactgcccttgaacgtgtgtttggagtttagggggaaggggcctgcaggtggttccaccctcctgccggaggatctgtctggagcccctcgcttttcacaagaccataaaaggaatcttattagtgatgtggaaaagcagcagcctggctgaggctcattttggagagtagggtcagagggatggctaacatgaaaacaaggaggcttgctccctcgctggccaaggaaaagtgacctagaaaagtgcgtctgtccgcttttgacacttggtcagagtcctcaatggaaaacgagcggaaatagtgtgggagggtaggagaggcgattgatttgcatttgctggtgctcttctgtggtttcaggccccacgggtcaccaaccatgaaatagactctcggcttttctcgaatgggggaagaccgatggggcaccactgaaaatgtggttcttttgaagttgggacaaacgcatgtatcactcataaacaagtctccaccctgatgccccagaaaggcctgctgtgaaacataagatttaattctcaagagaaattggagtttaggtgtatttgtttttctgtatgtggttggagaaacggcacagtccgtaactttcaagaatgattccaggctgagtagaaacgtaactgaaacacttaagtagctgagcgagtatttaactagagggcacagcttcatttagtttggcaattaactatgtcttttaaaactgatttccttgaatgggaaataaatgaacttagtacagaattcaagagatagcaagaaaaggatatatggttaaaaacaaaacaaaactccaaaccaccttgggctcccaacccctagcaggcacaattaccatttgcatgagtcctcccaaatttgctgacgctgggtatcagcaaagggtgcaggggtaggtcagtgtagaaggtcatgtagttcatgctttttgtttggaattatgacccctatccaagcaactgttcatgttctagagaggacgaggaggaaacgatttggtcagatatgaaatacagtccatgttctggtgtgcatgtgaaaggctttgtagaggtggcccttcctgtcatatatcatatctgagtatgtcccacgtggtgtcccctgccccggctctggtcttggggtagtttttcaccactggcttctaattctcatactgttgctgctctaaggggcttaacttgcagcaactatctggattaatgattctcaaattgggggaccaagtgataagaaccattattgtgggaagtaattgggcttaacaggaaataatttaggaattaccacttataaatcactgaaacggttaatctgtacctcccaaaattagtgctaaatcccagtagtgcctgcttattaaaaatacattagtgtaattaccactactcatctccaaaagctttttgggaacttcagaaccccagttagctgtattgctgcatcggtggccccagagtgaaatgaatctagagaaacgttaggggaagaaattggggtatctggcttattagcctcatatttaaattccattgatcctattaaaagacttgctgagatcaactttttttttttttttttttttttttttttttttttttttggaaaatccaatgaaacgtgattcttctgtgtgagggatgccagctttggcccccttcatgcttcaggcctgaatgaccaattgccacgatgctaatcacagaatgtaattgacaggcccttacttttatgccttttgctgtcttttccagtccctgagcttctgtagatatggtgtgggcacatggagggcttaaggatggggttctgatttgacctgcctcctttctgcagccaggatttgcatcctgcccgtgtagtcagcatgtatacaaagaaagagcatgtgtgtacgtatgtgctcagagcaagggactttctgcatgtggagaaaacgccttttgccctaagaagtctacctcaaaccaaagggatgaagtgatgtatctgtgttgcaacactgggcttgggggaaagtgaagctgtgcttgctttgaaagagctgtgctaagtatctgcagaatagctgctccaaaaatggaatctttattccaggtacttggtttctaatttttttttctcttgcaggtgtaaccttctgtgttttctttctccttgttgtcttgtttcttagcaacttattcaaacctccagtacttataggaatttgcaacccaccagttccacacccgtaattctacagggacttaagatgtttttagaaaacggtgaaactttggcgtggaggctcttgggggagttcagtgggttaaaaggagagtcagcagcaacttacaggcatgcaacctcccagaaaatcagcaatctaagtgctgctcaaaatcttcacaccaaatagtggtgcctttggggaccttttagatagaagacgtggaaagtttagcatggagaaaaaagttacttaaaaaaaaaaaaacagtgtcaaggtaacaaggagccttcacagttcctgatctgaaaacaggaatgtgaaccagaggccttggctggattcatatcacccactggccccattgtagaagggccagaagttggtcccaatgtccggctttcaaggttagtgacaatgtaagaatgcatgatctctggatgtgcatacaattagcgttgtaatccataaatgcaaatactcctgcaaattcttccatggtaaacttctgtaaggcatgttgctcttccacctacccccatccttcaagcctaggatctaggctgctgagagaagtgactcttggcttcagcttttaaatatatatatatctctcaaaacttaatcttttcttccaactgttggaagatacattgggatgaatggaaagtggtgattctaaaatggtggtggaaatggaggagggtcctgggttcagaaaaatcccacctttactttggtgcatggcactgggtggctgtgttgtgacttctttgctgatttctgattaccgcatggaccacagcagccctgtgactgctgttttttttttttttttttttttttatggtgccagtgacatctaccattggtgcagtgcgtgtgctgggaagaaattccgcaaggtggctcccagtagttaaaggagtacataaatagtcaaacatgcagagtcctctaccagctcaacccagtttttatgcacttttggtaaataaacagaaaggcttcttgttcaggcttgctctgtgtgaaccagaccgttgtgcttggctggcttcttggtattctatctattaacctcgccacccttttgtaactggtgcatttaattatcagtgggatgcttttcaaacaggtaagggtaatgatgggaaagggggtggggatgtctcattgagagtcacaaatctggatatgagctttggggccccttggtgagcctttgagtgggctttgatgagaaaatcaccctttgtaaccagatcggactctattgacatgtcaagccctacagacttgattgctttctgtgcctgaagtcttagcctagatgctataggatagttgtcctttcttatctcactttcccaaaacccactcgcattgtgtgcatgagtacgtgtgcatgcgccacacatggactccctgcaaccttttctgcttaatatgttttgtgactggaatattttatactctggccacccagacacaggcaggacaatagagttggccgaattgactgaaatgaggattatggagaataatagggcctctccaaaaataatgctaacacaggacaagcgacaggaagcaacagttgagtcagcagagctcagggcccctgacgaaccccgggagccgactgactgtgcacaatggccgcgttggcacgtcgggcattcccaggatgtgcgtgccgccggcgggcctgcctgtcgcagcagcctggggttttggacgccgcacgcgtgccgtttggatggcggtttatttgtgtccgtcagcttggcaggaggggaggcagccgcttctcagggcttggtttggctgtcactgttgccaggaaaaggaagctcccggctgccaacacaattacctttgtttcttacatccccccttcttaatgtggcaattaagtgcttaccgctctgcccagtgccaaggtaaccgccatggagtgggacagggcagagaacacaaccttggcacagcagcctaagtgtggagggcgggaggaggtgcaggggccccagccttgctgggaacctggtggcccttggatgccttggggctttgatgccaggactctcctctaggtagaattccacagaaatcttccaaaaagcaattccgaaggctgaccattcctctttgatgccacaccagaatgggaaccagctgccaggtttccagatttccttgggcttggagctgggaaggggctgaagtgactcactttgcaaatccagactaaagatctgtttgctacccctccttcctgtgtggccttcacagtactgttctggaaaacataaggaaagatgaaagccaggtgactcttcggcagagtcttagttctgtagtctgaaatcaagaaaaacccaggtatttgcttttgttgttgttgttttgctgtataaacttaagtttgaacacttgcctttccaagccctcctgggatggaggactccgcctctactgggggtcagagttgcagtggctgcttgtatgtgacttcggcatagtggatttgctgctctgtggcctggtccctgctttgatgtggggtgcatgatctgggatctcagtgcctgggtgtatgttcagggatgtacagaggtcaagtgtgggcctgggaaaaattaaagttctctagcaactaataatcattgttaaattatcttgattgctgatctatagtgtggggatggagtgggaggttgagtgcctcctaataggaaccttggagggaatcctttttctctgtagggctgggcaggaggaatcctcctgccccaggagaccctaatcccctccctgaaacagacaggaaaaaaagtccaggctttgttgccgtcactgtagctccctgccctcaccctgtctctgcctctgagaaagaagggcagttcctggaaaatcacagagccaggcacgtagggctgtgtgcaattcttttctctccaggtggggtgatgtcggtcagcaacttctgaggttttcccagttctggcgaggatgagcctggtagactgcttggtcgtccaagttcttgtgcaagacctaaggatgctttcctctttgagtattaaactgagttagtactgccatgccagctcagtcccggcaccttcccttgcagtggggtttgtgggtattatgtgtttagcgcttgtgcaagtctgtcaaaactcctggtatcaatgcatttaatcagaggattaattacaacaatactgttgaagtggaggacgtgggcctcaacgtgaccagcaaatgaagggcttaattatacagaatcagccacacatctggcctcattttgactgtgctcttacctcaaatcagtagagaaatataatttcttgctgctcttagggaagagtcctgtaatttgcaggaagtcctaagaaacttaaagaggcagtaaataaggtataactttcgctaataaaatagtaacaacagcaatgaatttggacctgtggccactaacaggagagggctgggtatgtgccctggcttgcccggttttgcttgcttttctgagcattttcccacagttatcagtgaacgaaatggaatcctactctgctttgagtatgaaacatatttcggctgaattccaaggcagggtctatcacaagatatttttatattcagagatgacctgctgtgtcactctgagagcgctaagctggccttgagttatgaatgaaactcccttttaccctccctttttctctttttcctttatcttataggtgctttctcttctcttggcagcagtgtgcttctggtggcacagcacggtattatttaatctatacacgcttctatttcctatggcttggtttctgacacagcaaagcagggattcataacctagttcatgttccttgtctaccccacctgccttgagtacatttcttcagtgccaagatagcagaagcttcatttaaacgctggtgttttgtgagactgaccttactgtaaattacgaaggaaaattttagaaaaggagggaatttgctaatagcttaggtttggctgggggtggggaggtggaattctgagataagcttggaagataaaaggtgccttcagtttaacagctggcatcttgccagtatccagggaatttgtttagttagtagactctgattattcttggaatgttagatcttattaacagataagttcatcaataaatataacccatgggtgtgcggttgtttctccctttgtactttcttccctgggatctgcccccaactccaccgcccaagtgaggttgacttctttgtcttgcagagtcactttgcatctaccccctcctgtttcctagagttacccgatacttgtgggagccaggatggtctcacatagacagagttttcaaaggggttctaaaaaggaaaagggggcctccctagagactgcctcaccagggcccaaagtgtaaccttagcaataccccctcggtacaaatacctggttaggttagcttagaataaattctttgtgtgtgtgtgtgtgtgtgtgtgtgtgtgtgtgtgtgtgtttcctcatgcactagggtcagggtctggaaagttttgggaaactatatgctaaatactctcatatcatatagtgaggtggcatttcctgatctcaactttgagctgcctgcatgcatgttgactccagtgcgtccctgccaggtgaaaggagtcatttgtcaacctgggaagagtgctgacaaaggaaggggagttggtttggatttaaacatccaggaactcaatgcaacaaccaacagaatttttattttggcattatggttttgtttggtggggtattctgggaggccaagaatgtacgagattttggaaagtcgaccctgtttctgaattgctaaattgtttgtttgtcttgcagaggtcctatacgttgcttgtggaggcgtgggattccagtaatgacaccgttcgtaagtatcgcttctgtggacttttctctaaacacacgtggaagtgtggggcttggccaaccagttggagctggatctgtctccttagtacttagcatttctgccacctcttgccttctgttctcccctgtaccccagggtgaaccttcagtggaatgtattccttaacttttctaggatttttgcttggaatattaagtggccagaacagaatcccagttaactcattccctgattatgaaacctagattatcttcgggatagagatcttaatggttttacaactttaaaaccttgtagtctgctaaaggatcaaagtagtgactttttaaaagtccatttaaactttaagtgagtgtttaatctctcatcagaaagataaagccataaaggtggtgctgggctctagagaccgaccttgaatttcacttggtgggcaggtgagcttctagtctctccgggtttcccacactgctccacaaacctttcattgaagcgcaattccagagcttcacagccattacctgccttgtccctttctgaaagatggctctgttttcagtgcaggttgcctttcaggactgaggggttggttttggtggataagccatggaggatgtgattgaaatgacatagtctggcttacaaagtagtcttgctctttaattgtaactttacagtgttttcgctcacgagccgaaacttcaagttccctttttgccagcagagtttgggttgcggtcgctggaaaacttgatgcgcactgaaatctcttggtctgtgcatgaggaagagtggatccagcttcttgtcttggctctctgttctctgaatgccttgtactttttgcttttctatcttaccattttttttttgtttgctttcactgtgaataatatattttcatctttccttgccttgctttttttgctgacagaaaatggtgaatgcacaccgtgggtgcagtgagggcttggtgcctgctacgtgggcagcttccacctgtggctggcttattgggctacttggagccacagaatcattgctgagctccgatgtgccagagagtcccaggccatttgggtcactcttctagcttgggaatcttaagtccagctttttggatgtcatcctccctggagggggagctcatgaaagtccaaggttcgagtcttcctccccagagggctaccctgtaatgccgtgggggggtgtgtgtgggggtggcagggaagctctgtcagccttggctatggctgatgccagtcagggtcatagacacctgtttgttctcccctccctgccacaaacgttgaggactgtgaacattatgtcactgtgacctgcttacaatggtaactaagcgttaggcagaaggggttgaggaggggggagacataggctcttctgtaatagtatggtgtcgacatggtgttctttcccctcccttttagctattgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgaggtaggaataaagttcttttaaacctcaagggtgcccattgcaggttatcaaaactcacttggtgaaccctgaagagggagatgggtttggtggaaatggtttctccacttgcctatttggcctcttttatgatgcttccaaggaatcttgaattcagcacagtcaaaaccaaactcaggatcttctcttgccaaaagcagtcccttcccagggccccttctgggtgtctggcaccgatatttgaacactcattgccataagccagaaatatagaaggcgatctgtgtaccccctctctgttagcatccatacctagtccacctccaagttctgaaaaatctctccagctcttcacttgaatctgcctgccttctgccactgccctggtccaagtcaccatctgctcatgactgaacttagagtagccttcgtctggtccacctttatctgctctgactcacctctagtgctttctccattcttctgccatcctggtcttttcagagccataacatttgcttgtcacccttattatgaaaaaccaaccacttggtggccttctgttgctcttgggacagatcttcatgtggcccacaaggctctgtgcagcccagctttgtctccctgccagccttgtcttacacaccgtgttgtccatcgtatctgtagcctggccataccctagcagttgccttcctatcctcaactacatcacatgctttctggcctcaggacctttgcacatgctgtttatgctacttggagtgttttgttcctttcttcaccctcagccactccctctggactgcactccacagggcagaagctgaggatgttcagaagcccaaacggagttggctgccctgtgggacccaagcgagttgtaaacattctggcttcagatgtaaatcaaaggcagagccctgagttttagggcagagaattccttctatcagctctgcagtgagccctcacaggcagactcgggcccaaatatagcctaggtgctgtttatgtatttgaaagtatttaaggctggtccttctgtcatcggtcctccaaagtcttttattacattttgggactgtggtatatagagttccaaatttctttctcccctagagcaaatggtttcagtttactgtaatgcataataaacatgtaaacataaataggcacacttcagaccaggttttccctgtagcttagctttctcggctaaggcccccttccaggtttttgggtcggtgtggtcccaggttatgctcagactcgcccttcatcacctcctccttggcctgcgaggcggtcatggcttcttcgtgactcatcttcgtggcactggggattgcagggaggcatggtgatgtccttttccagtcacaaggctggactgccaaacgaactgccacagattcctttccagtgccccaagctgaaggaaagcgtgatcaggaagcaggcagcagacgtatttgaacccagacatgctcgaccccctccctgagcaggtgtgaaattatgtatgcagctccatagctccactgaggattctgaagtgatcctctgcacgacacttcccggaaataagtggaaagcttactgcatgactgaaaagtacatatcagtcctgcacccctaggattgccctggactcttgtctaaactgtttgttgttgataccagcctcagaagctggatgcctttaagccatggctagtgtgtttaaccgatcccttttatgaagatcttgtaagcgcgtggtaatagcccactatgctttttaactgaaccagcagagcaaacatagttaatggagagacatttttgtcattccttggcctctgtttatttgcaaaaacgagtaaagtgttacctgcctgcaagtggttcagtgcgtgccggggtgtcaggctgcaggtatgtgagcttgttcaaggcttgtcttgcccacgcagcagtttgagagccctagagggcgaacgctggggccctgttggaagcggtgtgtggatgaagccacccaggagtcccttctctcctggtcacttatagggcttgcatcactttttaaaggagcactggcccgaggcctagaaaaacagccatgtgggtgggtaagaatcacaaagacattgcaagtcagtcctaactgtctctccaagatggtcttgaatttgacaaggtgatgaagagttggtgctggcaggtttaagaaaacaaacacaaaaccaggttggggtgctgatttagtgccttgctgccttttcagatccctcccctgaactgctggcacctgatgtttgagctatttttgtacctgtctcttctcaaactagatgataagtggcctcagggcagggactacatactcctgagagctgcttgagctcgaggtgtttattatcctcagtaagcattttttttcaggagcatgacttggctcaaaaaaacaaaaagaaaaaagaaaccctcccctcaatttacctgtgtctaaactttggtgaattattctcccatctgccttctgggcagaggagaaaggtggaatgcatcaagttcaaggtcttggtatttaagagctggctttaaaggttgccatgttaacaattgtaaaaaaaaaaaaaaaaaaaaaaaaaaaagtaactcaatcgtctccttggcttccagttaagagttttgaaatggacaaaaagcttttctgagcaagacataaaaccctaaaaccagaaatgattgctgacctttatctggaataatgaaatttcttcaagagcaacattccatagggagctactgtctctcatatgtaaagagcacttgcaagtcagtatggcaatgtaatagaaaagttggcagagaagagaagctgttgctgttcacaggaacaaatataaatggttttgtaactaccagaaagggctcttgccatcacttagttaaatgctaattaaatgagatacctctttacctatcaggcatagattagaaggtttgataatgtacaacgttggcagtgttattgggaaacacagcttcctgggtggtgggaggacagactggtagtttgagactgtggacagaggttgatttgttgtgcacggactctgattcagcacttccatttctagagtatctcattgtgggaaccatacacaggcagatacgttcaaggaatgctcactgtggctttgtttaatagtaagaagcccaaacgactcacatgcacacatgtcagggactaggtaaattatttattggtgtttccagacaatgaaatactgtgtacccattaaagaaggtaaacaagtggtaacaggttgtctctgggtaggggcataaacttttcatttctttgccttttttacaacagatagaattttgtagcaggtgcatatgtttttattttaaaaagccaaaatggtcagggaagaaggctgcaatgtgaatattaacatgattcatcactttgtctctagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagaggtatgtgtgtgtgtgtgcatgtgcacgtgtgcctgttgcttttagtgtccatttatcaccccaccagcaggcaggtggcatgcggctatctcaggtggggtgggattttggctgttattctgggcctgcagtatgaagatgcggagtgtagaagatgctgttggtgccccatccagatcccctttactggcatccccatcccccaggtgctgtgttggctgccaacagctcacagctgctccttctcaggagactcgtccttggccaaaccagtgcatgccccattcctccagctcacagtcagtgattgacagacatagggctacaaagcccagcttcctttgccttaaaacagtagtacaatttgcactctagagcttaccctgggattaggctgaaatcagactccagttgagaccatgttcttgctcagctctttcccctaccccatctgcttccctcaattccttctacctatgtccagatccccttctcagactctgcttctaaggaacttgacccaaaatagatccagacaggactaggtcagcccagttgttgtctgaacaggctatcctataggaaatgatagcccctgcattcagggtagccttgcagcaagttttcactaggtgtctttgggggcatggctttgatggggagaggtatgtggttagctcaagctttcctattggtgtaggagtgggcccacttttagtctctgtgctgtctactgtcccagtccctttatagaattcagtgattccaattcatagcaacttgatgggtaattctgttaactgtataatatcccctcatgagcaataatgtactctgcttattttacatgataattaggtaaattgttttgatagactcaatttcaaagtgagtttttcaaccatgagagaggggtgggtcatgggggaaggaatttacagctctcccgggtagtactactgctttcttaaataattggagagaagagtttaaaaaggatggcatttctggaattcaaatgaaaaggggaattcattaacatattttagtgtgttttaaaaattaaacgacctaacacttagtgtgggttttttgtttggtgttttttttttttttttttaagataaggtgctcactttgtcacccatgatggcacaatcatggctcactggagccttgaactcctgggttcaagtgatcctcctgcctcagcctcccaagtagctgggactataggcacatgccaccacacccagcttttttattttgtgtagacatagtcttgctatgttgttgaggctggtctcgaactcctggcctcaagctatccttctgcctcaatctcccaaagtgttgggattataggcatgggccactgttgcctggtcttagaaactgacattttttagaagttacttttttcttttttttaaacgaagtagagaattgctctgcaaggatactttataaaagtctcaccagatctggccaccagattagcctgcccaatgagtccagcctggctggctctgttagtcccatggaattttcaaaccaggcatttggtatgggttgtttttttttttttttttttttttaaaggctgaggctcatctgaatgtgtcctggtgggatggggaaggattatctatacctttttttcttctaatgaaaagggtgtgggcagaatggaaactgaccaagctctgctcaaggagccagggtagctgtggtttagagaggctggacgaaggtcccccttccctcgtcaacttgtctgcattttgtccccaaacaatatcatgttttcagaatctgctaacaaggccttgaagtttaaagctggttttgttatttgggcccctcccatcttcctctccttacaagggacttgatatgagacctgttaaaatcgtggaatttgcagactttaatgcaatgggccattctcatgaccggggcgatgcaaggaacaggcagtgtgctgacacgcccttctctgttttttacagctatttgccgacaaggctgcagtcctaagcatgggtcttgcaaactcccaggtgactgcaggtaaatcaactggtcttttgtgagatttcttttaattttcctttatgtaagagaggaactgactttattgtgactatgcctcttttttccttggagaacaagaaagcttttttaaaaaaaaaattcagatagacacatccgaagcttattaaattataccagctgtctggtggaatgcacacaccacttctctcttggaataaaaagaaactctttgggcatagccagtgacttcatgtattaactgttctgtaaattgataacacatttttataatcttcccttatagtgctgatgggctagatggagggatgtgggcttgtttctttgcgtctctctcctcttccaccaaggctttcttctcccagccccctccccgacttttcccatcaataggcgaaagtccagcattctttagaatgggattagtccaatctcctggcccctttgcaggcgggagctgggttggtgctgagaggttaatggctgccctggaatcttgtcagttgagcctgatgaatgtagacttttgctgcagtcctttgaagtctgttcctttatggtccaggaacaatgcggaagccaaagggaggcctgccctgaccacttcacgatggcgggttttggaacttcttgaaatttatattacgcccgtttggaaaaggcttattttgggaaatattgttggtgtctgtggtgtttttggcagtcttaatgctttgctctccctcctcccaaattttaaggagtaacgctaaatggatcctttgagcctgtcacttttgcccccaaagctactctgacatgagtaaagggaatcttatgaaacatagtctaaaccagtatgtcccaaactaatgttatttggggctcttattaaaacgcaggtcctgattctataggtctgggctgagcccaggtttctgcatttctaacaagctcccaagcgatgctgctgatggaaccatcagcaatcactgcccccagacctcagtactcaaagtgtaacttccagaattaacaagggagctgttaaaatgcaggttcgtgggctccgtcccacatccatagaatcctagtccttggtttggcccaggagtctgcatttgacaagctggccacatgactttgctgcttagtaaattttgaggctactcctttaaagagaactatctgtggcctttacctttatgattccaccgctccgtctgttcccctcccatgcaagggggaacatggaactaaattaagaactggttgtcccgaattgtctcttcctacacttcagaaagatagtttatttcctggaaggctgaggggcttctcctgctgtctcccattggtggcgatggactgtagtatttaacagcattgctgtccaatgcggagcaggaatccacctaccttaactcttcctaattaagggtgttctggagaaagtcccaatggcagtgctattagtgattccaagcctgctgcctgctcagatggatatcagcggaggccgactgtgatttgtgctgctgtcatcagaacacacatacagctatacaggggagggccctcccagccagaacaacaggctttgtttccagaatttagccctttctctttcgaagtcccacctccctctccctgcccagacacgcactgatggccttatttacttaaggtgcgactttcccacacatcatttgcatagtctcccagcccagttttccctccctaccttgaaagaaagtcaaaacagaaccttcacgctgaggaagttcaggttgtgtcctgctgcagaaatagttgaatggcaagttacctgcaagttgtcttttggattatgtattacacaggttattttttttttcacccccacatgagaaaatttactggtttttgttgttcccaagtagactgagtccctttccctgggtatacatgcttgcttattgcaagcctgccaataatatcaaacttaattatgaatcatcatctgaggaaagtcacttcaatttctcatgagaatcttaatcatatattattaaactgggataacttggttggtgcctcttttagggtcagtatttttatttgttttcttttgaagtcatccatggcctcttgtggttgcttttttatgcttggggattgaggtctctttaattaggtgaggttgggtcctcagctgcctctccttgcctttatgaggcaacttgaagagggctagtgatcctgaatttggaagagaataagggaagacggtgagaatattgccatttcgtaatcagttccctcttactatctttcaggctaagaatatcagccttgacagaatggctacacccttacctcccactaacgtgggtgtccgcttttgagaaattatttagattgtaattttgttcttatcttactcctttagtcacttgtcacgttgacattccattttacataaaccagaatccagtgtctaactttaaaccacacattctagtgatttctttgcatgtgggtgtgcatagcttggtttcagaagttaggaagtggttagtcagtattctcaggggttaagttgactctcagccgtgggtgattagctattagctagatccctataattttcccatgacaaggatttgctagcctgcctcccgctcttgggaaaccgaaagcctttccttctggggagctagagggggcgggggttgttttccagagttacagctgagcagcttagggggttggcgctgatcgtggcttttcccaggtcccgttctggaaacatgttgcccatcccacccgcaccccaccctccaccctccaccctccacgctccaccgggaggctagttgatgtttctccctgccttcccccacccttgttaaagcttggctcttgagaaggcaattaaagtttcagagggcttgaaaattcaagggagagtggtttgagacgctgccccctctcccaccccagatgaaagttgttgtatttgtttttgtttttgcttggggatcagaggcactatttggccccaaaagagtatgattaatcaaggtgcttatataaaagaacctcaactccgccaatactagataaattaagcagactgctttcttttttttttcttttcttggcaaagcaagaaatcactataaattagcacacagtaatgggacacaaattatggagttggttccaagtgttgtcatttccttctccttccctatagaagtgggtttagagagcctactctggctttggccaagggagggtgcccctttctctccttgtttttttaaataaagcgtcatcgtgaggcagtttcctgctgcacttggtggcttgttgcatttctgtgcactggggtcatgactttctgtgcagacaaagagcagagtggcaagtgcagcgtctgcagagactttggcatagctctcttgtcaccgagagagtcctttcctctatagtctgtcgcaactaggtgcacgggttgatttattccatgccttcacctttggctcactcgtgtgagcctgagaagagagtggctttgtgaagggcatccccatgctggcctcttcccaaacagccctccttttgtcaggagtcggctgggaggggacctcagctcaactgtgaaaatgtttgtttatacggagcccctgatgagccttgggagtctaccttcctgtccccagaaacaaaacagaaaaagcctggactttgcagtcttccatttgaattgtacaggtgtctcttaacgttcaaaaggctaacctggaggtgtgctgtgtgtctccaggtgccagtacggctggcaaggcctgtactgtgataagtgcatcccacacccgggatgcgtccacggcatctgtaatgagccctggcagtgcctctgtgagaccaactggggcggccagctctgtgacaaaggtatggcccttagggatgagacccagggtgggatctgggggtgggatggcactaatttggtttctaattttattggcaggggcttttattctgaattctccttgaatgctgtgtgggttttctggtttttctttttaaaagacgactggggctagaaacatggtgggttcgccatcttcacaggcgtctcttagtgactccaggatctttttggcagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaagtaagtccaattttcagcctgtgtccattctaaggatccttgtgccaagataccacgctggggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggattctgtcatagggccagggggccccagagaagaacctggcctgcagagttcctttggctgtgagacagggctgtatatcagaatcacctgggctgctttacagtgtaaatctctgggtcccccagattccctccagaatcggggagtccatggtctttgataaacttctggaattctgcagtgcagccaggtctgagaaccgctgtcatcagcaccccaggtgtggttatggatgtggatttctggggtcagattgcctgtgctggtcctaggcccccacctgtcacttgcggaactccagcaggccacagaagctccccgggccctctttaaatggcacagtagcaattcccatctccgaggttgtcataaagacacaaaagtgaatacttcataaattgttaggagttgtctctggtcagagcagaagtggagaatgcagcctctaggtgtgctattttgggcaaactctgtaagcaaatgagaggaataaggttttccacctgtaaagaactatttttcctgacttcttagctacttctgagccatgatgaaacttttctttaaaaataaagattaggcagatagagatgtcctgtgttcctcctgggcggatgctccgtcagtatccagctgtctttctcccccactgcttaggttggggattacatgaactggggcagtgggggatttaaagctaaaatcaaggcttcggccttatcgtcaccgtcccacttgtcctgctgtagctttccttgtagcaggtgtctggctcttcaatgacagcccctcatgtaagaggtgatgttaaaggatctaattgtcagatggattgaattaaattgtcaaccccctccttttcttgttgaccagacattgatgactgttctcctaataactgttcccacgggggcacctgccaggacctggttaacggatttaagtgtgtgtgccccccacagtggactgggaaaacgtgccagttaggtaagaacatccctgtgactgtaatttttataccaaggttggctttgattgtcaaagccattacagaagacgagcgtgtggccggcagtgtgagttcacactccatcatgctaagaagtaatttattatcaagagtctagcaggcctgggagaaataacttgaatgcaaatggactagctcttttaggccctgtgggaaagtcgtgggattccttgaaccatgtcaatcgtctgtccgaggagtgttcagctgggttccaaaaggggatgatctcatgaggaatgagctgtctgcattctttttgccacatttaaatcccagcaactaggctgcctgggttttgcacagaaatgcctggtggctttctgctgttttgttgggggctggttaactagcagctggaaagttatcaattagggttcttattggataatagctagggagagggatcagatgcttaaaatagagggaacctctagtatcttttatttagctagcttattaaaatgtctcatgtctcagacaaactctggcctgttctttttttttccaaggtgggggagatgggggttgaacttcatttctcatgctcatccccatctcctttcagatgcaaatgaatgtgaggccaaaccttgtgtaaacgccaaatcctgtaagaatctcattgccagctactactgcgactgtcttcccggctggatgggtcagaattgtgacataagtgagtgactttgtttccattttgattttcatgaaacttgggtagccgacttgctggtccgtactggggctccagtcctaggacttgagcagtagaaggaaaaccttagagtgggaatggttttttgagagggagtggtcagggcagcagtgaaaacatacactttatcaggctcattagctgcgaaaaccagccatattctgataatgtggctgaaacaatgatgtgaagtttcactccctcattctggaagaattagggagggtccccacccagcgtaataaccttatctcacggaaagcacacaggaaatctgatttgaaacttatctatcctgagctgagaaggcttttcaattaagcccaatttcactgtaaattacctctttaaaatgatgacttatttattttttagatattaatgactgccttggccagtgtcagaatgacgcctcctgtcgggtatgtaaatctttgcttaaatcaaaactttgacaattgacaacaaatctttagatttgtgcgacactaggagagctctgtccctgtgagatttaaaaatttgggtgaaaaaagagtctcttggaagtttcgctagggcttatgttaccccagcctcgtgggagtcattttgaaggcatgcacatagaaattcctctaaccactttcagaggtttagcatttggctatttcagtgaaccagctaaaccgcaacagtcatgctaaaccgctgaagccctgtgtttgtggaatacatagaaaaaaagcatgtgtctctctctccccttctcctcttctaggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcaggtgagtggtggcaaaacctcagatggccaagtttttagagcagagccgctgcctcctccgcttccctttacttttccctcagctcttgtgtctggaatttcctaacatctattaacatcctattgatgagagagtctctgctagacaaatgctggtggaaggagatactgacgaattattttcttcttagtgtcttcgtctttgtgttctttttggttccctccaccccctcttgtgctccctctcccactctgccccgttgtttcaaatactggacattggcagtccctacagcatagagatgtatcttacagggtgtctcctaatagaaaccgaaggaactgtcagattccagtgcctgctgccccagagaagttatcgtgacacctttgttttactctgatccctcccccttttcgctgttcctgatatttgcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaaggtacctcccttctcccgggacctggctgtctccagacttgctccttttgtccccacttactaccactgccccttgttacacttgagaagtaatgtattggtgaggaggacctctatagtgaaatgatcctgcctgtgtagcgggccgcaacacgtggaaacaatctattccggcctgccagtgggagagccgtgtctacaagtagcccaggggagagaatgtgaaatccatttagcattcctgttctggggtgggctgatgtgcaacgctgaggcaaatgcctgagaacaacactgtcaacagaacttcctgcaacggcagacagagggggatgttctgtatctgcacggtcaggtatgggagccccaggccatgtggactgtgactagtgtaactagaaactgattttatttcattttagttcatttaaatgtaaatagccacatgtggccggtggctgctgtattaggcagcacaacatttaaagcttctataagattgtccttgagccttgcttaagatcaaaaaggaagtaaataaagcaggtccttttgccttagcaagtgtttaccaaattgggtagatgtcaaaggtaggatgaaggggatccacaagcatgtgggttttcctggttgtgtggagggagaaaatgctttaaaactctttgcctggagtctcaactttgcctgtcataatgtgatgtggcacgttgccagtatcttggcttccctggggtgtgtctcattagccagagggtccctgtctccaggaaagtgggcttggcccaggcccttggcttaggaatgccgcatctgtgggtgcatggctgtgatctgatcccaagcctatcttctagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaagtaagactccctcatccgggaatggaccagtgctccccagcctgcccctgcccctgcctctgcccctggcccaccctgggatcattggtgttgaaagttttttttttttttttgagaccgaatttcgctgttgttgcccaggctagagtgcagtggcacgatctcggctcaccacaacctcggcctcccaggttcaagcgattctcctgcctgcctcagccttcctgagtagctgggattacaggcatgcgcaccacgcccaccacgcccagctaattttgtatttttagtagagatggggtttccccatgttggtcaggctggtctcgaactcccagcctcagatgatccaccccccgacccccaacttggcctcccaaagtgctgggattacaggtgtgagccaccatgcccagcagtgttgaaattgttttaatcagaaacagtaaggctggggagactggttgagacttatccttacatctgggatctaagactgaggtcgtgttcaatttaccagatcactctgcctcggagcctccatatctatgttggaacattctggaatgttgctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaagtcatatttctactttcatttccatgggacttccagaggcccaccccacatcttgcctaacttgtggcattcaaagtaacccagttgggagctcctttattcctggaaaagcctgattgtgttaaagtactacgactgtggctgttctcagaataggatgttggatgtaagcagtaggaaaggcttggctctcgcctgtcgtgaatggtcctggatctcgtcttcagccgattgtctcccctttgattctagatattaatgactgcagccagaacccctgccacaatgggggcacgtgtcgcgacctggtcaatgacttctactgtgactgtaaaaatgggtggaaaggaaagacctgccactcacgtaagtggtagttggccttggatgctatctctgggacccttccctctgtcttctgtgggagggggccactgggactcacactgaaatattttcctccaggtgacagtcagtgtgatgaggccacgtgcaacaacggtggcacctgctatgatgagggggatgcttttaagtgcatgtgtcctggcggctgggaaggaacaacctgtaacataggtaactttatgccccacgtgggatctgcagtgggcatggccacctgggcgtgtctgctggttggcccctggagcttatgatatttctctgggcctggttcttgcccctccagactgtttctggatactcagggagggtggtcgtgtctgctcttcttttatagcccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttacttagggctaagaccgctttccctgttgaagtcctcactattaagttgtcttttctttgcagataccaatgactgcagccctcatccctggtaagtgtgacatccttttaagccagcactcatccactatcgtgtgtgtgtgtgtgtgtgtgtgtgtgtgtgtgtgtgtgagaatcacccagggattgtgtttaaaatgcaagttctgagtcaggaggtctggggtggggcctcagactgcttttctaacaagctcccaggtgaagcgatcctgctgccccatggaccacactttaattagccaggttgtgtcctcatttagagcagtgatttttcaaccttggctgcacaccagaatcacctgggagcttttaaaaatcccgctgcctgggctgcaaccaagacctgtgaaattagactttctgggggtgggacccaggcatcagtattcttttaaaattccccaggcaacggccatggggtgagagccactgactgtaactggtgtggtgacatgtgagtgattggcagccagagtaatggactgggaggttggtaaccaaggtggtctttgctttcttagttacaacagcggcacctgtgtggatggagacaactggtaccggtgcgaatgtgccccgggttttgctgggcccgactgcagaataagtaaggactgtctccgtctggttttcccaatggctttaccgcttcattccatgcctcaccccaagactttcatctttaaaaacaaagccaccattccctttaagtagctctcatagagcaaaggatctctctcctccagctgggattaagatatgccaggctggatcctcccaggtacctgctggtagttccctgggtggtgtagccctccttgttcttggggagagagtgccagtcacagaatctgatgattaatctacagtggggtcctgaagaaagtatgtgcatttccccatgactaacatgaaattatgggcaagcagatgttaaccacagctacactggtataggataaagctaatacaaacggaagggaggacgactgtggcttccagaggcttgtctgtgctgggtctgatcaggccctggagaaatgactaaaacaggaaaataggggcaggcaacgcagtttttcaagaggcttaaagcatattattttgagccttttctctacttttttacaagccctttctcttacagaacaaaaaaggtgctagagtagttatggtttgattcttgtacccaaattgtctgaaattttactggtgcttgaaatccaagtctgggattaactagtcttcagcactagatgggggcaggttgtatctgtttcatgtttctaaataaacagttggcaaactgtggcccaggggccgtatccagcccactgtctgtttttataaatacagttttcttggcacacagccacacattcatttatgtattgtctatggctactttcatgataccacaagagttggatagttgtgacagagactatataccccacaaagcctaagatgtttactgtctgaccccttccaggaaactttgccaggcttgctgtaaattgcactgtcaaaggaatcaaattaaaaattgctgcctcccaaaatggttctccactgttagaactcaggatggtggtggtctttgggagccagtgattggaggtttttgcaatagatctgtttcttcttttggatgctgcttacctgagtgaaaattcatcaagcttatgatgatatgcttttcttgtatgttatgtcaataaaaacaatctcaaaacattgccacacaccatcagtccctaaacttgaactccatttctcctagacatcaatgaatgccagtcttcaccttgtgcctttggagcgacctgtgtggatgagatcaatggctaccggtgtgtctgccctccagggcacagtggtgccaagtgccaggaaggtatgtgtgccaggcttcagctgcccatgggtcttctggggtgagcgagctttgcagtcaccatttgacttttcacaaataagccactgtgctcagggaagggaacacacagtgggactacaagggaaagggaacgtgaagagtcttccccaaaacaggtagctgttgtttttggtcagctgttgccacaaaactgtgtaccaaaccatcccaaactgctgtggcttgcagcaagcattatttttattgctcatgatatgcagcatgggcagagagattgcgctgtgggttgggttcagttcgaccagtggctgtgtctggggcatattcctttcatcgccagtgggtaggtgtgcaagaggctagtcaaaggctctgctcacatcacatctgccaatgttacattggccagagcaagtcttgtggccaagcgcagagccagcaaaggcaggaagtacacatgctgttactgtgggaagaatgatcttaacatggcaaagggcacaggcataaccatttcataacagggaccaaagaattgaaccccgatccggttcacagaaaaataaactgctcacccgtctccacctgtcagtttcagggagaccttgcatcaccatggggagtgtgataccagatggggccaaatgggatgatgactgtaatacctgccagtgcctgaatggacggatcgcctgctcaaaggtaggacatgatggctgccgcagttcacctgtgttctggaatcagggatgagcatgcctgctaagctgccagcttctgtttttctccaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccagtatgtaacaacctttgttttttttttgaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattgtttttccagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacaggtaggtgtcaagtgggactagtttgtgtgatgatagtagatgatctcattatactattcaataaagccatcaggtcgagggattatctggcagtgccctaccctcgcaggagctcccaatttaactgagaactgagggcagcctactttactaaggtcacatggcccatgggaacagaggtctgcctcatattttccttcccaacacactatgcaacgttccctgcagaacaggtattgtgctagatccgtgacaaagccctaggacactgcttgtcctttgtccttgagtttgaagctgtacaaagcctgacttggcattttggtgtcctgggacagcctagccactgctgagctctgtgaggctcgatggccccgcaggggtgtccaggcttccctcctgaggatctcgagcaccgtttcagccaagggagagattgggcatggagccatggcacgtttgagctgtctgtgctaatttgaatcggatttctagttctgaaaaccaactcctgtactgagctgcctcagtagccagacttaacaagacactgctctccccatgcgaagtcaaagagcctgtaggagctgccgctccacccagtctctccagggataagagtatcaaggtctacaggggcctgatcccagcatttgcttatcaagttgtgaagtgaccatatgcaatgatgaaaagggacttgtccctgtggcccccctcttagggataaagggcaggagaaccactgttggtattcttttgttcctgcgatgatgcttttttctttctttcttggagagttaattggttttgtgcctgccttacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcctgtagtgtcgaggtgaattgtttgtgagcaatcaggggaactggccacagcactgaaagggttttaaagggtttggaattggtgttgggaaacgagcagggagatttaatgtctgcctcttttttttccctggctacttagattcatattaatgtcctgttgtaagggtgtggtctgaaatgactcttgtgcacatttacccatggggtggtttcctcacggcacaggaggtggtagttgcaagcttctggtgttcgggctcatcactcatcaccttgttcccagggaatgagtgttctggcctcaccatgcagccttggagtgctggtgttctggtcttctgtgaggttccagagttgggctgtccccacctgtcacgggcaggagaactctggttctctcacttgtggctggtggaggccctgcccccgcatcgcgtggtggggtgtgggagaagctttgcctctggcacctctgcggaaggaataagctgtggtaacaagcacatggacagcttccagcagccgtgcagagtcaccaggactctgcttctggctaggaaagccaaagctcacccttctcagagccatcccccagcacttcaacattcaggcctgtccacccacgtccggttttcatacaactggcacagcagactttgaatggaggaaaagctgatggggatgtttttctttgttctcggggaaacattttttcttctaggcttggagttgtgctaaggaacatcttaagaatgaaagatgagctttaagtgtcctgggatccttgtgcatgagcagaggccatcgagggatttgggattgtgacaaccctaagagggccaacactgttttggctcattggggaggtggcctgaaggacccggacagcgaagagttgaggtttccatgacatctccctgccctagcgtagctccgctttctcaccaatgtctgccagtagacagctgggtttccacaaggtggggtcaaagggagggagaaatctagatcctactagccaggagacagtcatttcgcagcagtggagtcaaacactatcctgaagcaaaaccttgttctggtggtttgtaaacttggattctgcaggaccccagaattccttgggtagctgccagatgcttttgtgccaagaaaaaaaaaaaaaaaagttgaatgagtctctgcaattctttattccaggagggaagggatcttgggattcatgggtgttgtcttaactcaccttctgtctgggacacccctggtattgggagggcatagatcagcctcctctggatgtggctcagtgccaggactttaattgtgaagggtggattttccccttccttcaggaagaaggaagcaggcaatggtgctctggttatcctggggttaggaaagttgagaggaagggactcagtgcctttaccattcattccccaggaacgccctgggctctctttaaaggggccctggaagaaaaaattttcagtccagaaacttggctaactagaactctagcattagaatatcccatgaaactccaggaaagaacacttaaagctggtgtttttttaggatgggaagctctgtcctgagattctatacttccatgatgtagaatttgaatagaaagtggagggggaggatgtatcttaattgactaaaagccaaaggagactcagtggtgatttgcgagagggtttacagtttgaagatgcagatttccaggactggtccatgaccctattagaccagatgcaccagaagtggagcctgggaatttgaatttttgacaagctcgctcttcctccccgactcatgcactctaaaaattgggagcaactctgctaaagtgctacagtaccagctcttaactaattataatgtttttcttccttgttaaactgaattaaatagcctggaagccagtttgttgctaaattgccacctgacatcatttttaagtaaaatgattacaccgccccttgagcaagatg

SEQ ID NO: 16169 - DNA, 16421 bp, Human
gtttaaggcctgcctgaatgaagacgaaactgattaaatatggctataaacccacaggaatttgaccaggcaaaaattttcttttttaaacagaaccaactcctatctgaaaatggcttctagaaataattatttaataaaataatttaatccatgtctttgtttcatagtaacagaaaaatatccacctccctttcctcccaaaattcagctgctgcatatcagtttaattgtactacctagcagttcaaagaaattggcttttcaatggacattagaatctaaaactcctagatttaatgggtctgtcctctgaggcccacaaaagtgcaatcatagaacaatagggtcaatacatttcttatcaagggttcacctactttgatatcacccattcttggaagggaactcaggtcaaactgttatcaaacaaatatataaatagataaactaaatgaagctaatgaagagaccacaatcaaatagtcctgggaaagactattagctggccttcttcagaaataaacatgcagggaaaaattgagaaaggacaaaggagaaggtcatgcacctctaagaatagagcaaataaagatattagtttaagacaacggtcctccaggtaaatataaaagctaagttcttaccaccaacatgaacaagtgaaatacacttatttgatggaaaacttacgggcacaaagcaattgttgaccaaatagcagaaaccagtctacaaaaatcataattaaaaatacaagtataattctgttaattaggcatagaaatttataatctccacgtcttacaattgtccagtgtttattcatgtacctaaattaaactaaaataatttcaatccaggcaaaccaccctgaaagatttttttcttaagatgtttatatctaaacccatgctcagatcagcaaaaacatttagaaaggaaaatattctattaaattttttaaaaacattttattgggggatcgttaaatataaataatccattttaaataatataaacacgtagcagaagtacataaaacatactttcattttctaaaacatagagaacagtaacttcttcgcctccaaaagaacagaccatttaataccatttaaaaaaatcttttggcattcctattgcccttcccataactaaatgaatcagtgacacgtgtatatatatacatatattggagatggagtttcgttcttgttgcccaggctggagtgcaatggtgcaatcttggctcactgcaacctctgcctcccgggttcaagtgattctcctgcctcagcctcccaaacagctgggattacgggcgcccagctaattttttctacatgttggtcaggctggtctcgaactcctgacctcaggtgatcctcccacctcggcctcccaaagtgccggaattagaggcgtgagccaccacacccagccctgatgtatatatttgaatctgctgtttattcatatgttgaataaacattcacagttgggattactggcatacatcttccacaattataacattattttagctagtgaataataaaactaatttgattttggttaacttcttttcaatacagatggtttaaaaataagacaaagcctgtctttttctattgtgatcttaaaaatatctttctaacatgctttttaaaaaaaatacataagtatgctaccactgccttgtagtaaactttagaaaatgttgagattccaaagggctgcctacaaaccaaatggcatcctagctttggcaggctgatgcttcattttggctgctctcgccccctctagcgtttgcaaagctcatctgtctgattatccagttacctcactgaacaagatcttggctaagtcctgcccatctatgacatcacccccttcttcagccactgcgaggtgaagctttaaacttcagacttggaggtgggctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggtaagtgttttccatgttttttcttatgattgtcccagaaagtttgcttggttttactctctagaaagaaacgacttgatactatgagaaatccaaataggaacgtttgctctgtcaccacaacaagcaatatatgtgcgtgcaagccagcaatgaaaaatttcactatgatggctgaatgtaagaagtttcttagaaccttctttcatttataaaagatagtaagtggctattttctgtcttgagtaattgctatgtgaaaagagccttatggaaaacagcaagttggaaagttcaatgttaaatattaaagaatacaaggagattcttcacagataggaaagcaacttggtgtgtactgtacgtgtggtatgatcaccaattgctgtttttacaactgtgaaagaaaatcaataatccctcagcccatgagtacgcagtacatgaaaagcatacatcttgctcacagctagccgagctactcctggagacttatgtgcctctgtaaaggattaacagctacacctagattttaaagcttgcactgctatcgtgcctgagctgcttcaagcatttcaggcttgcaaatctcaactagtaaattgaactcagaggagggggagacactcttccaaaccatattccctcttcaatagaacaccaaaatccattgcttaggcaagtgaagtatgtgactagcatagtaaatggctaagtctactcagaaaaactaacaaagctcaccctggaagctatgcctgatgtatgcagtgagtttggggtagcaggaaagaaaaataaatgagtagagcccttatcaagtgggttttgcagaggatccattctttgcaacttataataggaaaatcttatattggaagaaatgcatttatactacaaagcttgaaaaagtagttaaatgtatcttctcaaaaaattttgttcactgaattaggtctgaaacaaaatggttgcatataggtaaagagtgcaacaggcccatccatgtcttctcaacatctggggggtttgtttttattattttatttagaatttaaaagaaaaaaaattgatttttttttcaatttttagtccaaaatctctaatggttttaataataaggctattttaaacattcttaataaatctgtctattaataaatctgtctaaaatgctcatctatgttattttattatccagaaacaacataaataaagccactagaaaagtccttcagctgtagcaatgcctttcatttatctctgactgcataaaaatatcctgaccagcctaaacataaagaataaatttgcttatattcagggagaatcacttatacctgacccaaagtgacagatgactaatattcatctcttccgaaatgagtaaagaaaaattaatcctttaaaagtgccacaatcaataatatcaacattaccaactactacaaatattaatgataatatgccaggttttaccatgggaaaattaaatcagagatatgccccttagtttggacacatatatatacacacagacaaacgcacatctatttattaccctgaaataaaaacagagttacaaaaacgcatagatttactaagaaaactaaaatttgattttttgaagagcacaaccaaaacacatcaagtccaaggatcagcaaaatattagtgaatgaataaacataatgaattcattaatattgcggttctgtaaaactgtctaccagttactaattgggtttttcatttcgctgcaccccaccctttaaaatcaattatgactgggttcaaaatgcacaattaaacacttcccaaacataacgtttgtgagatatataattggatagcaaataaagtttttacaaaaagaagaaaaacagtaagaaaatctgtcataactaaatgtggcagcaaaatagaaggtatgtttcttttgctttcaagtgttaattaaggagcctacaattctatcaaaactttttcagagctaaatgaagcagtgtgaaataaatttggttgaaatcttgtggctgtcagactttgttagcaagctattaattatctttaccccagtttcttctctagactatattgcccaatcaaatagaaactccaattatgctcagcatctcctgcctagggacacaagaccctaatgaacactcagtctctctagatgaaaaatacaataatcagctttaaacatgcaagtgcactgcagagagatttttctgtgcttttcttggccacacaccctaaggcttcctcctttttctggattattttgaacagttttaagccctacaaaaatcagtgcagggaattggccttgtcttaataatatattaatgtttcttctttcttgcttttcatttttgatatgccaatgttcataccaatattaaatctggtcaatgaaaaagtattggtttatagttgccatttcagtcatttcttaacttctatgcctctttttaaggtgggtgggctatataacaaagaatgtgattgattaatggcaaaatccagagctaacttaaaaattctgaatagatccccttatatattcttttattcaaacccatttatttaaaaaaaaaagcattagaaataactgtttaaatcaaatgaagactaccataaataaagtcaacaatggaaataagattcagtaatttttcaaaggccataatttctcccctccgtctttcctccttcccccttccctcccaccccccaccttttgccccagaggccttcactgttcttctcaacgggaggctttgttgtaattaaaccagagaaaaactggccagcagcagccaacatctgacttgcggcttcagaaagcagtgttctggtagagtgtaccaccccccagtgggcaaaaactctacagtaaaaatctctcagcaatattaatcctcaaaactgcattttctcttcagagcataaaaagggatgtttctcagctccttctaacattccaccatttcaaaaatttactgaaagtcaacaaataaatttccaacaaagagttggtcttctgaaacagcattcttcctcttaagaaaataggtatacacatttcaaaaagtattttccagtttcaaaatacagatcgacatcactcaatttggttaaacatcacactaaaagacagttttcaaagctatgtttatgttgtgtaagaaagaactttgagttatctatttacgaaaaccccagagaaaacagattttaagtagaaagcaatagaatataatttaagcaaaagctaaaatttcatttgttttgcatatgcataatctctttcctaccctaaaatcaagtgtcagggatgtataaaaagctttctgcaggtattattctgtttaaatcaaaggagggagaaattgctctcactcgatgagacaatgacagcttttgttctttattctttcactttacatgtgcacaagttaccgaggcaactttgaagagaaaacccacagaccacatttggttaaaaaccatttttaaagtgtgccactggactgtggattgatcagtttatgtgttgttgattttcttcctcttcatctggtttaagtaataccctgcttggacatgaaaaacaatgtattttatgatttcaggtggtctcaccgaccagtatagtgcttgccacacagtagactaaaataaatgtatttgctgaactactgtatggaaacttaaatattagaaatttaaagcacatcaaccaagttgtacccacactgttaaaaaggaatttgaagtctgcaatggtaaaacgtggtttaacaaaagtaggcaaacttttaattgcatttgctcaaaagcacaaatttaaagcatgcccccaccccaaactctgcaccacttaccttcaccactctctaaattaatatcttactcgttcttacaactcttgttctctaattcatttactttgggtttaatatcataaaaggaagcagcattcactatgctgacggataatatcccagtttgcctttttgttttaaggatgcttgatttaactttacaagtcaaaataaatgaagcagaatttgattcatttgtcagaaacgtaccggggaaaataaccagtaacagaaaaagaaaaagtaaaaatacttagcattggaaattttatcctctattttccataaatgaaacaaggaccttgttcaggctagaaaatagtctggataaaaccaagtatgaaaaggcacacttgcttctctgcctctcagcaaacccttcagacttcatgactctcaagaggagagttagaggtccttctgcttgcctggcattgaacaaaagaattggaactttcctgaaatctgatgatcatggaaaatttaactaccagacaggctgcttagaaagcattttgctgtcactatcaactaacctgatgtactccagtttttcagtttaaccgtatatgtagtttatttgaaataccgtttgttgttgcaaaggcttagcattcacaggttgagcttttttggcagcaatttaagccttcataaataaattaccttcctaatactctaaattatgattgtataaattccagtttacctagaaatattcacaaagttggatacatttgtttaggcatgtgttttctttagtctcaaggttttacttaaaacaatgcaactaacttggattaaaagttctacatgccattagattttagattgaatatttttaaaagtccccagcattaagaaatcattctgtgagagaaatcattaaaaataaactataatctcaaaaccttatacttgaattaatatttttaaaaaatgactaatgatcaaacaggtcaaatcaaaatcaatttaaatctaaggcattaaataagaagttagcactactattatacagcttcatcttaatctaagtaatattctcaaaacataagaaataccttctcataacactcccacctccaaaatattgtagtagcagggaagaaatcacataaacatgtagattgccgcaagctcttgattttatttaaatactagttttctattcagatacaacttcttatattagtttccctaaaatagtatccttatctatttacatgttttattgggtgtatcatggaaataaattggaagctttcagacttgatgattacattataaatgcaaaaaaaccccacaatttttatttgtaaaaataaactgaatatgaatataaggatccctattaaaaatttgattcatcagtgaggtggttatgtttttcttctttttactacagttttaagtgttttatagttaaataatgattccattaaaaaatgtttttaaacattccattaagttaccagggcttcatttatgttttcctcccaagttaccccattaacagtatttttctaaaagatcgattcattttgttcagaagtaatggcctctttcaagcctaggcggacagaaaggctctgaagtcagtgttatggaaacctggccacagtgtccatgccagtgggggtcatttttcttttcatcatcgacatttgactacagtatttctaggtgcgcaaatatgtagatccagctcagaaaggggaaggtctaaggataggagaggatcgttcatttttgatgaagagatccttgcagcctttaatatgccaaaaccaaaacccaaaaatctgtttagcactatagtttcaaacataaatgggaaagagaagatataaaacgtagttaaacatgaactgttttgagcctaagggagcaggggcatatgagagtagctctgaacgtaatcttcatttccgaaagagtatccttctctcctaagaaacctgttttatgtttttgccttttattttaatacaatgtggggagaagagaatgacattttccaagaacttaatgagatttaaggctttctgttaatcccacattattaccactattgtatgaatggcaaatgtgagtttgcatatcaaacagaatagagaaagcagcttcacaaatgtaaaacaggtaaaataaacaaattaatcttccgtcttttcacaccaatttagaactctttcattctctgggttaaaaatgtgaaaatcaatacatattgttagagccttatttggtgaaatatatatatagtccagacacaagataaaagacatttattttatgtctggttatcattatgatcatcaccttggacacactgtggtctgacctgactcaggggacaatcagtttttaaatccccaatcagcggattcatcatctcaagtatatattgcctcaccatcatccctggaatatcagaaatgcttgactcttggtaacattttaagcaggttctcacttgttatttttataatggtttttaattagtttctaatgcaatttaacataagcaattgttttctaaacttaaattaaccacattattttatatgttgaataattttcaagtttaaaaaacttttacagaagatactttaaaaagtaactttgtaattataatttcaacagcttggttttccattttcacacactgagaaagcaacagttttcaagaaaagatactattggaatttgacaataatgagcaaagccctaaaggcatcacagtaaaacctcacattaaacaataaatcatttaaactttcctctgtgggcactttgcaatattcactagagactgtttgatccatctgctaactgctatttttgtttcaagttgcgtaaataataaattatatgtatctgtaattgttttcacttttcttccgttaatatagcctatgaccatgttggtatgtagttagcaaactaaaagaaactgaatttttggagagaaccagaaacacaaattgtggccttatttaacatactcgttcagcagagtatctgaattatggaacagatgctatacttgttggatgttagatagcaactgtgggagaagcaaattgctactactttagtccttactttgagggtcacatatttccaggatactcaaatgttccctacatatatacaaagtatcagagtggatgaccctgcataaccaattcaaatattactcacctcctctaaactctcaaaaaatcttcgtgcatatttgataatgggcaaagcagtcaacattaaattcaatgatctctttagtcaagccaaaagtcttcttttggaaatgaaaaatacacttattaaaaactggcaatattcatgtatgaacctagagagaaatgccccacctggttttgatgtgctttcctaatggtcactacaaggagattgaaataatagtgtcccttctatttcaaatacaatttttttttcaaactcagtatgctaaaagaaaattagaacagtattctccagaaaaactaaatatgacttgaacttctatgtcaccttttgggcaagaacacctgagtgcttagagtttcaagatcactaagtagtccttagatacacccctaaagagaaaggggatgatgtcaacattctgcagttgggagaattgagacctgcaggaggaatcaaacagggcactaagcaaatcaaaagaaaagcttttaaaatagtcttttcaactctaaattgtggattgtgtgactttgttaaatcatgttcagaaatgcctaaaaagttaccttggcatttctgtcaaaaatatttgttaatgtatttgctcacctctttgacatgtacttgttttcttctttttaaacattttatcattttatgcatatgatttaaaagtaaatttttaaagactggcttgaatttgaaagccatggtgtttaattcaaagtgacacaatcagataatagaaattatctgtttgatgacaatctcaactttggctcctactttatttgtataagaaaatgagaagtctaaaaacaaagaggtcaacctatcccttctgactaaccactatgatgaaagatgtgttattttaagacattgaaattaaatgtctaggaaatttctctagtatgttaaagttcattattaatagttcattaaaaccttttactttcacaggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcaggtaatcatacctcaggatgtagctactgtacaaagtttatacttggataatcctggatgggaataaaggtagggggtaactgcctgaaaaacctattactatacaggccttagcatcatgaatgactttcttcatgaggatctgaagttactatctctgaccacattgcacagaagagccaataagaatttcaaagagggcaatttccactaagggaattaagctacacaaaaggaactttcacacagaaactctatcagaaagaaaaaaaaaatacataggaagccatgtgtcctacatagtaacaggaagcagaattgtttctgcccccactttaatgagcttgcccaccatgctgaactgcagctggaatgttcattgacaacagcaagcctgatctggaggtgtgtacgccataggattacttgaataaacggtgaagaacatttccaaggactaaacaaaagtttataagtcccagtccctcaccaggaaaataatatatgtgcattggatattcacccccgcaaaatttactcacatcgttcaataaggtaggaaaaacaaagtattttattttcatgcctaaaattacaaaggctaattaatacttaaaaggacagaagagactatattacacaatacatcagtataaatctatactttgccagccatagaaaaagttgatttatgttctaggttagaattcaaagaaatataaatgcactgtgacaacacgttatgaggtagaaaataatgaaaaatgtggacaaagtcattaaaacctgcagtatgaaacatataacaaaatgtgaacagaagaaagacagaatttaatatgaagtgaaattttccacttaggttagctggatgtattagctttgtaattctttcccaaaaataaatgaaggaatcattcttattttcttgcagaaatccatccatttaaaataatgcttaaaattaataaccaaagaaaatgaaatgacattaataatcaaagcaaactatgggtttgagattgaggatctcaagatgtgtgtaactattcctgagtatgaagagaataggtatttttatgacatttttctacacctgtatagtttttgcctaataaaaagtaaatataaaaatgtgtggttttttgataacagtaaaatgattacctttaaatataagaaataatattccaaggtgttacttattatgaatattaagtaagaaatggatattcaattagcttgatcagtgactgtctaaaggttgatataaagtataattaaaatactttggattattcaataaaacttcaattatatttaatatttcaaaatcaaatggatttaggacagatactttttaatttataaagaaattaagaaaccattaaggtaaagagattatatgacagtgtctattgttagctagcaataaaccctattatgccccctcccaaaacaaatgaaaatattaaaagtgattatggatattttagtttccacatttgtttttaaacattatattcagtatgctggccttattgttttctgtctttttttactcacttcattttagggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaacaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgatttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatgaagcctccataaaaaaacaaaaggtcaagatttggagagcttccaggttgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccag

SEQ ID NO: 16170 - DNA, 12418 bp, Human
tcttgttcttgttctttctgttctcaaattttcaatggttaactctttcctcccatttttatttaattccacatatgacctcctcaacaagaccatgcctgatgacctatataaatgacctcacatccattcctatgtattacctggttctttgcatgtagcagcctaaggtcatacacttctcaaccaaacaatcctacgaaccccaataaatagcactccatattttagaacttttagagttttatacatatttttcattcattcacgcattcagtaagggcatggaatacatactagattccagttactacggcaggtgttagaggcacagaggagacaagtcaaagcccttgccctcaagcagcttacagtctagtaagggaaacagataataaaccatgatataatatcagatattgacagcaatctgtacaggcacagagtgtgaggttctattttacatataatagcaactgacaatttctctgagcaggtggcagctgaagagtgagtcggttaaagggagagcgagacatgcagggagatggaaaaagaatcttttagagaaaaagtaaaagccctgtagtggtaggatgcttggcatttttaaggaggaggtttctgtcagagaggatactgaataataggaaaaatgataagagaggtaaccaggggccatattatgtataaagcattctcaactattaggtctttggattttacggtacatttgataggaagcctttcaaagtgcagtggggggaggagttaaacacttcaccaaaatcatatgaattaattataaaacaatggttctagctgctatgtggaaaagggactaagaaattgactgaaaaataggatggaagcaaagggagcttttagggccaacatgtacctctttgtgtcttaggtagacaaatgcatctaatggtccaactaacttctctagatgataacttccaacccacctatgcataaaatttaacgtctttattctaaataagtgatattaataataaaatttggggcaccaagattattaatcagagtggtattttgatttccctccttaaatcaccatacatagctttctgcattcatcttgcgttgactgtcattacttgtctgagtgagactgataccacagcgatgttttaaataataatcatacctcaaaagactgaagtctcagaggtatctgaagagaataacctagagcacagggggagaattgaaggagctgttactgaggtgacataaaagcagtctaaatgacagtaaaatgtgacaagaaaattagcaggaaacaaatgaaacagataatttaagataaacaattttagagcatagcaaggaagttccagaccacaagctttctgtttcctgcattcttacttcttactacgtgatacatctagtcaccagggaagaagcgaatgacacacttccaaaaaccaattcgtagctttctaaataaaaccctttcaagctggagagagatccatgagcatagagatcttaaaattcatgttcagcaataaatcctggggccccagacagtgtcaggtgcatagggggtgttcagtaaatatcagttaaatgtatgcataaatcgataaacgggattcctggaaaatactacactctccttctccaaattatcttcatctcaaagacaggaacctctaacttttaattctttacttagattatgctgtctcctaaactgtttatgttttctagaaatttaaggcaggatgtctcagagtctgggaaaatcccactttcctcctgctacaccttacagttgtgagaaagcacatttcagacaacagggaaaacccatacttcaccacaacaacacactatacattgtctggtccactggagcataaattaaagagaaacaatgtagtcaagcaagtaggcggcaagaggaagggggcggagacatcatcagggagtataaactctgagatgcctcagagcctcacagactcaacaagagctccagcaaagactttcactgtagcttgacttgacctgagattaactagggaatcttgagaataaagatgagctctgaaaattgtttcgtagcagagaacagctctttgcatccggagagtggacaagaaagtaagtcagatctgattgcctatttactctctggtatctctatatatgacattaatagtagttatacaagatatactggtaatctctctatatatgatatataatcttagagaaatatactgctaatctctatgtatgtgatatctaatggttgttagggaaggaagtgaggctttgtcttttagagaagacaggttcttcttcagggaagaggtaaacccctttttatctataagaagatagaatacctgagatgagagaaagccgcaaaaatgaatttcagaagatctttaaagatctttctctttgctttagtttatatcatctcagtgtttagatttaattagaaaactttctgctctagcccagttattctccatcatttttttcatatccatctgtacattctccaggaagtgttgtctctctttatgaaaaattctgttttccacataagcaattacattgtttgccttcctttgcattcagtgtctgctttcagtgtaccttatcctgtgttctcatgacagcatcctctagttgctggaaatgggcaagtttgccatctttgagagaatagctatatcagcagatgaaaatttacagtgtccatttgtaatttgctaaaaaaaaaagtcacaaaagaattcccgaaaatgcaatctcctgctttggtattctttataggactcttttcctctatttcatccttctatttaacctttccaatctctggcttcaaagactatgtaacttagaatttgttcttcctttcctttgtctctcagcaaaatataatcatcttagaaattttcctctcttctatttgtctattctatccacatatctagcttatttcctgttactgggattttgcctattgtttttctataccttacttctgtaaaatttgttgagtttttctatttatccctctttctccttagttaatgaggtaccctaaagcactagcacttaggaattagtctacttgtcagcaagagcgatctattaacaaagggatatgtaagaaacaggagaactaaaacaatcttgtggaaagggattattttctaagcgtgtgtctactatattagtttacttccgaaaaacatcagttacttctcataaatccatcctgtgtttaagaacataaaatatagtgtggataacaaatgcaaagcatgcaaattttcaggtaatcaggcgagccattacttacggcacaggtgtgccgccaaaaagaaataataataataataataataataataactactcaataaatagagagcataggtgaaagaaggacctaatacagaaatttttaacttttcctgatactgtttcaactttcttttgaatgtctgatttaggctgccctagtcatccttggacgttatccttgggtgattcaattagtagcaaattgagttgattttcaacttctccattaatgtgcaggacctgaaatcaaagcaaaagtgtgctgttgagggaaatgttttgtcacctaggagataagtcaagctgtgggtaacaatagccctcaattgtaatcccagcactttgggaggccgaggtgggcggatcacgaggtcaggagatggagaccatcctggctaacacgatgaaaccccgtctgtactaaaaatacaaaaagttagccgggcgtggtggcgggcgcctgtagtcccagctacttaggaggctgaggcaggagaatggcgtgaacccgggaggcggagcttgcagtgagccgagatcacaccactgcactccagcctggacgacagagcgagactccgtctcaaaaaataaataaataaaacagtagccctcattaatgggaataaagtatcatctgagagtcatcccaaagcttactccctcgttgagccgatgggctgactgagactctggaacccacgggtcactggggtgtgttagtgctcactgaggagacagagctgttgcaatactgagttcaagcagcacgactgactcacataatgtgaagtgaaaccagacagagctccgaacttggtaccttgggtagcaaaggcggcttccaatgatgattctataccggtgaacaaagaaaaatttgctttgagaagctgagaaaatcgagctagacggcagtgaagtaaaggcttctcttgcaaaatctgagtgccgatctgtgatgggaaaaataacttccagataaagcaaaagttgatgtggacaccagtacccagtaaattactgtgaaaaaaaggcaacttctcttggtccagtttacctttagataaatgttttaagggtaaaaatatgtgtatttcaagatatgtcttatgtaaacttttttaagttatgaaaatcatccatattgaaaaatagaatgttttctattttgaaactgttttgcattgtcagttacttaagcagccattttacattttggtttttgagaacataatagggacctgtatactccttgtggggccgcattttaagactcctgacagctcatcctgcaaaattaaaatccaaaatctaagtcgcaaaattctcttttctccttcctcagttatttacttagagtgtagaacagacatcctcttagagttttttgtaactatcagttatcgttaacatcatatttttattctaaatccttccatagaaacactgcttgttggaaaaaaaaaaggcttttactttgtttcaccattgtacagagggtaaatgaaataactttcgctgaatatttggtctataatactgttacatttcctctattattttaacatcttttgaaaaattcaaatttttactgttcattcacatatcattttaaattgaggtttagttcacatacgatgaatgcacagctcgtaggtatacagtttaacgacttatgacagtggtataaccacaagaccagcaacatttgaatctttccatcaccctagacagtttgccctgtgtcccattccagttaaattacctttcctacacacacaaaggcaactactgttctgatttttgacaccagagcttagaccaactattatttaacgtcatgtaaatgcaaatatgtagtatacaatcttctgtggctggattttttttcactcaacattttttttggagattccttcattttgttgcatgtatcagttgtcttattttgaattgctgagcggaattcccttgtatggatataccataatttgttcacttattttcctgttggtggatatttggattatttctggaatttggctcttaagaataaagctgctaggagcattcttgcacaaggcattttgagaacatattttcatttttcttgaggatatacataggaataggtttgttgggccatagaaaaggcatatatttaattttataagaaacagtttccaaagtgtttttccaatttactctcccaccaataatatctgaaaattccagttgctccacatctgcagcaacttcaccaaaaaatactgtcacgtttaaaattttgttcagtcattttaatgtcagatatttatatagcaattcaatattttactttatgatattatccatatttatcccattcacatcatttctctcaaacagtaactacaaggagattaaggaattatgctagaattttttatttatttatttatttatttttttagacaaggtctcactctgtcactcaggttagagtgcagtggtgcaatctccgctcacagcaacctctgcctcccaggctaaagcgatcctcccacttcagactcccaagtagctgggaacacaagtgcgtgccaccatgaccagctaattttttgtatttttggtggagacagggtttcaccatgttgctcatgatggtcttgaactcctgagctcaggtgatcaatccactcacctcggcctcccaaaatgctgagattacaggtgtgagccaccatgccctagaatttttttatgtgtcttctggggcatgtgcatatttaataaacgttcttatcatcattaaaacaaactgattatatacttagaattttcatagttactaagtgtataaatcatatgtgtcaggtaaatattttggggagacactttataatctcatcattatgcttgaattgtttcatttcaagccaacaataaactattcaaattcactcaaaattgggggtaaattaacttagaaatttctataaagagacggggaaatttcatataatgagataggaaatattaagtttaaatgcctcaaaagaatgttgcatattcctatagtacttctatagtctgcctgaactcatcatcaactttctcccttccagatgatgccaccagtccccatttctcaacacgtcatgaagggtccttccaagttcctgtcctgtgtgctgtaatgaatgtggtcttcatcaccattttaatcatagctctcattgccttatcaggtgggtctacacttcatcaattctttcaaagcctcctagctgtaagcattcatgcccagctgaaatcaatattagtttagtctagttaatcagaaactagctaattcagaatcatcccatgtaccatatatggccaatttcctaatcaatactaaacataattccacaatccttgaataattaatgtaatacttttataagtattaaaagtatctatgatttatatattactgtagaataaaattgcatttgaaaagatgtttacatctagaatgaagggagctgatttgaattctgaataaatacctatttagctagaaaaaaatgtgaacttcacattcattgattatggaaaaaaatcgtatctaaagccatagattaatcaggaagtggccagtcttttgtgttttatctcaaaggacacagaatggtagttctgaataattaagattatatttaaaagttcccagagagtcagtagtgatttggtattcaatacctccagctataccaagatatatttgtatcttttacaaatgggaatgtttaccattgttttgagatattctgagtcatatgtctttctgtattttgaattggttccctaaaagttagttactctctccatctttccagcctagtgctataaatactgcatcttcaaattcttccgcctctgcattcagattcaaaaccttatttgaaatgtataatgcactttatcctttctagtccaaagaaatatctagtccaaattttcagaattgttctatatttctgtcattttctgacattatgaccaaaagtacatcccctcatcctcatatctccatccaatgatgattaggcacaatggaagatcagatatggtcctgagaactttctttcttcatacccttttcagaattctactttttagcttttatcctttactttatcaccacctagcacaacatagcatcctaaggctagttttgcatgctgtgggtatttggtttcttttgttactaaaacaaagcatttttctgttcacagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatggtaagaataaaaaaaagataaaatactactattttaattcatatggctaatcagtgctttccttccgtttctaagtggagaaaacaaacaaacaaacaaacattgtacctatttcagatgtaggaaaatgtcatcccagagaaccatatgatcagcctgaggtcaaaatgagatttaatttaatcttttaaatttgatttgattgcttagcttcaaagaccagaaatccaaatatgctgatcctatatagaatgagtacatggtcagataagctgtcatgcctcaagttgcagcttttgagaaacaggatttactatctacttccccagaagggtgtttaatgtaacaaactcctttgtgctttctttaagaactttctaaaacgatacgcaggtagagaggaacactgggttggactgaaaaaggaacctggtcacccatggaagtggtcaaatggcaaagaatttaacaactggtaagtctccagaagtctctttatattccccagggtggcatctcaggaaaatcactttccttttctcctttcaaagcactttaaatataaaggctgagctcttcaagagctctaacaatctcttctgaatgcgtatactctggaattctttaataacaggctttattattattctttttctttatccacacttataatacataaaataaatgcttatagtaatttttctcagcaaactctaatgtgagtagtagatctggttaatttggaaatatttcaataataattatgatgatgcaacaaaaacccattttcaatgtcacatttagtctttactaataagacagttgctggaaaataaatccttcttactatttctcagttttcatctccacagaataaagaatagtttcaatgcctaattatgagtttctatacacctgaaagaaaatttgccccagaattagatactctattttcattacctttagttaaaatacatttaatgtttgaagatcattttataagtttgctgttgatcataatactgataaagtatcgagattaaaattcaggtttctagaaaagggattcctaatatttgtcctatggctccatatccacagatgggcttcaggagccataaaccccttaaagctgtatgcactagtatgcatggctgttgaatgcatataattttgtgaaattatttattgaaaaatctatgaactcagaaatgaccaagaatcacttatctggtgccatgccaaccaaatgaatggcgtgctttcctcttacttccatattttttctccacatcctattttttttcaattcttgtccattgtctctacagattagtctatgattatttgacttgtgtatcccactaagaatttaaaagaagcagaggtcaccatctccgagttcattctcatgtaactgaatgaaaacaatgagctgaaaataattctaagtttttttattgtttgacaggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactattggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaatggtttccaagaaagttcattccttcaaaatacattaaaaagtatatactatatgagaaagcagaaaacagagttactataacttagaaaaaaatcccatgtagagtaaaacccttagttttataatagcttatacatatcaaattgttttcatatgcttatatgctaaagggtgtatgtatccatatccatttttctgtatatagcagatgctctgtaataattactcctcatagtcaatgctctgaaagtatcttgttcaattctgaggtgctatatacactttagttatttatgtaaaataattcaatatatagaaaagaggcataatcttcatgggatatttcaatcagcaaaaaactcaatgatgtagtttggatgtgtgtccctgcccaaatctcatgtcgcattgtaatcccctttgttggaggtggggcctggtgggaggtgattacatcatgggagcaaatctctcatgaatggtttagcatcatcctcttgatggtctccttgcacctgagtgagttctcaggagatctggtcttttcaaagtgtgcagcactttctctctctctctctctctttctctctctctttcctgctttctccatgtgacatgcctgctcccactccacttcaccttccaacatacataaaagctccctaagcttccgcggaagctgagcagtgtcagcattatgcttgtaaaaactgcagaaccgtaagccaattaagccttttttctttataaattacccagtctcagatatttttatagcaatgcaagaatagcctaatacatttgattaccttcaaaattgttttataaatgtaatttgcaatattcttctctgcttgttggaaatgtatgatgtgtatggtatctctaaactattggcaaacggcaaacagaaatgtggatttcagacactgcttagtgaaaaataatgacctctgtgctcctgagttcccacagctgtgggaaaaaagaaacaagcagcctcctagcggtaatattctatcattaccaacaatctactcccgagtcatcttagaaaacaatgtcttgcgattaatattttagttataacatatttttatgtgcataaatctaatcaaattatgaaaattgagagcaagcttaaaaatatttctatattagtatgacacaatttttaagtcattgaatactgactgtatcacctaacaattcaatgaattttatcatttttacaaataattttattgaatccctataattatgtgaaatgagcagctgatgtatttccctttccagaggaagaagttgaaattatgttgaaaaagcgacgcaaaacacggataacagagttattttttacacataatttgaagtcattttattcataaggacaactgttttctttaaatagataaaaaatatacaattcttaaagggaataatgttattatttaaagtatgactctacttgcaagtgaccaatgacaaatataaaaaatgggtttgtctcaagaacccctcctgcccccggctaagtcccctgttacaaaagttgcagtgccatctagtggttatacgagattactgcacttctgttttaaggatcctacaaaacatctatgtggagcgtggagctgctgagacccaaagcacgggggccagaccgcccgagtttcatctctgccacgcgcgggctgactagctattttatcagaactcgttcaaaattcagctaaaattagttagatgttaaattagttagtacatgaaaacaaacttaaaacattatctggctccctagtacaccataggcatgtattaaatactcatgatgattattagaactagaaacactatgtcttcaaacttccagtattggcataaagccgcgtttctacacgacatgtctatttctacgtaatatatcttatttgtatttgtttttggaaagccttttaaaaatttcatttcacaagttataagtaagcacctactacta

SEQ ID NO: 16171 - DNA, 29401 bp, Human
gtcatgggttctatagcttactgtgaacttagacatattagttagtccctcacccaaaatcatctgaaaaataaaggtaatatcagcctcattagttagttatgccaattaaataagaacacatatttaaatctcatattaatgtgtatggagcatagtaagcagtaataacctggcatgttgtcatgccaggctagtaacagtaaaagtaatagtagtttcactggaaggtccaagattagtgtggaaattccaagatgattagtgtggaaattccaagataagtgtggaaatttcaatttatcagggtttaccttttgtcccctttaagctaacaatgaaattataaaaggatataaaagggataagcctgacagttcatatccacttctgtgtatgataatataactggagagacatcaaactcatgctgagaacaactagaagagttagaattgaagaaaaaggatttcattaagatattagagagtgttcaaggcaactggaggcagaacgaagattctggaaaggggccacagagaagtgagtcagcattccaggagccacccttctcttaggggcatcttggcagtgggtcagatgctgagattctggggagagggctgtggataccaggcatttttttgggggagagaaaaatctcttcctaaagcacttgaaggaccaaaacccccagagaggagagagggccaaagaaatgagaaaaatttttctctcaagcaattttcaaattattaaatttcacaggaaaggaggttaggaagaactatgtgaaaaacagacttgaacttttggcaatcacatgttgttcaggagacaaaaccaaattcaacttccaagaaagagaagcagctttgataaaaagcaggttctcagatggaattactagaaggctttatcataggtcctaggacaaactagaaatgatgaaatagtaaagaaaaagatatataaaatcttacagaaactggaactcagtcctaatgcaacttcatttctatttgataaaggcaatagctgtccaatctggaacttatttcttacaggtaaggggggctactgtatagaattcaaaagcagggaaaatatgttgtcagagttaagatagagattgtatttggggtaatgagcgttgcaggacatgagtagggcacatagcgtgttggtattgttttacgtggttttaagatatacttcatctaggcacttgttacatgttatatttttaatgaatgtgtttagttgtatgcttatgatttgtgcacattactataaattatattttagtaaaaggtgcccttactggcatttatatacaagaaatcaacacatctgacaagaagctcttgctgctaaagagcctctgtgctcctggatcatgccagagggagcacagaagctgcacaccgttcaagcccatttttgaaaagttgttgtagcagccatagcagcaaattcccaaaatatcttgaagaaattgaaaacaagatattttttgaatgagcgtaaactcttgggaatgaattttaatttgagattaaaattgctgttgtctttacttacctaacattcatttcctctgagagccaactccttcctttcaataaattcttattttctatcataatattgctttgtaccgcacaaaatacaattataatttttaatagtcaaagaaattttaagttatcaaacattagtttctttcgtaaccaaaatactgttagagaagtagcttcaactttttaaaattcttacaaacaccagtttattctgttgtgatgagctgatttttgaaacaatttatgcttcatttgttcctctagctatatttaacttaaaggcttgacattttgagttactggggcggttacacacttacacgttttagtcgttgggctttttttttgttttgttttgaatcattcttggggttgaaaacgtagagactgtggtttagatcactcatagaaactggaggcaaaatgcatgacagtaacaatgtggagaaagacattacaccatctgaattgcctgcaaacccaggtaagaagctgggctctacagagtaagtgtgaggactggaatgggaaggtagtggtagtgatgggctcacacaggaaaggtgctgatctagtaaaaagttttcaaggataagagatggaatgtgggagtccataaattggcttataatttgtgtaaaacatgcatatatttatattcccagttctaacaactaaggagagggaacaatgagagaaagatgtaagacaatgagataaggttaagtttaggattgaaaataacagttaatttcactaaaaaaaaatctatacaaactctaaagtgttactcagatacaagataccatcattattacataggtagaaaacctatcatggaagctcttaagagagaaaaggtagaaaatagtatgtaaaggacatttacaaatcaaaaaagtaacaaaggttgagtagaaacttagtagggcattctaatggaattatgttacattggatgcactggaaatatatatatatatatagctttatatgatgctttagtaagtgaaaaaaatgacttttgccacagttagggaatatcaaggttttataacttaggacttaaaagtttggagttttctcctcccaacttaaaaggtaatcaatttggagaaaaggtaattcagaggcagaaaaagatgaactctaaatgttgttaaatgacttcatttatttcttcattcattgggtattttgagcattttataccaaatgctttaaactgtttgtcggatagttccaacatctctgtcatgtcctccttggcttgtgttttctttccccatggaagttgacattttcgtggttcttcatatactgtgtaattttggattgtaatttgaacattttgaacaaatatttagttagactggatcttatttaaattttggagtatattgatactattgttttagcaagcaatcaccctggtgagatgaagacaatctgtgggatctggttccaatgtcagttccattctgaaagcctttgtagtgctattcagacatgtgcatcaaccaggggtgaaattgggaactgtgcaatgctctactcattagttcaggtcttagcatctttagtgtgccaattagaaccatatctaggcatgcataagttgaggggcaggtgaatccaggagtttataaataatgttcatgggtctctttctaaagtttcttcctcttcaccatctgacccgtactttcaggttcccaggggcttctcctttccatcctccagctagaaatgcgggcctccttttattctgatgaaccatatacttctgcaattatagctgcatctttaagctcatgtggcagacggacagtgagaaagaagaaaaaaaaagcaagaggtttggccccactctcatggagctacagctcaactgaatggaaaggattgactttagatttcttttctttttttgaggtggagtctcactctgtcgcccaggctagagtgcagtggcgcgatctcggctcactgcaagccccgcctcctgggttcacgccattctgcctcagcctcctgagtagctgggactacaggcgcccgccaccaggcccggctacttttttgtatttttagtagagacggggtttcaccgtgttagccaggatagtctcgatctcctgactttgtgatccgcccgcctccgcctcccaaagtgctgggattacaggcgtgagccaccgcgcccggccgaggattaacctttctcaaggttttggctattgcatgttgctgtagtttcccctaccatcatcagattgcctgaggtttgaggcacatgagaatgtagacaagagggggagaaaaaataaacgtggtattttcacactctatttgagataggagtttgcttttctgttcctcagaccatacctctagtgcttctcctggagccctctctttatgctgacagaggctcaattccatgtttctggctgtattaagttcggggcagtgatactagaggagggaaatttaaattcaccactggtttgatggctctttaaatttggatattcttgtaagatctgctgctagtatatcctttttccttttgctcttttttgttttgtttaaagaccatatttttagagccattttgggatcacagcaaaattgtgagaaaggtagttttttttttcattttctccttgttgccacacatatatagactctgtcttagtctgttttgtgctgctattacagaatacccaagactgggtaatttataatgaacaaaatctattggctcatagttctggaggctggaaagttcaagactgagaaacacatcttgctccatcatcccatggcaaaatttggaagggcaagagagcacatgcataagaaagagagcaagaggcaccaaacttgcttttataacaaatccactttcgtgatagtaaacccactcccattataaggacattatgacctgattacctcttaaaggacctgcctctcaacactattgcattggggattaagtatctaacacatgaactttggagacacattcaaaccatagcagtctctaacatcaacattcttcaccagcagcacatttattacaattaataacctacattggcatattgtagcactcaaaattcataatctgatggacttccctttgtcagtgacctgacctttctccctggctgcccttaatattttttcttccatttcgaccttggagtatgtgtcttggggttgatctactcatgaagtatcttattggggttctctggatttcctgaatttgaatattggcctgtcttgctaggttggggaagttctcctggattatatcctgaagtgtgttttccaacttggttccatcctccctgtctctttcaggtactccagtcagtggtaggttcggtctttttacatagtcccatagttcttggaagttttgttcatttcttttcattcttttttctctaatcttgtctgtctgccttatttcagcaagagagtcttcaagctctgatattttctcttctgcttggtcaattcagctattgatacttgtgtttgcaacatgatgttctcgtgctgtgtttttcagctccatcaggtcatttatgttcctctctgaactggttattctggttaacagctcctgtaatcttttatcatgcttcttagcttctttgcattgggttagaacataatgctttagctcagcgaaattcgttattaccaactttctgaagcctacttctgtcagtttatccatctcagcttcagccttgttctgtgccctcacaggagaactgttgcgatcatttggaggagaagaggcactctggcttttggaattttcaccgttttttcattgttttttcctcatcttcgtggatttatccacctttgatctttgagactgatgacctttgaatggggtttttgtggagtcttttttgtagatgttgttgttgttactttctgtttgtttgtttatcttctaacagtcagcctttctgaggcaagtctgctgcagtttgctggggatccactccagaccctgttcacatgggtatcaccagtggaggctgcagaacagcagattgctgcctgcttcttccttcagaagttttgccccagaggggcactggcctgatgccagccggaactcttctgtatgaggtgtctggtgacccttgttgggaagtctcacccagtcaggaggcatgggatcaaggacccgcttatgtagagaatctgacattcccttagcagagctggtgtgctgtgctgggggaatcccactcatcgggttcatctggtctcttcagagccagcaggcagaaaagataagtctgctgaacctgaaactgcctctcccctcaggttctctgactcagcgagatgagagttctgtctgtaagcccctgaccagagctgctggaattcttgcagggatgacctgcctggtgaggagggatggctcagggtcccacctaaagaggcagtctggccacaacctgccacagccagtttgctgcactgtgggaaatctggcccagtccaaacctctcaggctcctttgcactgtcaggggcaaaccgccaactaatggtggtcacccctccccccaggaacttagtcattccaggcacactccagactactctgctggcagcagggatctcaagccagtgggtcttagcttgcagggatccatgggagtagaacctactgattgagactgctgggctctcctccttggcttcagccccctttccatgggactggatggttctcgtgcctcactggagttccaggcaccactggagtatgtaaaaactcctgcagctcagtgcctgcctaaacagccaccaatgggagtggctgtcattggtttgcccaggtttgtgcttgagacccagggccctggtggtgtaggctcatgagggaatcttctgatctgcagattgcaaaaatctgtgggagaagcatagtacacctggtgggtaggacagaccctcgccacttcccttacctcagggaggcaagtctccccaccctgtgcagctcctgggtgaaatgacaccccacctgctttcttcctgcttcctgtgggttgcaccagctgcccaatgagatgaacttggtacctcagatggagatgcagaattcacctgccttccgcattcatctcactgggagcttcagaccagagctgtttctgtttggccatttgggcccctcccttcaagtatgttttcttttgtaagaaactgccaaagtggctgtagcatttcgctttcttaccagtaatgcatgagacttctggttgctccacatccttgctagtatttgatattgttaatgttttaatgtaacacttaagtaatatgtaatgatatctcattattttaacttgcaattctcaaaagacatatgatattaataatttgtcatttcattattttgattatgtcttttgcaggttgaaagtttttagttttaatgaagtccagtttatcagttctttctttcatggattgtgcctttggtattatatttaaaaagtcatcaccatacccaaagttatctaggctttctcttatattatcttctacgagttttacagttttgtgttttacctttaggactatgatacattttgagtcattttggggaaaaatgtaaaatctgggcctagattcatttatttgtatgtgggtgtctagttattcagcatcgttagttgaaaagactgtcttttcttaattgtattgctttgcttgtttatgaaagatcagttgactatatttatctgggtctatttctttttagtctgctactctgctttctatcctttttcattaatttatttgtctattccttttttttttttttttttaagagacggagtctcactctcttgcccaggccggagtgcagtggcgcaatctcggctcactgcaagctccgcctcctgggttcacccaccattctcctgcctcagcctcctgagtagctgggactacagacacctgccaccacgcccggctaatttttgtatttttagtagagacggggtttcaccgtgttagccaggatggtatagatctcctgacctcatgatccacctgccttggcctcccaaagtgctaggattacaggcgtgagccaccgcgcccagccttatttgtctgttctttaacaaataccacactgtcttgattactgtagttttagagtaaatcatgaagtcaggtagtatcagttgtttaactttgctcatctccttcaataatgtgtttgcttttctgggtcttttgcctatctatataaactttagaatcagtttgttgatatttatacaataacttgctgagattattattatcattgcatttaatctgtagattaagctgggaagaattgatatcttggcaatgttgagtctttctctccatgaacataaaatacttctccatttatttagttcttcattgatttccttcatcagtttgtagttttccacatatagattttgtatatattttgttagatttatacctaagtattttattttttgaatgataatgtatatggcactgtgttctcaattaaaagtccatttgtttatttctggcatatagaaaagtgattgacttttgtgtattagccatgcattctgcaaccttacatatcagtaaccttgcatgtcagttcccaaaattgtcaattattttggattttctacatagatgattatgtcatctgcagagaaatacagttttatttcttactttctcatctgtataccttttatttcctttatttccttttcttgtcttactgcattatctggtacttccagaacaatgttgtaaagtattggcgagagggacatctttgccttgtccttgatcttagtgggaaaacttcaagtttctcaccatacttgaggatgttagctgtaggttattgtagatattctttattaaggtgaagaagttcttccctatttctagtttactgggagtttttgtcacaaatctgtgttgaattttgtttactgaaagttatcacaaatgggcgttgaattttgttaatttttttgtatatattgatataatcaagtgattttttttagcttgttaatgttatggataacattaattgatttttgaatgttgaacctgccttaaatagctgaaataaatttaacttcatcacagtatataattctttttatacatcattggattggatttgctgatgttttgttaaggttttgcatctatgttcatgaggtatattggtccatagttttcttttcttgtgatgtcttaatctgattttcctattaggataaagctggcctcatagaatgagttaagaagtattctctcggctctaacttctaaaacaaattatagacaattggtataattttttccttaaatatttggttgaattcaccagtgagtccatcttgacatggtgctttctgttttggaaggtcaacttctgtaataaatgtaaacatatttaggtcatctatttctccatgtatgagtttagacaaattatgtctctcaagtgattgatcctctgtgtggacatagaactgtccattttagcatccatgggatctgtagtaacaactccttatttatttctgatatagataatttgtgtccttcctcttttcttcttaattagcctggctagagccttatccatttttttttttttaatctttcaaacctagtttttggttttgataacttttttctatcagtgtcccattttttatttctgctctaattatttcttttcttctgtttaatttgtacctgatttgctcttctatttctagtttcctaaggtgtaaacttagatcattaattttagatctttatttttttctaatagatgcattcaatactatcaatttctctttaaacaatgcttttactgcatcccacaaattttgttaagctgtattttcattttcatttagttgaagtattttaaaacttctattgtgatttcttccttgacccatatgttgtttagaaacgtattgtttaatctccacatgtttgtggagattagtgggattttaaaattttctttctgttattgactctagtttatttacattgtggtctgagagcagacgctgtatgatttctattttgttaaatttgttaggatatgttttggcccagaaggtggtctattatggtgattattccatgtaatcttgagagtgtgtattctgctgttgtttgacaaagtagtctatagatgtcaattatattcggttaattgatgatgttgctgagttcacctaagttctactgattttctgcctgctggatctgggcatttctttctttcttttttttttttttttttttattttgttgtttttgagacagagtctcgctctgtcacccagactggagtgcagtaatgcaatctcatctcatttcaaccactgcttcccgagttcaagcaatcctcccacctcagtctcctgagtagctgggaataccggcaaataccaccacacttggctcatttttgtctttttgtagagacagattttaccacattgctcaggttggtcttgaactcctgagatcaaataatccagccttttgggcctcccaaagtgctgagattacagtcatgagccaatataccctgctggatctgtgcatttccaatagagtgttgttgaaatctccaactatgataatgaattcatcgatttctccttgcagttctgttaatttttgcctcacgtagttaaatactctcttgttaggtgcgtgcacatttaggtttgttatgcggaaacataacatagtttcttggaaagctaattcttataccattatgcaatgcttttcttcattcctgataaatttccttgctttgaggtttgttctgtttgaaatttgtatagcttctcctgctttcttttgtttgtgccagtatgatataatacatatatatattcatgatccatttacttttaatttgtgtgtctttatatttaaagtgcatttcctgcagacatcatatagtttaatctctgatttttaattggtgcatttagatcattgatattaatgattattaatataggtggattaaatatctaccatatttctttctgttttctatttgttgcctttgttctttgtttctatttttgtttttcattctcttcttttcagagactgagtctcattctgttcattaggctagagtgtggtggtataatcatagctccctgtacccttgaaatcctaggctcaagtgattctcctacctgagccctgagtacctggtattacgggcatgtgccacaaagcctggctaatttttatttaatttttgtagcgacagagtctttgctacgttgcccaggctggtcttgaacttctggcctcaaatgatcctcctgcctcagtgtctcaaagggttgggattataagtgtaagctacaacacccagccatgtcttccatttttttcctgcatttttagtttttaacttagcatttataaagttccatattttctcattcttagtatatcaattatactttaaaaatgtgattttagtggttaccctagtgtttgcaatatacactcacaactaacataagtttgctttcaaataatactataccatttcacaggtactgtgagtaccttataataaaaaaatctaattctctgcttttatcccatgtgtcatttctgttatttattttatttacatgtaagaatacataagcatataaatatatataaaagatgtatacataagcacacataattaaatatattgctactattgttattttgaacaaactgccatttgttagatcaattaagaataagaaaaatagttttattttaccttcacttattttttatattgttcctttttcatataatttaggtttctaacctgtataattctctttccttttaaaataattgcatttaacttttttgttttttgatataagacaagtctactggcaacaagttatctcaatgtttctccaaaatagtggttgtttctcattcactttgaagaatttttttggctaaagaattctaagttgataaggttttttctcttaatactttaaatatttgtttccactgtcttcttgcttgcatggtttttgagaagaatgtaaatgtcatttttatctttgtttctctacatgtagaatttattttcctctggattctcttatgatttcttaaatctttgataaagggggtacaggggcatatgtgaactctatatttttaattcagtatttctgtcaacttaaactgataaaaactaaaatctattgattaagacaaatatcttgggaaacatcaatgtaaagcttgctgatctctctagtgttggggggaatgttggagaaaaatatgcctatttagctaaggacaaacctagataaattaactagaggtgtgaattgtatgcaagagattgtgtcagaacagggttccaataatgaacttcataagaggttttagataacctaagacattttgaaatataacacaactacaggaaattatacaatacaaatatgtagcttgattaattattataagataaacacctttgttgactcctgatatggcctagctgtgtctttacccaaatctcatcttgaattgtagttctcataatccccacttgtcatgggagggacccagtgggagataactgaatcatggagttggttaccctcgtgctgttcttgtgatagcgagtgagttttcatgatatctgatggttttataaggggcttttacccctttgttaggcacttctgtctcctgctgccatgtgaagaagaacacgtttgcttcctcttccaccattattgtaagtttcctgaggcctccccagccatgtagaattgtgagtcagttaaacttctttcctttttaaattatccagtcttgggcagttcttcatagcagtgaggatggactaatacaactgctaacattgtctaagaaagatccttgttatgtggctcagaggccctccatgtattcttaactattcactctcctatccttccaagaataacactaatttgacctctacaataatcactttatcactccagttttgccttttttcctccaaaacaatgccttttaagtctattttaatcgatagatttcctcttaatatcatttaaaaatatttctttacatttttagacaggaatcagaataatttgctatgttgaatttccagttacttggattttgttgatttcattcctgtggtttagttgacatgaatctctccaattgaaagggtaacttgaatatggtagctggaaagttaaaatcaattcttttaactttggaaaatgattaaattctggagatagaatagtaagttcataagatgacaggtcatttgcatcctctagtgaaaagcgaaggaattaaataaaaataacattttgatgcttaatgtttctggcagtattatgtctgtatttaattgttaaaatgtttttcaataattttttccaggttgtctgcattcaaaagagcattctattaaagctaccttaatttggcgcttatttttcttaatcatgtttctgacaatcatagtgtgtggaatggttgctgctttaagcggtaagtgaactgtaatctttattcatctagagagaattatacttgtaaaaagaagaggaagaatctgaataattttgttattctttacagcttttaatatattgtctcactaactgagttacactccaataactttttaagtggcaccaaaaattttaattatgtaaatagggttcacattattccaagtttagtgagatgatcagagtcttcagaaggtagaagacagaccactattccttaagaatattgatgcaaaaattaaaaaaaatagtaaactgaaaaatagtctcttgtccgatctaggaacatggttaattttacctccacaacaaccttgtttcatgaaaaatagcaaaacagatggtttaaagtacacaaaactactaagtggctgtataacatcacaggcagcctgttctttcttcctagctatttgagcatgttctggcccttgttttttttagcatatgtagcccatcttcctagaaaacaaactccgtttagtgattgtaccctaaaagcaattagctataaaaattatcttgtacttcaaaacatgcttgcagtgcatctaatatagaccaagcgaagacatagaaaactacaaaagcacttcccccaaacctcatgccaatctggatatcaacctaaaatctaccccctgttactacattctgaagtaatttcagagagacccttcaaatactgcttacgtaacttaagagtcagcaatacttggagcactccatataacactctaaataatttctattcatttgcaaatcttttgcttattatcttttggcattttgaaaccacagataatatactttatacatttatgaagcaaaaataatttttttatttcagagatttaagtcaactaattgtaactatttaagaaagaaaaaattggaaagagacaatttctgtactctgtaagtacctcagtattaatcaagggaatgtattctgaaatataatttaaatttatagctcttttttttacagtaagcatatgaaattgacacttatgactgttttcctttattatccattatgtgtttctcttcctttcagctagcactttggaaatgatttcttgtgtggagccaatagctggagccatcttctaatctggtcattttctttctttctttttttaaatgtgttattatgtattactttatatcatttttatgttttatttaacatttagattgttagttaactattcaagtgtggtatttccccatttaaatcgagttatttagattggctttagttataaaaattcctaatagagctttgtagttatagctctggtccctaactttttttttaaattatactttaagttctgggataaatgtgcagaacccgcaggttcgttacataggtatacacgtgccatggtggtttgatgcacctatcaacccatcatctatattaggtatttctcctaatgctatccctcccgttgccccccaaccctcaacacgcctcagtgtgtgatgttccgctccctgcatccatgtgttctcattgttcagctcccacatatgagtgagaacctgcagtatttggttttctgttcctgtgttagtttgatgagaatgatggtttccagtttcatttgtctccctgcaaagaatatgaactcattcttctttatggctgtatagtattccatggtgtatatgtgccacattttctttatccagtctatcattgatgagcatttgggttggttccaagtctttgctattgtgaatagtgccacaataaacatacgagtgcatgtgtctttatagtagaatgatttataatcctttgggtatagacccagtatttctggttatagatccttgaggaattgccacactgtattttccaaaatggttgaactaatttacactcccaccaacagtgtaaaagtgttcctatttctctacatcctcttcagcgtctgttgtttcctgactttttaatgattgtcattgtaactggcatgagatggtatctcattgttgttttgatttgaatttctctaatgatcagttatgatgagctttttatcatatatttgttggccacataaatgtcttcttttgtgaagtgtctgttcatatcttttgcccattttttgatagggttttttgttttattcttgtaaatttttttaagttccttgtagattctagatattagctgtttgtcaaacggatagattgcaaaatttgtctcccattctgtaggttgcctgttcactctgatgatagtttgttttttgtgtttgtttttttttttttttttttgtgcagaagctctttagttaaattagatcccgcttgtcaatttttgcttttgttgcaattgcttttggtgttttaatcataaaacctttgcccatgcctgtgtcctgaatggtattgcctaggttttgttctcaggtttttatggttttaggtcttatgtttaagtctttaatccatcttgagctaatttttgtgtaaggtgtaaggaaggggtccagcttcagttttctgcatatggctagccagttttctcaacaccatttattaaatagggaatcctttcccccattgcttgtttttgtcaggtttgtcaaagatcagatggttgtagatgttgggtgttatttctgaggcctctgttctgtccattggtcaatatatctgttttggtaccaacaccatgctgttttggttactgtagccttatagtttaatttgaagtcaggtagcatgatgcctccagcttagttctttttgcttaggattgtcttggctatacaggctcttttttggttccatatgaaatttaaagttttttttttttttaattctgtgaagaaagtcaatggtagcttgatgggaatagcattcaatctataaattactttgagctatatgactattttcataatattgattcttcctatctatgagcatggaatgattttccatttgtttgtgtcatctcttatttccttgagcagtgatttgtagttctccttgaagaggtccttcacatctcttgtaagttgtattcttaggtattttattctcttagtagcaattgtgaatgggagttcactcatgatttggctctctgtttgtctgttattggtgtataggaatgcttgtgatttttgcacattgatttcgtatcctgagaatttgctgaagttgcttatcagcttaataagttttaaggggatgagacaatggggttttctaaatatacaattctgtcatctgcaaacagagataatttgacttcctctcttcctgttgaatacactttctttctttctttcttttacctgattgccctgactagaacttccaatactatattgaataggagtggtgagagagggcatccttgccttgtgccagtttacaaagggaatgcttccagcttttggccactcagtatgatattcgctatgagtttgtcataaatagcttttattattttaatgtatgttccatcaatacctagtctattgtgtgtttttatcatgaaggggtgttcaattttatcaaaggccttttctgcatctgttgagatcatcatgtggtttttgtcattggttctgcttatgtaatggattacatttattaatttacatatattgaaccagactttcatcccagggatgaaactgacttgatcgtggtggataagcttttgatgtgctgctggattcggctggccagtattttattgaggatttttgcattgatgttcatcaggaatattggcctgaaattttcttttttgttgtatctctgctaggttttggtatcaggatgatgctggtctcatataatgagttagggagaattccttctttttctattgtttggaataatttcagaaggaatggtaccagctcctcttcgtacctctggtagaattcggcagtgcatttgtctggacatgggcttgttttggttgggtaggctattaattactgcctcagtttcagaacctgttattggtctattcaggaatctgatttcttcctggtttagtcttgggagggtgtatgtgtccaggaatttatccatttcttccttgcctgggtatcaccagcaaaggctgaagaaaagcaaagattgctgcctgctccttcctctggaagcttcatcccagaggggcacgcaccagatgccagctgagctgtcctgtatgaggtgcctatcaacccctgctaggagttgtctcccagtcaggaggcatgggggtcagggacccacttgaaaaggcagtctttccctcagaagagctcgagcactgtgctgggagatccactgctcttttcagagctggctggcaggaatgtttaagtctcctgaagccgtgaccacagccaccctttcccccaggtgctctgtcccagggagataagagttttatctataagcccctgactggggctgctgcctttctttcagagatgccctgcccagagaggaggaatctagagaggcagtccggctgcagtggctttgctgcactggctttgctgcactgtggtgggctccgcccagtccgaacttcccccagggctttgtttacactgtgaggggaaaatcacctactcaagcctcagtaatggcggatgcacctcccctcaccaagcttgagcatctggggtccacttcagactgctgtgctggcagcaagaatttccagccagtgggtcttagcttgctgggctctgtggggattggacccactgagcaagaccacttggctccctggcttcagccccctttccagcagagtgaatgattctgtctcagtgggttccaggctccactggggtatgaaaaaaactcctgcagttatcttggtgactgcccaaatcgccacccagttttgtgcttgaaacccagggttctggtagtgttggcactccagagaatctcctggtctgtgggttgcaaaaaccgtgggaaaagcgtagtatctgggccagatagcacctcacagcacagtccctcacaacttcccttggctaggggagggagttctcccaccccttgtgcttcctgggtgaagcagcgccccaccctgcttctgcttgccctctgtgggctgcacccacttgtgtaaccagtcccagtgagatgatcctggtacctcagttggaaatgcagaaatcacctgccttctgcattggtctcactgggaactgcagaccagagctgtttctaatcagccatcttgccctctctggtctggtcgttttctttaaattggttgatacaggagcagtgatagcacaacaaatatgcacagatttggggaaagtcatcctgccttatggtctggttcaagaaattacattttaatagttataatttggtatcaccttgtttgtgataccaaaccagatacaatacacgtttgcctcatgttatgatttgttattcagattacaccagttattattcataactaagagtgatttctcatctcacaagagccaaatccaaggataatggtgccaattgatagtaatgattctatgaatacccagcattctggtctatcatagacactttcagaaccattgagttgaaggtagaaggtggttatataatagaagatgaactggtagctactaggggctcagtgacaactatctggagagacattcattcatctcgatcccacatgaagagagcatttctcctgattatataagaagtgggtcagaaaagcctgtccagtgaagtattgctgccttcaaagtgtagaaaacctcactacatctccttagtggaaggaagttcactgtacaacaacttatttcatatttatgatagtatttagacatatacaaggctttttcacatcaagaaaccttattcacataaggcatctctatcctgcccttcattttaccaagtcatctggagcagcaatcgccaaccttgttggcatgagggaccagttttgtgaaagacaacgttttcatggactggggtcaaggaatggtttggggataatttaagtgcattacttttattgtgccctttatttccattattattacattgtgtaataatatataataaaataattatacaactcaccataatgtagaatcagtgggaaccctgagctagtttttctgaaagtagatggtaccatctgtgagtgatgggagacagtgacagttcatcaggtattagattctcacaaggagcccacaacctagattcctcacatgagaagttcccaatagggtttgccctcctatgagaatctaatgccactgctgatctgacaggaggtggagctcatgaggtaatgtgagtgatggggagtggctgtaaatacagatgaagcttcacttactcattcgctgcttacctcctgctgtgcagcctgcttcctgactcatccatggaccagtactgatccatggcctaggggttggggacccctaatctagagcacttggagaactatctgttctccaaagctgatcaaatgctatcattaatgtatctaatattttaagaaagggtaacactgttgagagccaaatagatacatggcccagagcaagcttaagttactaataactcctttttcagctcaccccctgctgaaggcatgagtttgaatctcagttttgccatttgctgtgtaatgtatgcaattatatttagcatcatatttctcacttgaaaaatgaaaataatacatttaatacttaacaggagtgtcagaaagtatattagcacttggtaatttatacaatacaatataaaagtaagaaatttttattttatttatttttattttattttcagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagaggtaggtttagacatctgcttttacattgattttttttttttttttgcataacgaaagagtaacctagcatgtattatattttacagtgaaccatctaaaattaccttaatattcgtggcaggaacaggcccagagggcaagcaagccagagccttctttgacttgtgagccagaattgtgcaaataaggattagaaaagtattggtagaaacccagttttaagtttgtatgaagttagcaacattgtttcaaaataaatcaaacaaggccaagagcagtggcacatgcctgtaatcccagcactttgggaggccaaggcgggtgtatcacttgaggtcaggagtttgagatcagcttggccaacatggtgaaaccccatctcaactaaaaaatacaaaaattagctgggcatggtggcatacgcctgtagttccagctactcaggaggctgaggcagcagaattgcttgaacctgggaggtggaggcctacagttagctgaaatcatgctactgtactccagcctaacagagtgagactctatctcaaaaaaataataaaataaaaacaataagtcaagcaagaatgatgtcatagagattggtagactaaaaagctacagaaatctgttcctccactgagaaaactattgaactgtcaaaaactgtctgaagtaactattttggaattctcgagtctagttaaacactggaagcatcaagggaagagtttgataaagaggatgataaattttggttaatgttggtgaatttcagcctttccactcaataataactattttccataccccattattgcagggatccatgggaactgctgcccatgttcttgtaatgaattcctgcagccagggtgaacaataagcacctttttgtccaaatatcagggttattgctgatttctgcctttgaatgctgaggggcagacacagaagtgggctatcattacatcagtcctcatcagctgaagtggcttcccaaggatttaaataaatagtatgtgtttttcctccctttaggaagcagtcatttaagacaatttttattagataactggctgacagcagagataacagaacagagatttcaatgaccatgcacaacagagaataaaaatagttgggaaaaaatcatgaccaaatgactctgagccacaacaaccaagatttgacaatccctgaagagcaaaataattaagttaccagagttaccacaacatggtactcataatgtccagttctcaaaaaaaaattacaaaacatgcaaagaaaagtatggttcattcacaggaagaaaaagtaatctgacagaaactatccctgaagaggctcagatattaaaaatatgagtcaaaaatgttaaatcagctgtcttaagtataaccaatgagttaaaggaaactagacaaaaagctaaaggaaaccgaaaacataataaatgaacaaaattagaatatcaatataaaggtagaaattgtaaaaaagaaccaagcaaaaattccagagctgaaaagtacaatgactgaaatttaaaaataattttaaaaactcaatgaagaagttcaacagcagatttgagaagtaagagatcagaaaacttgaaaataagataattgaaacaatccagactaagaaaaacaaagaaaaagaatgaagataaataaattctaaggaacctgtaggacatcagcaaacatactaacatatgtactgtagaaatccaggaaagagaagagaaagagaagcagagaaatacacttaaagaaataatgaacaaaactttccaaaatctgaggaaatacataaatatatacatccaagaggctcaatgaactccaaaagggtaaacttaaagagatctacattgagacaaaatatagtcaagttgacaaaatccacagagagaattttgaaagcagccagaatgaagcaactcatcatttacataagaccctgaataaaattaatagctgattttctctgagaaaccatggagatcagaaggtagtggaatggcatatttaaatgtctgaaagaaaaaataaaactgccaaccatgaattctatgtatagcaaagttgtccttcaagaatgaaggaaaaagtaacacattttcagataaccaataattaagggattttattaccagtagacatgtgctacagaaaatgctaaaggaaaccttttaggctgaactgaaagtacactagacagcaattcagagcctccaaaataaagaatattcataaaagtaacaatagaggtaaatataaaacccagaattactacatgtgtcatatagtttataacttctcctatttatagctttctatatttatatttatctataacttcataggcaaatgaataaaaattataaatatgatagtggtcatataatgtataaagatgcaatctgtgacagtcttatgaagcagggatgaagacatataggatcaaaatgtttgcatagttattgaagctatgttgatattatgaaattatattgttacaagtttaagatgctaattataattctcaaggtaaccactaataaaattaccaaaattatgcagaaaaggaaaaaagaaaaacaatacactataaaaaaccaattaaatacaaaaaatgtcagtaacagacaacttgagaaacaaagacatataagatatagagaaaacaaatgattaaatggcaaaagtaaatcttgttttagtaatcacattaaatagaaaaggatgaagccatcctattaaagggctgagactgacaagttggctaaaaactaaaataaattaaaaagaaaaacaagactcatctacatgctgtctataagagacttgccttagatataaggacacaaagaagttgaaagtaaaaggactgaaaaagatattccatacaaacagtagtaaccaagatagtgccgagtggctatatttttgtcaaacaaaataaactaaagtaaaatttacaagagaaaaagaagggcattatgcattgacaaaaattttgacatagccaaataattatctgttataaaatatatgtacttaataatacagcctcaaaatatatgaagcaataattgctataatttaagggagaaaagaacagttctatgaaaagttagagaatgaaatattccactttcaacatgagattaaacaactagacataagatcaataaggaaatagaaaatttgaacaacactataaaccaattatccctaacaggcatatacagaagaatctacccaacaagagcagaatattaattcttctcaaatgcacatggaacattcttaaaaataaaccatatgttaggccacaaaacaagtgttagtaagtgtgaaaatttgaagtcataaaaagtatcttttgcaattacaatggaatgaagctagaaatcaataactagaaaaaccagaaaagtcacgcatatgtagaaatttaaaaacctgctcttcaacagccattggtcaaagaagaaatcacaagggacattagaaaataccttgagacaaatgaagtaaaaatacaaatagcacgtttatggtatacactgaacatagttctaagagggaaatttatagctgtgagcagttaactaaaaaagaagaaagatctcaaatccatagcctaactgtacactgtaaggaactaaaaaaagtaaaacaaaaatagaagtcatctttatgatttgaaagagtaaaagatttacctaataagtccctaaatttactaataataaagaaaattgtttatatatttaattgcgttaaaattcagaacttgtaatcataaaaaggacagtacacattgacaaggaaacacagcaaaggaaaccagcctatgctgctgctgttgtgaggataatttggtacacttacattagtttggtgtcttttctttctctctctttctttctttctttctctttctttcgttcgttcgttcattcgtttctttttgagacagaatctcactctattgcccaggctggagtgcagtggcgtgatcttggctcactacaacttttgtctcccaggttcaaatgattctcatgcctcagcctcccaaatagctgggattataggtgcatgccatcacgcccagctaatttttgtattttttttaatagagagggggcttcatcatgttggccaagcctagtctcaaactcttggcctcaggtgatccgcctgcctcggcctcccaaagtactgggattacaggtgcctggcctggtggtgtcatttcttaaagttgacaaaaagcatatcctggggcctaaaaattctattctaggacaggtgccaagaatgtcatagtagcatacattccaaacttgataaaaccctggtgtcaaccgatagtataatagataaattggagaagagtcatacaaaggagtacaatacagaaacaaaagtaaccaaattatcaacaatttctctcagttttaaattatcttcttttgatatgtatgataatatagcacacctattctgtatgtattactaaacaatacaaaatcaaaaggaagaaaattatgagtagttaagaatatagcatagcagcaacatttctgggagaggatgggttatgttagattaatgaatatcatctctgtgttttctgaaagaatttcctgttgagatataaaggcccatctgatcactggattgggctgagcagagaacaaggccaaccatggaaatggataaatggtactgaatggacaagacagtaagttctaaaaatctggcagtaatatttgtatttgaatttactttgcattaaatctgaagtgttctctagttacatgctttaaaaaattctcattttaaggttagtcatgaaagaagatggtgccaacttgtatgttgcaaaggtttcacaagttcctcgaatgaatccaagacctgtcatggtgaggtagactgactgtgaacttggctccaggcttatctatgtcattttcaaacactttcattttaagcaaaccatacaatatctttaagtctgttccttacctccacaacaaaattaaattgcacttgtcctcctgatttcacagggttgatgtgaggaacagaggttttgatgtatcagggaaagattatgagtgacagcaattatacctattatttaaaataagacaatagttttaaaattttaaaatgggtaaagtttggcactagaaaatttaatctcaattgtatatttataggatcttcagattactaaaaagatttgagataatgctggaaaaattggattcacacaatttcactcaatgtttgtctgagagatgagacagttttgaaaagctactttattgtaatacattcatcaatattggaaatataactttatttaataaaaagagccccagactggacattggcaggtttgaaatgagttttttctcattagcttttgaccttggatgggatggtaagttttagaaatcagagaacatgtacatttatacattgttgtatctacactgccttgcacattgtgactgcttcataaatatctagaattaacttttatttcttattttacaatacggaagtagtaaattttctctacctaattcttaaaatggttttttgtttgtttgtatttttgagagacagggtcttactctgttacccaggctggagtgcagtagtaccatcgtggctcactgcagccttgacttccctggctcaagtgagcctcccatctcagcctcctgagtagctgggactacaggtgtgtgccaccttgcttggctttttttttttttttttttttttcagcgatggggtctcactatgttgcctgggctgatcttgaactcctgagctcaagcaatcctcccacctcggcctcccaaaatgttggaattacaggtgtgagccaccatgcctggcctctcaaaatattttaaggatcaaatatattattaactaaccagtttttggaaactgctcatcacttaaagaaatgtaaaatattatatgattaaggtctaacaagtttcaacaattagcaaattatatcatagatgatagtgattccaatgagcaaagaggaaaaatttataatccaaatgctgacctaaaatatctgtgccaagccatctaaactcagctaaatagcactgcagtttcagtactaaaaccaccagggaagtaggaggaataaaatcaagcatggtttttagaaatagctgctgagtcttcagttatttaaggaagcaaaatattgggaaactgtgtaaagaaaacgtgtcagacttctcccatcagccagctaaggctttggatgtacttgaaagaatattatgcttacagacatgaaataggtttgattcaggactttgcagtattcctatagttgatttataacatctcctgctaagcaaagcccactgactaattagtcaccactacacaaggaaaaacagcattatttttagaggctgaattaatgttagttttctcattttctcatcttcattctctctgctgttgaagaaatgttcagtggccaactgattctgcttcttctcttgcaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgctgctgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatatcagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatataaaaaaatagaatattattcagccttgtaaaaagaaatcctgttatgttgggaacaagccccccaaaatctggccataaactcacccca

SEQ ID NO: 16172 - DNA, 11544 bp, Human
gagagatacagtacatggaaatcattcacctgtctacgtacaaaaataaatagaaagaacagaggccgggcacggtggctcacgcctgtaatcccagcactttgggaggccgaggcgggcggatcacgaggtcaggagatcgagacaatcctggctaacacggtgaaaccccgtctctactaaaaaaaaaaaatacaaaaaattagctgggcgtggtggcgggagcctgtagccccagctactcggtaggccgaggcaggagaatggcgtgaacacgggaggcggagcttgcagtgagccgagtgagccactgcactccagcctgggtgacagagactccatctcaaaaaacaaacaaacaaaaacaaacaaaaaaagaacaatcagagttggcagctcagaaagagttaaagaggtatatacatatatgtttactgtgtgtgtgtatgtgtgtgtgtgtgtgtgtgtttaggtatcttaaatatttaagcctggagttcttgaagtaaacttgtatttgttggatttttatttctaagtcagtgaactaagatgaaaaaaaggacaatgactgatggacgtattctcaccaaacagggttctaaaaacttagaacctctaacttccaaataaaggtggttgtgttagtaatgaaagtgtagtaataatccctattgcacattctgtcataaatttgtactctctcaagagaaaaactaaaagcaaacccctaatctcctatattttgaggcaattttacatgggggaaaaatagtatcagacaggtttcttccagaccagctttttctaacactaaaaatgaatagatttcaagtaagcaaaggatttttaaataaatcacttcaactaagatttgcatacagtctggatgaagtagattttacgcttatattcttcagtgaggatttatagctcaacaaatttgttggtgcaatgaaagcagctctaggcacacaatgcaaactgaaaagatggaaagttttgacttcataaaaactgagaagtcaaagtagtcttttctttcatttttttctgttgttggttgaaagcccatcttttacaaaagggtttatctatagtaatattataatgcttgaacataaacaatatacaaaatataatacacaaaacgtttatttgagtgtctgcttttgtatgggggtgcatggtagattgtatttccagatactaaatcatggatcgaaatctctcctttcaagattcttattatagccaatctcttccacattggaaatttgacctgttccacatttgatattcctattaacaaggttactcttctgtagatgaaaaagtgtatatcgaagtatcagtatagtatctgaattagataacacactaaacaatataataatgtattagtaaaaataaggaaaataaagaagctgaagtcgtgcttaaagaactttaagaaaatgaaaattgaggtgttgaaaaaagcttttaaggctaacgtgaatgaggcgtccaagtgggaaacccatccagttctacttttttgaactttgcctgtcgtggccaggataattaggtagagatcagaagaacagagtgagacatggaaatcccaatttatgtgaccttgggcaaattacttagctctgtatgcctcagttttctctttgatagattgaagatatttatatatctttactatcaagccatttacagaaataaatgagctaagatatgccaagtgctttaaattgtgttaagtacaaggtaaataataaatgtttattattaaaagaggaaaattctgtaagtaattttgttatgctaagtaaatttacctttggtttgcccatcatttccttcattttccagataaccctttaaaatgaatttgattttcaaacaataaaaaacaaaacagcaacaaaactccctctgacctcctctcaccttctttagtccttgccaaagtgttaatattgcaaaagtactgtgagaatttcctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcaggtatgtgtgatttcagtcactaaattaaaaataaccagaaaagctatttcttggattggctgattttggggtaatgctttaagagaaaaggacatgattaacagtggatgtttttaggattttcatgcattagcactttccacattcattatattttcctgattcttcattgtataacttagacatgatttcatgaagttttttccacaggtttgaagagtggtttctgacagggctacctttaaattctgagtgagaactgaactttagcctggttaaattgtgagcaacagtgttctagtatagcaatagaaaatgccaaatattaatgacacaatgctgaaaaggttttaattgactatttatgttgtgacatccaaaaattacacaaatgaacagtttgacacattgtactgttgttaatgacatcactctttgagagtgtgttcacgttagcacagaatctcctaatgttgaaatgttttaggtgaaaggcctaaaagcaagtaattttgagtatgaacaaatggaatgttctaggggaaaaaggattgtttatgtatgttcaatatactgtgaaatgaagccaggcctcaaagttgttacccatcaatttgttatcagttatcacaccaagtccagaatgttcctatgtcttcttttccctataatatctctacgaaccaatgagcagctagacatttatcagagcaaaacctgcactgagatgaggagagggcatactctcaactagtattattgtgacaatggtagactacgttgaatgaaagattcttgagctagacacactttcatgtgatttctgacttggatacttacttgctttgataccttgagaaaataacattattattggaccttatgttttctcatctatgtaatgagaaccatactatctatcttgtgattttgttgagagaataaaaataaatgcctgttatgtaagtccataaaacacaacgtggtgcttgttaatatcttctacctccagatctttaagcacctctgccaatttaaaataaatggtaaattcactttactgcaacagagctggtagagaagaaaatgtttgaataatcttcctgaagaataagatacatcacataaaaatgttggtattgggtgaagtcccgattggaaagtcttcagtgttttattggcaagatgactccgttatcgaatgaaagaatgttgtggattctccgtcactagtttctgcttttaagaactcagctcctgagtttgctctttaagtcattactctgtctgtctttctctacagtgtttaagaccactctgtggaggttaatttctgggaccttagggataatatgcctttcgttgatggctacgttgggaattttgttgaaaaattgtaagtttttctaagcaagtctccataaaaatcaaaactgtgaagacatcatttaataataaaggcttcatcttgctaatgtgtaatattttagtatttcataaacccatacctaattaaacaaatttctaatcatttcttatagcttttactaaactgagtattgagccagcatttactccaggacccaacatagaactccagaaaggtaggtcacattttttggaaaacttagcattggtaaaagattaaataggcagtttcttgtttttcacacagagaggcatgatggaatattatacttagtaatagaaatttgcctaccagtgtaggatagtctcattttacattgctcaatctaatgtaaaaatgattaaattacactgaatgtgtatcatttgtacatttaactaatcaggaaaatagtagcctgaaacgaaagatatgtttcctatatgagtgctcataattaagtaacaaaaaataaaccacaggaaatgttacagttaatcctcattacctgcctgaatttgcttataacctatacttttgcatctcactacttttccttttccagaatatactgcacagatttctaaaccttacttatccagtgaaagccagctcaaagtccaattttcgtttttggagatggagttttgctcttgtcgtccaggctggagtgcagtggcacgatcttggctcactgccacatcagcctccctggttcaagtgattctcccaccttcctgcctcagcctcccaagtagctgggactacaggcgcccgccaccatgcccagctaatttttgtgttattagtagagtcagggtttcgccatgttggccaggctggtctcgaactcctgacctcaggtcatccacctgcctcggcttccaaagtgttgggattatgccgtacccagcagagccactgcgcccggcctcaattttctaaatatgtatttttcggaatgcgccccaagttgtctcaccatcatcttgattatatagtgtttatttacagtgcaacatcttggccaggcacagtggctcacgtctgtaatcccagctctttgggaggctgaggtaggcatattacttgaggtcagaagttcaagacaggccaaccccgtctgtactaaaaatacaaaaattagccaggcatggcggcacgcacctgtagtatcagttactcaggaggctgaggcatgagaatcacttgaacctgggaggcggaggttgaagggagctgagatggtgccactgcactccagcctgggcaacacagcaagactctgtctcaaaaacaattaaaaaatataaaaataatagtgcaacatcttcagcactacttatatggcaaagatttgagtgcctatgacgtgtcatgtttttattaccgtgggtaacaaacgttgaagacactattattgataaactgtataattaagcctcaagataattggtttatttatattcccttttcaaaaataagatatccaaacatatatcaaaattctccaaatgtaccatattcttttctgactcagaaagtatgctaaaatgttttcctcctttaaatctttttcatctagttaactcctatttatgctacagtacttagttttgagtcacttcctcaaaaaaaggttcttgtaactgcccctcatcttacactctgctacatgctgttttaacatacttaatttttttgtacttatctaaatcatcactaaatatcgttaataaattattgaaaattatataattgtaattctatctctagaatataatctccatgaggaaaaagcatcatgttcatgtctaattagttcacattagtagcccctgaagtgtggtgtatacagtagattctgaatgttaaaagaatacacagcaaataatttttgaataattaaatagcattgaaaaaaatgtctagtctccagtgtcattagtcatgctttatgttttctgtcagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggcatgtgctgagtctgattttctacattttctttgatctagaaaaatatactatctaaacaagttaaatactttggtttaagtcattaatcacatagtaagtggatggttatattggaattgagttatctgttctgtgtaccttaaagtagtcattgtaaaatctttattaaattccttaatgattatatcatgggaatacaaatcaagataggtgccaaataaagtgaaagaaacttttcaggaagaattcaaagaagataataggtcattatatttacccattttatttgaagaaccaactaaatgactgtgattcttaactcttttaattgaatttataatatcttttataattttatagtttttgtcatctttctgggatataagctagtatggaaatatggtaagaaaacgtacccaattcttttcttttcttttttttttttttttttgagacagagttttactctgttgcccaggctggagtgcactggtgcaatttcagctcactgcagcctccacctcctgggttcaagtgattctcctgcctcagcctcctgagtagctgggattacagacacctgccaccaggcctggcactttttgtatttttagtagagacagggtttcaccgtattggcgaggctggtcttgaactcctgacctcgggtgatctaccctccttggcctcccaaagtgctaggattacaggcatgagccaccgtgcctggccctaattacccaattcttttttgtttgtttgtttgtttgtttgtttgagatggagtctcgctctgtcgcccaggctggagtgcagtggcgtgatcttggctcactgcaagctcctcctcccgggttcacgccattctcctgcctcagcctcccgagtagctgggactacaggcgcccacaaccacgcccagttaattttgtgtatttttagtagagacgcggtttcaccgtgttagccaggatggtctcgatcttctgacctcatgatctgcccacctctgcctcccaaagtgctgggattacaggcgtgagccaccgtgcccggcccctaattacccagttcttaagaaaaagtgcggccgggcgcagtggctgaaacctgtaatcccagcactttgggaggccgaggagggcggatcacagtcaggagatcgagaccatcctggctaacacggtgaaaccacgtctctactaaaaatacaaaaaattagccgggcgtggtggcgggcgcctgtagtcccagctactcgggaggcggaggcaggagaatggcgtgaacctgggaggcagagcttgcagtgagctgagatcgtcccactgcactccagcctgggcgacagagcaagactccctctcaacaaaaaaaaaaaagaaaaagcgaaaaacttctcctgctgcacgtggcacctttgcggattataggttgagtagattatacccatgggattcctccttcacaataccatgattttggaatcaaatttaatctttgatcccccgtgaagaaagtgttccatgaaaactctatctccttttagaaggtttttaattcttcaggaagtgagattttgtggtattttttctccatatatgaatgggcctgataaatgagaactttcagtcttgtgattataccttttaaataggaagttaaaaataatttccgtttgtgtgatggacaggctgaatcttattctaaacactgactttccctcaaaatatgttattcccagaatagattaaaattagattaatgtgattgtcttttacttgaagcaggattttatgagctccagtcaacaattttactggattggactctcttacagtgaggagcacaccgcctggttgtgggagaatggctctgcactctcccagtatctgtaagtttctggcaatcatggcgttttttgctctttatgaatttgtccttaaatgtgactagtaaaggtaacatccaggagcactgtggctgaaataaccttgtctagggcatgagaatacagtaaaaggaaaaagtacaacaaaataacaattttagatctaggcagatctaaaccactctaagtgttaaaatcaaaacagaagataatgcctaatgaaaggaggtcggggtataggatagttggtgcaaaaaaatactgataaccattacatgcttgcctgtattattttaaattttttaattaaaaatatattattttgtagtcacatggacaacaaaaccaaaacattacaaatctccagaaagtgcaatgcataagctctcttagttcaaattaaacatttgaaaggtattatatttcatcctatatcttttgtcagttaactgaagtgcatttttcctaaatcaatcttcatacaagaatgtgaagagggccagggatggtggcttgagcatccaagttaatgctcaagtgacatgaaatttagtgtattcgtggccataaaagaacttttaacatatgctttatttttgccttagtaccagcacttggaagtatatgtgcatgtacagatactcatatacacagaggcagtccaaaaaaatagtatatttattattttatttattctggtagaccccaatattctcagcatgctcttatgttttatatactatagactcattgtctgtatgtgtgtactttttgaatctcattttcatttataaacatgagatttgcagcatcacacagggacaaagtttatgctctggtttgttttcctagactagattagataatacatcttaaataaaatagaagaaaagcatatcacatatttaaaccattaatgacaacagaaaaacagcaaggaaaaaatccctggcctcaatgctattgattagtgagaaaataactgggtattttgtagcattacactagaaaatcatgaaaattgtggttactgaaaaaaaaaggactcaatatgttagtatctcactcaaatgcttttaaaatttatatcatttaattgaaaaatgccctgaacattcttacttcctttttgtgtatgtgaacattttcttcttcattacagatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgaatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatggttatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggcggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgcggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgcatgtgaggacaagtaattattttctgtttttctcaatacattaattattagttcctccgttagttgtgaagtcctaattagggaaaaggagttaggctggcgggagcaggga

SEQ ID NO: 16173 - DNA, 11544 bp, Human; identical to SEQ ID NO: 16172

SEQ ID NO: 16174 - DNA, 11544 bp, Human; identical to SEQ ID NO: 16172

SEQ ID NO: 16175 - DNA, 11544 bp, Human; identical to SEQ ID NO: 16172

SEQ ID NO: 16176 - DNA, 41433 bp, Human
tcgtgaggaagcctgaagtcaatttaccatgctatcagcatggtatatgtgcacctacaaaaatattcatgtggttatcctcaatttgaccatacaattacattttatgtatttttatttattatttttatttttataaataaaagaaatgggggtctcactatgttgccaaggctcgtcttgaactcctggcctcaagagatcctcccactttggcctcccaaagttctggattagaggtgtggtccactgcacctggccaaatctaattttaaatggtttaagaaaatagaacaataaccatgccaccagcacagtttagggccttgcagagctttattccagacggaatctattatcttgaggtaatattttggtgtaataataaactccacaaagatctgtgtaattttctttctctatctttgataactatgactttaatttgtagtataatcacacacaatccatatagttagtaattatatggtactactaatccttttaagaaaacaacccttttgatacttatttttaaagttggagatatgacaaaatatttacattcagaaacattctcatcaagtggtattaatttcttttcttaaatttacttttaaatttgtcaaagtctagctattaattatatatatatattttaaaagcttgtccttaaaatccaactattagttccataataaaaattaaaatggaacataatggcacaaaatcctttattattctcgaattgagggttggccaattaatggcggatcacttgagcccaggagtttgagtcctgcctgggcaacatagcaagaccccatctcattttttattaaaatttttttgtattacattttatgttaaaaaaagaaaaagaaaaaagcaatctttttttctttttctttttttttttttttttgagacggagtctcactctgttacccaggctggagtgcagtggggcgatctcggctcactgcagcctccgcctcccaggttccagcgattctcctgcctcagcctcccaggtagctgggattactggcacacgccaccacgcctggctaattttggtatttttagtagagacggagtttcaccatgttggccaggctggcctcgaactcaggtgatccgcccgcctcggcctcccaaagtgctaggattacaggcgtgaaccacctattacaggcccatgggtggggctctatttgttttttccattcaagaaagcatgtcaaactccatcagagcatgggtgaattataaaaacataaccgtgcatgtctcctaagttattgtaggcttttatgcacgggtattactaagaaattacttgcgccacacctcactacttaatggagacatgccattttattttgcatccatggttaagaacctctgctatacagaagggtcctaaacgtcatgttatgattatgaaaaagaattgcatgcataaccgagcaattggaaataaaaaagaccaaaagaaaaaaaaaagaattgcttaagtaatcagaaaaaaaaaatggcattgttaaagagttctacaattgagtttgaatgcaagaggagacaaagtgacaagccctgggctcttgagctagtccaagtttaaagagttcgcttggggattccttcacagtccccagtggaaccagtgaaaagagcgtcatggctcccgtgtcccctgaccctccattcaatcaaaagcaacaggcctgaacaatcacggaacaaaaacctcattgcccagcgtaaccttccaaccccggagctgtatgggccgctaatccgccgcacaaagcgggccgctgctcttttcttctcccgcgcccgggcccagcgtggcgcccaactgctgatcggctctggaacgtcccagcagcgcgccgggggcctccggtgtttatttagcgggctgcgggctgcgccgggggcctcctggagagccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtaagcggcggccatcgggggaaaccgaggcagggcgtgggccgtcccggcggcgcggggctgggagcacgctgctaccatgcaggggtggagcgccgtctctggtcccctgtcgatcgatgacctcatccctgcacgcaggtggcacatttccttaagctaagactggcttctgttttgatggcacgtcacagtttacacgaagttgtatcatttacttttcatctatttttaaattttggtataacttacatgttataaaatgcacagatttgaagtgcatagttcagtgagttttgacaaatgtatatacccgtgttaccacgaaaacaagtgagatatttccactacccctgaaagttccctcctcccctttcccagtcagtcccctttgccccagaccggaggcacccattctgatttctatcaccatagattgactttgcctattctacagttccacaaaaatagaatcttacgggatgtactctattgtctggcttcttttgctcagcacattggttttgagatgtaccgatgttatttaatccttacatacttatctttactgcacctgttttacagatgaggcgactgaggctcagaaaatgtagggatttggccagcaaggcccctcagctggcgaactgctgtcccgggactggaatttaggtcctgggcatgctaagtctaattgccttcatggcatagcagctgacacctgggaattatgctcagtatgtgtcctctagtgtcttgatactcaaagtgcggtccatggaccagcagtattggcatcacccgggagtttgctagaaatacagattcttgggcccaccctagaactccagaatcagaatctgcattttaacaagctccccaggtgattttcagtttaaaaagttaaatgttgactaagcagcactggtccagggcatggtctcccctcccacagattgagtaatgtgttaaaatcacataggagctgttaaaaaaaagatgcaatttgtcaacattttttcaagttataaatgtgtgtgctctttgactcagaaggctactttgaggaatgtattataggatgcactccagcaggtgtgcaatggcatgcctccaccaatactgcagcaggtacactccagcaggtgtgcaatggcatggctgcaaagatactcactgcaacaggtacactccagcaggtgtgcaatggcatgcctgcaaagatactcactgcagcaggatctgcaataagcctggaaccaaataaatgcccattaaaaggagacaggtgcttcctccatgtaatggaatactatgcagtggaaaaaagtatgttattgtcatgtagtcttttaaaaggggaggagagtagagttttttttttgcttgcataaaaagaatttcaggacacacacaaagacacacacacacagacacacacacaggcacatgccccaatgacactggctacctgagggagataagtgagtaggaactgagcaattgggagacagaggtgggaaggagacttttaacagaacatctttttatatctttaaaaaaattatttaactatgggctgggtgcagtggctcacgcctgtaatcccagcactttgggaggccaaggcaggcagaacacttgaggtcaggagttccagaccagcctggccaacattgtgaaaccctgtgtctactttaaaaaatacaaaaattagctgggtgtagtggcacacgcctgtagttccagctacccgggaggctgaggcaggagaatcacttgaatctgggaggcggaggctgcagtgagctgagattgcgccactgcactccagcctgggtgacagagtgagactctgtctcacacacacacacacacacacacacacacttatttaaccatgtaagatattcatccatttaaaattacataaatgaattttaaaatacagatgtctaggctctaccctggacctcaagaggggcccagaagcttaaacatttttaatgagtgccactggtcattccagccagatttgggaacccttggcatagggtagtcagaggatttctgtaaacctgctctatgtttgagttccagtttctcaatctgaatcttgggcaggttattcattgttgtgttctgaacacatttatcaaatcacatttattgattcgattcctgtcagctcttttgtcttggggtttaatctgtagaaacagacttggagctggtagaagggacctgaaaatccacttgttacagaacttcatggggaaactgagcctgggagagggcctgtgggtggcagaacttgaacctgggttttctcaccctgggcctatgctctttcgggaacactgtatcttgagataatccgttcttggactcctgcagcctaaggcccagaaataggacctcattcagatgaagctcatgttctccaaagcaaagggggaaagtgccctgtggctcagacatccggggcagcttgatggaccatcaagattccctggatggcctttgtgttggcattagaccatagtctactgtactttggctggtaagcatgacatccatgagtcctagttgaaggaaaggccatgttgggttttcctggtctttactgattgcacttggttctgagttatatgcccatcatgaagcagttccatcaggctctgtgatttatttaaaattcatattaatttattccctccctttgcccccttggagaagttttgacatttggattgtggtagtgggaactgaaaatcattatagaaatgctcatccacatccataggcacacacacatacacatacatgccaggctggagtttacattccagaggtgagttgatggctacctaaagccaggggaaaataatgcagcaatgggttagtatgtgcaggcttggttccatgccagtgctaggcatagtctctacctggcagttgaataatttcaaaatcaggtctttaacaggtcaaagactaaacaaaacactgaataaaacaagaatgaaataaaaacaaaactatcaaaatacaacaacagagtcaattattcaaattgttgaaaactaaaaataatttatgtaaaacagttaattgaagccagttttttcactttatgaatatacttatatgaatatacacatcatgaattctttgtagtgaaatcactctctctctctcttattttattttattattttttttgatacagagtctcgctctgtcacccagcctggagtgcagtggcgtgatctcggctcactgcaagctctgcctcctgggttcacgctattctcctgcctcagcctcctaagtagctgggactacaggcgcccactaccacaccctgctaatttttttgtatttttagtagagacagggtttcaccgtgttagccaggatggtctcgatctcctgacctcgtgatctgcccgcctcggcctcctaaagtgctgggattacaggcgtgagccaccgcgcccggaaatcacttctctttaatataatatctagacttgtctttacagcatgaaaattactcacaatatcaggttaatgtgttgatcctcaaacatgttcttaagctatggaaactcttagatatttccagcaggaaagagcaataagaaaattagattttattaagttttattctcaaagctaattatacatttaaaaactaatttctggctctgttattgcaacacacaaaataaactactaaatgtaacatcctgatgtgaaatgtaaaacttatgcagagatgtttagtttcctagatagaactcagcttcgcagatggttttagatctgggaatgcgtgcacattgcacatattcataattgttcttccttcagttcatgacttttccttctgagaacatggtggtgtggttttctagcacctttcatggttgcagaatacttgacttgaacccatggcatgggcatgcaagggcacagaaaactatgctttgtggattgggctcagtgttaattaggattgctttcaactataaaggacagaaactccaaactgacattgacccacttcagaccaattaggatggcaactataaaaaacaaaacaaaacaaaaaacaacagaaaataagtgtttgttaggatgtggagaaattatggactgttgatgggactgtaaaatggtacagccattgtggaaaacagtatggcagttcctcaaaaaattaaaaaatagagttaccatatgatgcaacatttccatttctgtgcatatacccaaaagaattgaaagagggttttgaatagctacttgcatatacgtgttcataacagcactgttcacaatagctaaaatgtagaagcaacccaagtgtccactgacaaaggaatacgtaaacaaaatgtggtcgatacatagaatattatacacccttaaaaaggaaggtaattctgacatatgctacaatatggttgaaacttgaagacattatgctaagtgaaacaagccagtcacagaaagaaaaatattgtatgattccacttacataaggtagttgggcgtgtcaaattcatagagacagaaagtacaatggtggttgtcagggctggggatggggagaatggggagttagtatttaatgggtacggagtttctgctttgcaagatgaggagttacagagatggatgttggtggtgatttcacaacattatgaatatatttactatcacaaactatatacttaaaatggttaagttggtaaattttatgttatgcatattttaccagccccccccccccccccccgccatacagaaaaaaacagaaaaagtgatactggcttacccaaaatgtcattggcttatccaaaatgtttctcacttgtgtaaggtctggttaagcagtttagtatgatactgtacagtatttgggacacagaaggttctgtgtggccttcaggaaggcagcattcatgtttctggctgcaggatggagggagggatggaaaatgagaagcaaagggcacacatacaccattacttaactaaaggtatctggaagctgccatgcagacttatgcttccatcccattggtcaggacttagtcacatggccacacctggctgcaaggaatgctggaaaatgtagtctcccttctaggcagtcctgtgcttgccaagcatcaagggctctaactcctgaagacagcaagaatgggcatttgggggtcaccttatagggaacaaggggaggggtcatttaggaaggaatcttctctctttagggttaaaattcccccagagggacgtgcctcagttgtcccagccgagcagaaaaggagctggggtacttatgctccaatttgcctcattcagagtttgtgggctgctcccagaggccctgactccctggcacgtccagcctgccccacccatttgcccagaggaggccatcgctgtgtggggagtgatgctgctgggaggagggaaaagtgtgcggagcatctgcctgagtttcctcatctttaatgcagcactaacaataactgctttcttctggggtgatgtaaggattaaatgacataatccagaaaaactgacaaattacatgtgtcagcaaataaaatactataggaaatccaagtacggtcaggttaatggtggtgtagattgtgcagggcagtctcccatctctgccactgctgcacttgggttatagataggctaggatataattccctcatccttggggtggctgggaataaggctgtaggggctggggttggtgccttcgggctgggagactcctattccgctaactgcccctggttaccccacgcggtgtgcaaatggtaccactttctgattgggaggcagtcagctaggaaatgcagcattcgttagctactactttaaaattaagaccctctccttaaaggagagggcatcgtacccaggttgaatttaatgctgattatgtgatccatacatgtgaaagcatggtagttacccaactctcacttatgtgtccaatttgcaggtatgaaaatgagtgcgaatgtcaactcctgctaaaagaaatgcttgaacggcttaacaaggtgagcggaacacatccttgggtttacgtagcttaattacagtgttgaatggaatggtggaagtgcaggttttacaggcttcctctttgtgttactttggcggtcactacttcttttgcagtcactctgtctcttgacttgttaatttcaattgagtctttatgagtgaactcacacacccatacacacacccctctctcacgagagaaacacagactatgaagcttgttggttatgctaggctagcaaaacctgccggcgttacagtgacaagctgctgttttacttgtcagacatactgatgcccaacaccaaatttaggaaggaccttgctttgggcagtggttatttggacacagtgatacctctgtcctattggctaagagttttgagattgcggctccacagaagtctcaagataacagaggaagaaatttctatttcctctagagttccctcttatagcgtgaccaatagccccaggggagatgccaggggttcttagccacttgactttcctgcagggttatgtggagttgctctttacagaacagtggtgatttccttcttgggattcttcatcatgattctaactaactgattggattttctgcttttgctgggagaatcccaccaccaaaaagcagaatgattctggaccaccagggttgtacagaaccagggatggcacatagctttaagcatggcccttttctgatcgtttttgagctccaatgtcagagcagaacgacccatggagactatttagtggaaaggctgcttgattagggcacatgggctgcccttccccgccccttccatgcctacaactcatcaaaattgctgacaaaaccgcagactcttccctgccatgcccaggtatgctttaggcttctttgccacatggaactccaagcagcctctttggacagtcagggttagcgccggatgtttgccatcccttcactttgtccagcctttgctgtctaggattactctgctggttgaggggaaaatcagaactagaatctaggggaaacccaattttgctttgtctatgttacctgcccctctgcgcgtgagcacgtatgatatgttcaaaccaggacagtgtgcaaaagagggtgcagtttgtaataacacaggtcagtcaatgcaggctgggactctcaggacagctagtaggacacttgggcaccctagatagaaacacagagatggcagtgagaatgcacttcaggaaggccctgaggacacacgctcaatagttggcttggaaaacgatggcctcgagcctgttggacatctgagctgggagttgggccttattagtgtctgacatcactctgctattctgctgacacctgtagctcatccccattcttctgttttgtgcaacctcagactgccagaacatggccttcagacacggggacccagcacccttcacagcacccctcaggccctccgaggccctctccccaacacttccacatgttgctttgtgagcatctgtcctcacttgtcactcacgcagtgccatcctgggtactcttcaaataaaggggagaaagaatggggttcctcttttacccttgatggaaaatgacagtgaatttaaaaaacaagcttaaactttctgttgtttttctctttttacaaaagcaatccatattctcagtagaaaaaataaggcaacatagataacgaaaaataaggaaaaggcatcgcataatacaccttcatgtatattgtgacatagagtgtggacatttgaagtatcagccctgtaagaatattatgaaggttctggggaaagatgctaccaagaatgtgggtgagaccagcacaggcaattagcatgactggcccctgggtccaagtaagacagtactgcccgcaggtgagctgcagagccccagcgaggagtgtagcctgtgactaggaacctcctgctacagctgagcatctgtgagactgtgggccaattgccttgtccctctgagcctcggttttttcatctgtgaaatggaatcacaatactccccacccaccataggagtgaaagtgcctagtgagaactaaatgatgtaataatgtatatgacttgcccatcacctggtggtgctgaatccctgatcactgttattactacagagcacttgatgtgacagacaccagcttggttttctccacagtgtgggtgcagaaccctgttgaaatgggaggtgactttagaaagtgcatggaggagtgatatttaatagttgtgaattttttatgattacctgttatttacagcggatgacataaaatattcctttccaaataaacctacgtaagaatgagtacctttaaagacaaatacagagtgaataagatgcaggtggtccttggataatagtagaaatcataaacacagcaggcagatgcaggacgctggggagggccttgtgcaagcctgtgggagcctcagaacagcccgtggttattgggggggcaggttttattctcagaaatgacctattccaaatccttctctgggccagtgaggaaactcacccttgatgaggttaaatgacttcagagcctcgcagctcagccgtggtaagtgtagacaggagttggggtcttttgtatttgtggttcattctctacctccaaagaatagtcagggaaccggtattactcagaggccagacacgaagccagagagttctcggctataggtggccccatggaccttgatgttggtgtcctgtccacacaccttgggccatgccagtggtcactcagacacgctgaacaccctgatcactgcctgcatctcgggctctgggaacatgcatggcccacatcagtatagtccagaagcgctgggtgttaacaccccaggaacaaccctcagttgctgtggactgggataggtggataagttccccacccctcatagtgatggttcagagccacattccacatggtccctcagagggaccccagccgtactgagctgtctacaatggcaacctgctcgtcacattccttcattggttttgtttccttctctggctcactagcctcccttacctgtgcttcctgggatcacctcccagataagccacaggtacccagtctttgccttggggtccacttctggagaacccaaatagtccctcaagggcagggccaggtgaacactggacctttttgttctctgctgagatcatcagatgacatgaaagaggctaaaattcacatcgcatcagctggtcgtgtgagtgattttggcctgcaggttttgggtattttcttacatcagatcaacgaggttttagctcagtctcagtggccatttcctttggtctgacttgtggaagggattcatccctgggtgtggccgtgggacatcactgatccagtctttgcatcctacttggaggatattgcagtgtatgtgaaaggactgatggcccctgccttcacaaaaccaccatgcatttcttcatgctgcccgtgtaatcaagcctacggaaagagctcctgtagttttatcagccagataaattatagtaggccactctttgctgtgcacttagaagtgaagtaaactcctcaacacgttacctacaacctatggccaaagttattcaacttctcagccttttgatgtagtaggaattccaggtgactttaaaatatttgggtttgctaacttctagatctcatggtcaccaaatatatacgtatgaagttactggtctgctatgatgcctgatttgcttatcttgaggaaactgtaagcagcagactttaaaatctccctctccttttctctttaaaattcccagaattttaaaatgatgtggtttctagtcaaatgctttcacttaaaaacaattttaaaaatatttaaaggctgacatatatactttttcatgtaattcatgtgtctcttaaacgtgcctgtggaaagcagcaagaggccagggagtttaggggataaaatggtgcaggcatgaagccctaccttcagggctatgcctttgtatgccaagaattcctctgagcccggaaatgaacttccggagaagagaaggagaggaaactgggaaggaagaggaggagtctgggggtggagaggcaagaggagtggaggaagagtcaggatgaatgcaaagggagagacagcaaagttgaggagactgaggcagaggcaagagagagggtggagagatgtagaatttgtccagtgccctccaggccaacattagcacctggaagaacagccataacatttttggaaaggtttttgacatccagagttgaaggaaaagtgttttttaattaaattccagctaactagaactcttaatgaacttaaatacccattctttagcagttgggttttaaatggagtttctgggatccctgtgaataggtcagcaaggctgttttttttcctttttaatccccaccatttgagttaaaaaagggctgattttcaataatgctccaaattctagttatttctccagctcctttctaaaaacatggctgtaaatagtctagattagtggttctaaaacttcagtgtgcatcagtgttacctggggtgaaaggtgggcggggtgggggggcacgttaaaacccagactcctgggccccagccccagaaattctaagccagtaggtctggcatctgctggagtatttgcatttctgatccgttcccaggtgttgtgatccagggaccacactttgaggaccactggtctagatctaggacataggcaattatcagagttggaatgttttgtaaaattagactattgacccataatctcaattcagaaaaatctagatgattctgctggtgaagcttttgaaaattcagctgacaacatccacagcataataaaaacacaagcgtctacacatttctgagttctggcgcaaacaaaagaaaacacttccaaaacaaattttcctcagcgtatcagcagctgtacattccagtgggccctactcacctttgggggttttggggtcagcttatcgggtgattatcttcaaagcaggacagtgtgcttgcagaaacatctgcttaatccctattttaagaatacatattgactggccttttactatcactatgagcagttataaagatttaactgatgggacccagtgctggtggttttgacacaatcctaggagggaggtggggaagaatgacaggcacctcgaaggatggagtcagggcttagcactcagctcttggctaggagagagaagcccatggtaggttccaggcctgttatcttccactaacttccattcacgagttcaatgatgcactgcatcagtctggcctcagccctgcatacatggagggaggctctggacttcaaggtgcatttggcagagccctcatgttgcatcgagttgcttgaagggtctctgagggaagagggcagctgagcatgggagatgcctgtggccccttggctttgcttcagtacagtggcttccatggactgctttgttcaaaggatggcacatgtggcttaacaaaagtttgaggaccagtgaccccagggttccttctatttctaaaatttgtaatgtttgattccttataaataataacacaaagggtccttgaagccctgtttccagtcattcagctttgtggctcaatcttggatgcattttgttaagagtgattgagaattctgtgccccaccccatcctcagcagtcttaagaggggcagagggaagatagaacaacatccacccaatactcctgcacctctggcccagatttagccaagcctctctgagggtgtggtcccatccccggggctgagaatcactccacagggaaccactgcctttgaagggagtgggatgcgtccgggaacactgtgattttccttcacatcgtgtggtccagctgtcaggcaagatggtggtcatgtgacccatgctggccaatcacagctctcctgagggagggatgcagggatgaactgattcagagctgggtcactctgaggacaggtccttgactcctgctacttagattcctggaactgccttggtttccgtctttcctgaggtctggctggtattttacaaatgaaccagggtttttctgaatcctccacccttttctgttgctggaaagattcaggcttccctttccaccatttctcttatgaaagggcttcccaggcttgtgaaatacttctgggtatttcagaagaccagacaccaggatctccaaggggcctgcccacttcccctgcggtaggaaggccttgatttgcatgagtgcatcagtctgggtctgatcgccccgggccgggtagcgcacgccttctggaagaagaaacgctatagctgagttttcattagaccctccctcactgtccctgggtcgcaggatgtgaggacccatcattaagggctcagaatggtaaccccctgaaggcagagctcgttaaaggtcaatggctaattaattaaacacatgaatgagctcagaagctaagtcccatagttagatttcatattcttgtagtttggacagttcagtgtcctggatctggaaaaatgtgtccctttttgtaatttggttcattcttttatttctgatttaaaacaaaaacccccaaaaacttcagaccacgtgtagatttgttgaagggagtggttttcccaggagctcttgcttctcccagtgggcagtggtgctggtggcagcaggagcccggtgccagggccaggaatcaggaggagccttggagagagtaggcaggagagtccaggggccggggtgaggaatgactctggacactggtgtccttccttcttctgtcgagagttccttacctggggattcaccctgcagcagaaacctggaggagcactgaggaggaacaagatgttccgttgccgaaaattgctcccatagagccgtgccatgcagtatggcagccaccagccgcatgtggctgtggagcacctgcaatgtggggagttcgaattgagatgtgttatgagtgtaaaatacacagcagtttcaaagacctcatctgaaaacaagaatggaagatatctcactactaacttattgattacatgatgacatgataatattttgggtatactgggtaaaataaaatatattattaaaattaatttcacctgtttctttttattttatttaaagtggctacttctagaaagtttaaagttggccaggcacggtggctcacacctgtaatcccagcactttgggaggccacggtgggtggatcacctgaggtcaggagttcaagaccagcctgaccaacatggtgagaccccgtttctaccaaaaatagaaaaattagctgggcgtggtggtgtgcacctgtagtcccagctacttgggaggctgaggcaggaggaaacgcaaaaggaaatgattttgtttgtttgtttgttttgttttgtttgttagttcatgtcttttattaactcatacagttccttgtcttctggtttgttgaagcagtaagtcagacaacatttgccacaataatgtctgtcatagtggcttgccataaacactccagcaccacattcatcagaagggcactctcgatgaaggtgactaattttgccattctcgtctaccttatagtatttcaggacagccagcttaatcttcttcctcttgtgcttattcttcttgggagtggtgtaagacttcttccttttcttagcaccaccacgaagtctcaacacaagatgaagagtagactccttttgaatgttgtagtcagacaaagcacatccatcctccagttgcttgctagcaaagatcagtctttactgatcaggaggaattctttccttatcctgggtcttggcctttatattttctatcgtatctgagggttcaaccttgagggtgatggtcttccctgtgagggttttcacaaaaatctgcattttggtggcagctccactgcaggtggctaatggaaaaggaaggaaatgttttaagatacattcctaagggttgcacattgactaatttgatcttgtacaactctcaagttctgtaagataaaatcttcagttctcttgggtagataaaagagcttcagaagtttgagttgggtgagggttggccactcccttaccatcttgctaatgctttagaccaaattcacacagaaagagatttgttaaatattaacatttattgtgatgcaggcccccaaggtccatacaaccttctctgtaggctccatgaagtctcagctctggtgtcttaggtgctaagagaacactttgcatggaaagctcattgaaggcagaggctacaatagagtcagaatttcaggatccttcttgtcagcatcagacaatcagaaatcttactacaccagtggtctttcacaagagcaattaaggaaccaagtgccttttatttttattgaattaattaattaattttttttgagatggagttttgctctttttgcccagactggagtgcaatggcatgatcttggctcactgcaacctctgcctcccaggttcaagtgattctcctgcctcagcctcctgagtagctgggattacaggcatgtgccaccatgcccagctaattttgtacttttagtagagatggagttctccatgttggtcaggctggtctcgaactcctgacctcaggtgatccacctgcttcagcctcccaaagtgctgggactacaggtgtgagccaccacacccggccccaagtgcctttcttaagagtgcagtctcaaggccttgccagaccgaaaccctagtagcacaagggtggggagtgtccctacatctcatggccagtccacatatcgtgactgtcataactctgttcatgcgagtatggagagtgtctcttacatattttagtcagaccacgtgttccccttgattaatgagagcccattgctaagactcattatgtttattagcaagtcactaataagtcagtaaaaattcacttcccaaggcctcaggtgttggcaggtgtgcatggcagaggtatcttgggagactggggaatcctgatgaacccaagtaatgctcacctgtaatatcacaccgaagatgccaaagtatataagtcacttctggacatcatagcacaatcttattaagagcatgaataattctttcatacctacttggtctatccaaacaagatcaatgaggcaagagccagtgaattatcagaaagtttcctgagaaaattcaaccttttgtgatcaatgtcgtttccaaccttagaggaacaaacaaatgctattcacaaaacagtcattctaaaaatgcatttttgtatgaaagatgcatcttctcaaggtaaatgttaacagtccttgggagaaaactgctagaatacagatttcaggatttaagggaaaacaatttttttctttcagtcttagaaacccaactcactgatgatgagatatagaacaaatatagacgttacttaaatattaactttatttggtatgtaaatatacctagcgctccgatctttctagatcaaggttacttaaccctggctgtattgaccctttaggcaagggaattccttgtgtgcagggttgtggggggatgctgtcctgtgtattgtagggtatttagcagtgtccctggcctctacccactagttgccaatagaaggaccctaccactaaagtggtgacaactaaaaatgtctctagacactgccaaatgtccccttggggggcaaaatcaccctctgttgagaactgctcttctagaacaggtccaatgggctaagccattgccttgctagaatgcataatctcagacccctcccagacctactgaaccagagtctgcatttcagtaagctcccaggtggtctgtgtgctcatatacccggccagctttacccctatgctccatggtgcctgtggccagggatatgtggctctcattgcaggaagctgatgaagccttgctgcataacctacgccttcagctggaagcccaatttctgcaagatgatatcagtgcggcaaaggacaggcacaagaaggtaatcatgaccccttgaagcccttcctctagaaaacccagtttgggtttgatcaggtaagccgagggtactgtggctgaaaacagactgctagagtggcatacctttgtgcgttttccctcgaaccaaataggggtgaattggtcactggacagtgcttactgagctagatgtgctttgaagagtgggcagtagtgggtgtgttttgagggccctggtgttgggaactagtatctatattgtacagtataatttacaaagtgattttatatagatctgtcttcattaagctacagtccatcaactgtttccgctcagaaaatacatgaaaaagtcttgtttttagctctgcctctgagcccgttaattgcaggagcacattattcaggagcttcctctcctgcagtgctcagactcccccagcctccaacagttcctcacaggcctgattctggggggccctggcataattgaaaaatcagattctgcagctgtttgactatgggtgagtggcctaacctctctgagctgctttttcttcttcaaaatgcaaatgcaggctctccttcccagcagtgacgtgggtgaagtagtgtagcagacctgtgggtgcctcagggcttccctctccaggggctctggcctcctcccactgccatccctgcagctttgcctgaggactttctccaagcagctggaggctgctccgcctgtagtggggtgttggggaactcctgtccccaggagcagggagcagcctcaaccagaactgatgggagttggtgtataaacacaccagctccctctcgcctttgtagaccaactctgaggcttttgttctgcattggcacccagagatactcaccaggattgagctccaggtgcccacagtggtgatccattggtaatagccctcgctgactgctctcccttcctgcctcactttcccactccacccgtcatgtttcctggcatcactgcccagtcaactgtttgcactcagatccctctctcagggtctgcttctggggaaacccaaactacgacaatgtgggaacatgggtacaacctggagcttggcaagtgctcagtgaacttccagttcccttcctacctcagtgtgtacctgcatcagtacaccaggcctgtctgctccaatcagggtccctccaactttccatgaggcccagccatttcctcctccccacccacctccttgcttctaccctacttgatggaatcctgggaacagtgcctgggccagttttgaagcagctcaaataattcttccaggccatttaggatgatgatgatgatgatgacggtgatgatgatcgctcacactgtgaggcttccctgtagtatctcactggatcccaagagcagccttgtgaaatactgctcaggtcaggcttcctctaagcagagctctaggtagtgattttttgtcactgatgtcttagtggagggctctgagaaggggaggaaaagggcaggacagggcagggagcagagcaaggacttgtcctcagccggagtccagctgtggccttctcatgatcccacaggaagctctggagtgtgaatgtgaattacaccacagctgggtccctcaaggagttgagagagttggtcttttgtactcctgtgctgtcagtcgttggcctgggttggggatgaggcagggcctggtagcttcctggacaagatgaccatttgttggccaagggctgctttctggagagggctgtgtcatctgttattacagagctggggacaggggcactggcgggtaaaggggatcagcatccctacagatagttatccctgttttacagaagaacttgcattttaggaggtttaaatagcttgcctgaggtcacacatagccagtaagtcttttagtccaggcctgattgaccaaagcccattctttgaaacactgctggtgttggaaagggtcctttgtgccctccagggccttttaacttatttatttttgacacggtgtctcattctatcactcaggctggagtacagtggggtgatcacaactcactgcagcctccacccacccccaggttcaagtgatccttctacctcagcctcctaagtagctgggaccacaggtgcacaccacaacacatagctaattttaacattttttgtagaaatgggatcttactatgttgcccaggctggtctccaactcctgggctcaagcaatccacctgccttggcctcccaaagtgctgggagtacaggtgtgagccaccatgtctggtgagggctggtttttttctctttttttttttgtgcctccgccacccagggctttgtgaagaccaatgcaccaatgtaactgaagagaaacagtgaaataaggcaagtcttagtttattcatcggccccgttgttcttgtgaagattaaaggagactgaggtgccaggaatgagcatggtgcacatgtgggcaggcccacccatggcagcaaatgcatcagtctcttcttcctcctgaacctggtcatggtctgtcctgtctgtgatgagggagcgtgcggaagtgtccattcctgttctcatctagtactagaaggaaaaaccagcgcagctcaacttataatgagaatgttttccctcccccaacagaatcttctggaagttcagacctatatcagcatcctgcagcagatcatccacaccactcctccagcatccattgtgacgagtgggatgagggaggtaagaattgaagcaggaaaaggcaaaccagccctggagggaagctgtacctggagactcccagggaagggctcacaggttggactgtgagggcggccaccagggtccactccccactcctgccttgtattctcatctgaagtttcttcttctgatattttacttgtactgtaaatgccaatatttagacatgtgaggatgtaaaccgcatccttgaccattttcttcggtattttctcttgagaattatgagctgttcttccttgcatactttataagaaatgaccaagctgctttccaaagcgatgtgccattgttgcatctccacccacaatgcgtgagggtttctgtggcttcctgtccttgccagcacttggtatgtcagctttgtagtgtgtctttgctcttctaatggtggtggttttaatttgcatcccctaatgactaaggaagccgagcatccttttgtgcactcatctgccatccggatagcttctttgtggaagtatctgctcaagcctcttgcccatttaaaaaattggtttgtttccttattctccctatcaatctgataatgaatttcaaatacagataatctcagataattagtgaatatatttccaagacggagctctgctaatgattatgtgagcctgtggcattgaaactagtgggaaaggatagagattgttgaagccaatttgtaaaaattaagatttggatatgaaaaattacttctgatattatgttccaaattccttcttcatttgactctctagctgctcaacgggatagtaacgcttttcctaatatggtttatggaattttgtgatgcatagcatgatatatatatatatagactggtgctgagtgaggtggctcatgcttgtaatcccaactactcaggaggctgaggtgggaggatcatttgaggctaggagttcaataccagcctgaacaacatagcaagaccccatctctaaacaaacaaacaaacaagaagcaaaaaaaccccacaaacactggaaatgatgcaaattaaataaaaatgttacagtgtcccttcttcagaggttgtggtaggctactacagggtttggtggattggtcaagagataaggttctgggtctttttgcaaggatgacctaggatggtggctctcaaccctggtgacacttgaaattgcctagatgtgtgctcaggccatgctccgagtcaatgaatgggcttcccaggaggtggggcctgcccaggaccagcatgcagacaaactgctgcagaacccatgggctggggtcaccggctgcctgaactttttcgtcttaattattttatacaaagctaaagaaatccccaaatttgctttagaagacacttttgaaccctgcaaagtatcatctaagcgacaggaaagttactttttttggcattcatgaggatagtcttgtctgaattgcccaccagttaccatttcaggatcctgttctccttagtggatgtaactgatgttgctacaaaggcctaaaaaaacttttcctgaagccttaattttctttcccagagattcctttccagagatgttacttttatttttcaaacccaactctaactcaaaggtgttttacatccgagcataccttttgaattgtatcatctattcccatgtaataagacccttctaagtcataagtatacagacactaaactgactttgatgtcatcgatcagcatcgtctgggcttgtgagacgtgcagagtgtccagtccagcctcagacccactgaggcagaatctgcatcttagccagatccgcagggactcgtgtgcatgctcaggatagagaagcaccgattgagaaagtgtcacatctttatgagtcttagcttagcaattctacaatcaagttagacggtcactttcctgtatgtctatgtcattgctgcagccactttgtaaggtgtttgaagcagaggctgtcttccatgcagcctctggacacagaaaccctcattgtagacttggtgtttgattttgcatggcttcgagtcaatgtgctctgtgtcagaatgcatggctcttgagcagtcaggcctttgtgaaacaatttgaatatttttgaatagacgtggaaaggcaggtcaggagagagggacctgcttggcagagtgtggagaggtcagaggatttccttctagccattccctggagcgtcacttccctttcacccactggggctgatggctcctgctttgtgctgcgctgacatccgagcacagcgtatggctcgcggctccaaccagccttcattttcttcgagagtgtgcattccaggttttccctttcacagaagggaaaacagaggctttgagagtcaaatccttttctagagtctcttagtaggttcatggcacagccaggtctaagctctggtctcctggtacttggtcccggcatgtcacactcccaaggaggttcagactttgaagacaaagcaaaaggcattgatggctgtgctgtgggcctggcttagtcttctcaggctactataacaggacactacagatgggagggccgacaggcagacatttacttctcactgtcctgggtgctggaagtccaagatcaagatgccagcagaattggtgtctggtgagggctctctttctggcttgaagacggctgccttcttgctgtgtctcacgtgacagacagacagggggtgggggtgggggctctggtgtctcttcttgttcttacaaagaccctaatcacatgatggggccccccatcctcatgacctcatctaaccctaacaccttccaaaggtctcctaaaaccttcatcttgggagttagttagggcttcaacacagaattcagggggacacggatattccgtccataccagggccccgcaccttctctgcccttttcctctctgcatgtcccatgagtctgactctggccttctctgtgcaggagaagctcctgacggagcgggaggtggccgccctgcggagtcagctggaggagggccgggaggtgctctcccacctgcaggcgcagagagtggagctgcaggcacaggtacgctcgagtctgccgcgtgtgcattggggcttcccacatgtttcatggaggtgttacgcgcaggcacacgcatgcagcttgaggagctgtcacacgctgaacatatcctatgttcctggcagaaacggggttttctgagtgggtggccaagcgctctgctctggcctggactgaggagttttccaggacacagggagagtcctgagctgggggacacaggtgccacgctcattcctggcccctcagaggtgccccttgggactccttcgagtcatgccctccccaccgagtcttaggcttaggctgccccagtgtctacatcatgcattcattttgcccaggtcaagcttcgtaagaataagaagaaacggacaccatagggatttttatcctccacttgttcaaatctgtgcttctgttttccttctcatggtaacagttctccttcggaatttgattacaacccggcaagagtggttgtatcagtgtttgcttctagttagaaacgtgttggtggaaagctcacatttctacccccaccccttttgggtgaagcttaatttgaaaacaaaacagaaaagccccaaactgtcctgtggcctgtgccttcttggctacttgccggctcatcttctttgttccttccggttctctctctttctcattaccctacagcaggtcattccacagggacgcttgggttaaaatactgcacctttgtatggctctctaaccacatttcccaaaccaaaaagtaagttgacatttggtttgacaagtacacatggggacaagagagcaaaacgtgtaaaaatcggacacttcagaaagcctggaccatttggatgttatgtgttactctgtctaaaaatgtgaagccacaactagatgtagcgctttttattgatttccagtgcccccatgtctgctcaggatttcattttgggaccttggagttcacatcctaattcccatcccagcacgcaccacacaaaactcacagtgcagcagctctcaggggctgctggaaagcaaacccgggtctgtggtggtcccctgaactgacgatcgcagcaggaggaaccaagtaaggcacttaaaactcctccttcttgtgagacaaaccctggctcagggaccatgtgcctcatcctggtgactggggcctgtgtggtttcttctgaggctctgacaggatagaataagggttgtatgtgtttgtgtacatggggtgtgtgtgtgtgatatacatggtatgtgtgatatatgtgggatgtgtatgtgaagtgtgtgtggtgtgtgtgtgtcatgtgtatgtgtgtgtgctgtgtatgtgaatagggacgtggatacaagcccagtcgtggtcctagagaccagtgttttccaaatggctagtgacaactcatttttggatgtaaaatgaactcagtagaattgactggcatgtaaaaggaagtcaacaaaatgctagactaaaatataataagaaaaacagagtgtacagcaagtgaaagggaggatttgttttgtgaagcccttgttttatctctctatatccatatggatatgttgaaatacacacacacacacacacacacacacacacacacctacctatctgatgtgtatggctcgcaatgagaaatgtggtttttcctggggcggtggtgataaagttgaaaaccactgccctagagatactgagaaagatgaaggagcccagcctagatggcaaattccagttccaggacaaaaagaatgttcctctctttatgtacaggtatttgttgaatatcaaaataagaaatttcacaacagattaacctggtttctgagaacatgaaatgaaaccgctggttggccgcctgtttctgtcctgagtggctgcaggaggacttcctggcttttccctgctgccctcgtctctaaagcagggtctcaaacatctcttctgtgctgcctcctccactcccacccttggcattctgatggagaccgcttctcagaaaaatgatggtaaaggcataaaataaaatacagataatttaaaggaaaccaggctgggtgtggtggctcacgcctgtaatgccagcactttgggagggcaaggtgagtggactgctcgagtccaggaatttgagaccagcctgggccacatgacgaaaccccacctctacaaaaaatacaaaaattagctgggcgtggtggtgcgtgcctgtggttccagctacttaggaagctgacatgggaggactgcctgagcctggagaggttgaggctgcagtgagctgagactgagccactgcactccagcctgggcaacagaatgagaccccgtttccaaaaaaaaaaaaaaagaaactaattatattaaaacagttatcaaaatattactgaatcattttaaataaaatgacagatgtgcttatactcactcagtaacaagctatagcatgtagctgatgaaacacggctgtgtccattttctgttgctgccttgatgagtcaccaccagcacccgtgtcatcgcagttgtgtaggtgggaagtctgggtgggtcctatcggtttctctgctctgggtctcaaaaggtagaaagaaagatgttggccagcctgggcccttgtccagaggctgttaggggagaatttgcttccagtctcattcaagttcttggcaggagtgaggaccctgtttctttgccggctgctggccaggagtggctgtcagggctgcccaggctccttggcttcaggcccctccacgttcggagccggcagcgaactctgaaccctcttcctgcgtctcatctcaatgacttggacttacacgtttctctgacttctgtttttaggggataatcttgaataaactcctttccttaaaaaagggtaactgattaagaactttaattatatctgcaaagtccctttttgccatgtaacatattcgagggtgtagcaccaaggggaaaaggtcacgggggccaaaattctgcctccttagctctgatgaaaacccagacgtggctgggtgcgcccgggagctcctgactcagtgggtctggggtgtggcccgggatgctgcatgtctaggtgtccctgtgatggtgctgcggctggtccaggagccacactgagaaccacagggtaagggcgggtcccagggagtgggcgaatgttccacctggtccccctgtgtcccaggcttgggcctcatttcaaatgtttgtggctgggtttttgctggttttaaaggttttagtggcttcccaatgtagcagctaagctagagctgaaggaagatgtggccgcacaccgccgggcagggcccgctctgtggccggaactcggtggagggcgggccgagagagagcgtctgctagcaccagggccgtggcagcgggttccgcctatggttagggcgtccgaagcttcccgaactctccacagcaggggtcgtcagggtgaggtccccgtcccagcagcgggggcaccacctgggaacttgtcagaaatgcaaattcacaggcaccccagaccactgacccaggagctctggggcgggccggtgcgccttgtttaagccctccacgtggctctgcgggctcagtctgggagacgctgggcggacgatgggagaatagtgcctgggcttggagctggaagctggaagcctctccttcaaataagtgcacatatacccgtaagagccccggaggaagcacttcggacaggtggagaggaaaggacaggtaattctagttccctaaattgcatggactgagagtttctgtgacagggaagtaaagaaagtcactttttaaaattgcaaagtgggaaccgcccatgtctcatttctcattaaagtcacttagcaccatctagtggtttagtttgtgtaagacagtatgtaatgagtttccttttttttttttttaagacaaaacaaaaacaaaaacaaaaacaaaaaaaaaaccttacacctaaaggtgtctggggtcctaaggactgaggtgagagctcacccctccagatggggctcgcgtcaggctcctgcctgtgtcgtgccctcagcggctcacagcccagtggggagacagatataaaccaggcaatctaacggtccaggcagaaacagcagtcacctggctccggataaagttcaggttgccacatggccccaccgttggaggaaccctgggccaacctctcttctcttcgtctcctgacccctcctgcagtttctgggacctcccctttgctcattccttctctcctttctggaagtccctttccttcctcggttcccaggaccggtcctgcctcctcctggaagcccctttcttcctctgagatgccctgggcgtgcctcccctgctggactgcggccttctagaggagggtccgtgtctcattctcctcggccaggctggtgctgggtggcagtggacgccgtgccacagtggctctcgtcacaggcatctccattcctgttgagctcctgagacaggagctcttactggttttcctgaacactcttccttctgatgaaaggtttaaattatggagctgtaaaaaccacatcggtatagacatcagtccacttttataaaccaagtcatcacttcactggactcagcagaatcccgtagagcatctgcgaccagtacggagttggagggctctgggcctcatggtcatgtgggggatgggggctgtgggggcgcccaggacaggagctcctcccgcagtgttccagcagaggatctccagcctttaaaacatgcagccttcttcaaacaaacacaaatgcacacccaagaaaacaccccatccctccaccccctaccactaccacaaaaacaacaatcaccacttcctgagacataaaaagattgcactccacttgtagggtagaaagatcacaggtgactttcctgggctctcatttcccattctgtgatgctttgtggttctatttacagtttaaaactttgctaagtgaaaacctgcaaggagaggtctctgcatggctcacactgactttcccatgtcttcagagagaacaggctggtgttggcctgttgctgtgtgggaatggggagtttgcaggggccctggagacagagtgtgtgtgtgtgcacgcacgtgtgtgcttgcatattgttgcctgcagcagggaggaggctgaggtgcagggcaagggtggcctggttctgggaggtgtttcagaccttgttcaggtagattcgaatcctgctgtggtatttatgggcaagccactttgccagtgtgccccagtttcctcatctgtaaagtggaaataatgacagcccttccctgataaggttgttgtgaggttgatgagttgacccagcttaggacttatcagcatgagccactacccccgctctgggctggggaacccacacccaaaaggaacggccaccccagagctcttgggtcagtgatctggggtacattctcttcatatgtaattttttcttttactctttattatggaagatttcaaacatagaaaagtgagagattataggtgctatggctcacgcctgtaatcctagtactttgggaggccaaggtgggaggatcacttcagcccagaagttcaagaccagcctaggcaacataattagaccttgtctctacaaaaaaaaatttttttttaattggctgggcatggtggcattcacctgtggtctcagctactgaggagacaaaggtgtggggaccacttgagcccaggatgtggaggcttcagggagtcctgatggcagcactgcactccagcctgggcaatagagtgagaccctgcctgtctcaaaaattaaaagtgagaatagtctgtctcatgagccctcccgccccatccctcaacacatggcccctctatgttctctacagccccacacacttccctcaccatgtaattccaacacttctttgagatttggggctcaaaggggtcttttcaatccccatattccttgaaagtgtttcctggagtgtctgaacactctggtgtgggtgagatgtggctgcaccaggcgttagtgtgtctgacttgtatttgctattacaggcgactgtttgaatccagatttcttgggagaaacagaaactggatcacactagctgaaacaggaaggggactcttgttttattcagaagtaattttagatttttgaaaagttgcaaaaacagcacagtagcttccaatatatacccctcacccaacttccacaaaaccacgggccgatgataaaaacctggaaattaacagtgatcctgtcgcattaatagactgcactaaaatctcaccagttgctccacgcgtgttttttcctggtcgagatcctactcacatttaggtgtcatgtcttgattgtctcccccatactgggatggtccccagtctttctctgtcttccatgaccgtgatgctttggaagaacccagaccagtggctttgtggcatgtctctccttttgggtttccctgatgttttctcaggattagatggaggttctgcattcttggcaagacccccatggagtgacgctgtgtcctgagtatttcgttatgtggctgtgtcctcatacaggtgacaataactctgatcacttggttaaggtgctgtctgccagttttctccaccggaaaggtactatttttttttttttccaaaggagcagggtataaaaggcagggcatgaaatctgagagcaggtgtgcatcaggaatcaggaaccaggaactgggagctgaggcagccgctctccgtctccttttccatctcttccttctcttgccatggctccctaatttctgtttgtctttgcctttcggcttcatttcttttcctctccaaataattacctttctcaactttgccatgcacatgaaagctcgccactccagagcggcagcctcagacccgttcatgtgtccctgttgtctagaacctcccaccaactctgcgatttctgagacccctttccagattcccaggagagaaggcatgtgacaggccagcctaggtcaggcccacccctggtcctataactctgcacaggagagtggggtcatcttgttgctgggaccgtgcctttggatgggtggggctgacatcagacacagggacaacgtggactggacagacatctccccaaagtgcttagcacacgtaccttttcttcccttcctcctcccttctaatgcaacagatctatggctgaacacctgcttttttttttttttttgacagagtctcgctctgtcacccagtctggggtgctctgtcacccagtctggggtgctctgtcacccagtctggggtgcagtggcatgatctcggctcactgcaaactccacctcccgggttcaggtgcctcagcctccagagtagctgggattacaggcaccagccaccacgcccagctaatttttgtatttttagtagagatggtgtttcaccatgttggccaggctggtcttgaactcctgacctcaagtgatctgcccgccttggcctccttaagtgctgggattacaggtgtgagccaccacacccggccatttgccgaacacctttgaaagctacattttcacttaaggaatttcatgatccaagggcataaagtgtataagtgaagaattgggttttgatggcaatgatcatcttccagggtgtccagtaggtacatttaggtctggatgtaggaaatgcctgcagtggacatacatgaagttgaatatagatgtgtgtcttgccccttgtgactcgaagtgtggcccatggaccggcagcatcaacatcacgtgggaactggtgagcaaggcggagtctccggccccccatccctgctgagtcagactcttaacaccctcaggtggttccagtgcaccctggcttccagaagggctgcgctaggtagaagtgaggttttgtttgttttgttttgtttttgaggaccatgcgtgtcaaattctttcctactcaagaatgagattggaaaagaatcatgatatctcggcctctactttataaagtttaaattttttttaagcttcttgactcttttttaataacacttgatcaagcacaagagaaaatattgcaatcaagagctgtgggaaacgtgagctgtaggaggctgcggctggggtaatgcggcgtcactgtcttaccagaaacatctcgttaaaagtgggactacacgccaaaataatgagaaaaagtgtagtatcgtaaatacataaaccagtaacatagttgtttattatcatcgtcaagtattatgtgttgtacataattgcatgtgctagacttttttttatgcaactggcagcacagtctgtttacgccggcgtcctcacagacatgtgagtgaacatatggctccacggccctaggatggctgcggttgtcacaaggcgacaggaattgtccagctccattgtactcttatgggaccaccatcctatatgcagtccattgttgactgcagtactgttatgtggcccatgactgagcatttgtgggtctttgtgtatcatcacaacctcttacactgaatataaaactatctctttctgttttcctcccttaatttttacttgctctgattaatgtactgtatttctctgacattattttatgtgtacacaagggcacacacatacaccttagctaccaaaacataaatgtaactctgccgatccaaactcgggagaaaatcaaagctgaatgagaacaaggaaacttttctcccactcagtatttcaataaaggtagcatcttatctatttagtatgtgcttctttttacttatttttttgctatcagatttatgcttgttcattaaagtctgaagaatgtactttatttgaattatacatattattccaccgatagcaagttttttttctttttcttttagacagagtcttgctctgttgcccaggctggagtgcaatggtgtggtcttggctcactgcagcctctgcctcccaggttcaagtgattctcctgcctcagcctcccaagtatctgggattatggcgtgtgccaccactcccagctaatttttgtatttttagtagagatggggtttcactatgttggccaggctggtctcaaactcctgacctcaagtgatctgctagcctcggcctcccaaagttctgggattacaagtgtgagccacctggcctaggtttcgttttattttctaggtttgtcttcagactgcctttggggtgggcctccttatggactaattgcagagggtgctgatattagtgcaagaagggctgggtgcggtgactcgcacctgtaattccagcactttgggaggctgaggtgggaggatcacttgaagccaggagtttgaaaccagcctgggcaacgaagtgggaccctatcactaccaaaaaaaaaaaaaaaaaaaaaaagcccagcatgttggtgcttgcctgtagtcacagctactcaggaggctgaggtggaagcctttagcctgggaggtcgaggatgcagtgagccgagattgcactcctgcattccagcctggtgacaaagtgagatcctctatcaaaaaaaaaaaaaaaaaaaattgtgtaaggacacaggagctcagttttcacattgctttttagcttaaggattccaaagtgattcattgctaatctcgaatggacagagaaacacacaaacaacataaaacattcaccgagtccgggttccttttcctggtgaggtctgtctcttagagaagaagggggatggattttcttacagcgtgtccttgcccacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggtgagcgtgtgccctccccatccaggccacttattccttccacaactctttattgagtgcctattgtgtgccaggcacagttataggcagtgggcatgtgtcagggaaggaaacagaacaattcctgaccccatgggtgttggataactagtaggggagacagaggatgaaggtacgaccagtgctgaggaggaagttcccgcagggaggagggtggtggcaataggggtgatgggggaatgcttgcagttttaagtagggtggtcagaaaaggcctcactgagaagcctgtgttttgctcataggcctctggggacataagtgtcccagcaggtgggatgcccaggagtatttaatgaggtgctgcaggtgagctacgtggcacggagcctggcacttgagggcactcagaggtgttggtgatgctcctgctgccatcctcacaattcttagcaccttgctgagtcagtctgtggctgtgactatgtggctgtctggtcttctccataatggagctgtgagtcgatccctactcactttaagaaagctgggaaattctctctttctctccagctatgctggtattcatagctacggtgatttccagagaacgggttgggaattaatttgtgattcttcacttcagtcttgctaaattcctgggtttcgactgaatgaaaagagaagccccccacaactgaggtccccaccaggagcagctcttcccttcgcgctgggtgctctctcttggctgtgagcactcgaatgcttggcaggagaagcaggattttatttttctttctccagtgctggtcggtgtatctggcatgattccacattatatttatgtcacagtgaacactatgcacacatctgcaagaataagtctggagctggcatttcggtgactttgtaaacatttttgttttgggacagggcttcacagaaaggtgactggatacctcttttatttatctataagttctgattttggtctaattttaaattgatagaaatgttgcaagaatagaacaaggaactcctgaatactccagattcaccagttgtttatattttatctcaattgctttatcattttttctctatttatatatgatgtgtgtgtgtacatgtatatgtatatatgtatatacgtatatatgagtagatatatgtatatatgtatatatgtgtgtgtatatgtatatatacgtatatatatacacgtatatatatacgtatatatacatatacacacacatatacatatatacacacatatatacatacgtgtgtgtatatatatacgtatatatacgtgtatatatatatacacacgtatatatacgtgtgtgtgtgtgtgtgtgtgtatatatatacatacacgtatatatacatatatcttaagttggagatatcatactctgtttgccctaaatacttcagcctgggttgactactctaactaaaaaaatcaaaaaggcaaaaaaacaaaaggcaaaaaaataaaaaaggcactgtctcatggagaagtggcatttttaggttataagcaatccccactttacaattttttataggtatgtttcacagtttatgactcttgagctcaaagaaatgatcacttcctttatgtcctcatccagtatgtaaatgtgtgtatggctgtctgtttaaaatgatatctaattcgtgagcaatttggtctagagaaagcttttttttcatttttgctcaacattaacgagagtcgctcttgcccctgacctctgtttggcttgttctttctggttctttctgccaggctgacctctgccttcattgaaactcccattcccctgttcacccagagccatggagtctctctcagcactggatccggtgggaaaggtaacgctccccaacactggacttctgtttttttctgtcttgaaaaaaaccaagcggctctcttcctgactttaacattcatgcttgcttcagatccatctggaaattaaatgcttttatgtgaaggaggactccttcccaccctctgccctctctggcttgctaagtgactgagctgagaagtttataaggagaaaaatcgactagggggctaggctaccttgggcatgccatccctaatgtgaggcatttattttgtatttttatatttgttttatggtttgacagcaataacttttgcaacacaaggcatttaattgggcaaaaagtacaactcaatattcacttcttgctccctccgctcggcagtaagtgaacactggatcacatcccaccgcctccccacattgaatcaaagggtttgtgccaacgcgtgtaacatggtgtccagtgcagagtggctgctcagtcatctctcattctcccctccctcaaaccaggcagaaacagcttggctggtaaatgtggcatctgccttcaacatttggtctgtaagacctcacctcacatcgaaatctcccagttctgaacaagcgcagcatttggggagaaaagagaaggtggtaatatggatgctcatgcatatagggccttgaaatccttatttccagatagctcagagggctttgtggaaatggtgttccagagtcaacatggttggaaagggaacagccttgcagctggacgcccagggccaggtctgcagacgagcggccctgcaggggcttgctctcagaacggtcccagcttggctgaatgctctgctaatgctgttctgaagttcttaataatttggaacaaggggtcttgtgggtttttttggcactgggccctgagattctgtgcagtcctgtaagcacctcctcctcgcataccagttcccagcagttttcctgtgccctgtccctctctgcatcccttgcacctgtggctttgtgacccatgtctgctgttgccggctcacctggctctctttttattgtgaatcagccgtgcttgatgccggtgcttgatcggtcttgccctgtggttaccagtgggaagggatgcaggggatgacttttgggctgaaaaagttcaaaattcactatgtgggtggagccgggaagcctcatagattataccaggtgagaattttatgtgttttcttcaacttttagtttttcctttcagctagtctggaagcaggagggtggacttggggcaggggattcctgtcatttctgaatttcatagcatcgcttcttctcttggcctgggaggaaggggaggctgatcacagccgggtggcatttatctagcttgagctaattatggaatgaggtagatccaccgtgaacgggttccatctccaggcccaaggccatctgagcatgtcagaagcccccaggtagctctgtcgtctctcctttgaggaagtcagaggagagaataactttgaggaatgggcttctgtggatccaagtgtctgctgtgagctcagtggggctgcagtgggaacaggggctagggctcccattgagtgtcaggacaatggccttgcataccttggtaggttctgcctggtgtggtggtgaactgtgggtgtcagaacagggagcaccttccctctggaagcccaaaggcatccagtgacttgtccagagtcgcccagctggacctcagcctgggccatggagcaacaaagccagggcctttcttccattgcttctgctccagatgaaggaagccccaccctagtactataggcgtttgtttccgagagagttagcctattttccaaccagcgtattttctttctctctcagtgacaattatacttgaatttctgcctgtgtgtttttccagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgcacatcctttgtctaattaatagggaccttgggaatgtaggtgggtcagcttcatgaggacagggatgctctgttaaatggccaccataccgtcctcatttaggaaagagacatgctcttcatcctggttcataagtctcgttagagactcagatagcatctggatttcacacagaaacatgctggttgatgacatcggctcatcttcattccatttcaagcacaagtgtgtgcttatgtggatgagtgttttgctagagatgaaattattaaaggcatctctcttaatgtggattcccccagaagctgatcccaaagcagagaatgcgaagtttcattggaagatgaatttaggatgcacaagtaggagagtggagaaggcagggaagagaagggaaccaataaggaggacgttaccaccaaatcagctcacaccaggggccactgaggagctctggcagacagcatagatcacgtgcctcagagtcagcctccctgaggggtgagggagctggggtattaatcctccagctcctggcagtcagtgggaggtgtgctctctgggggccaagaaagctctcaggcaaagatgtctaggtgctggcatttggaagtcaggcctggaaatacaaggaagtactaagggtcaaggggtcataggcagtgcaccagtgtcatctgccaccatatgggtaccaaatgtacttagtatgagatacttaaaattttctcactcagagattgcaacctaggtcaggtttcaagaagcaaggtgaagtgtcactgtgtaagttccttgtttagaagtgagttaattagtccagcaagcatttattgaacatgtactatgtgcctgacagtgtgctgtgccattaaggggcgatttttcagacttctcaatgctctcaattaccataatatagcagtggccatgtgagtgtgcatgatcttgcgtgtgcacacacacacatgcacacaggtacttactgtgtcacatcctaaaacacagaaattactcaaaaccagaatctttacacaaatgtctatgttgccctccagtatctatctttgtactcacagtccaaaaataagttatgccaattaaaaaaagtctccttccctgtgtagcttcaccaaagtacattaagggagctgagtaaatgtgtttaaatgggttatagtatcggcctacaaaaagcatctggtgagacaactacacattattagaggaaattgacagagtcacaaattacattctgttatttcttggttacaaataatataatactaaatggagtcacctttcctttctatttagagcttgaaacaatcttgttccaaattcatttgaggtttggatttcaagaaagaattaggcttttgttgttttttctaaaagatgaatggggaacccattccactgagttttgaaatatttataacttaaaagcttaagggagaatgatagaaaccattagctggagcccaggatgtactaggctttgggcctgtgtgtctattatcttcagcttcaacagccactgcaaagcctttcttttcctccttgggtctttttattttctgaactatgtgttcagtttatattattttaaaaggcagggggtattgctttagaaagaaaggtcatttttatattatattcaatcagtcaagaaaaatggattgggatctgttctgtgccaggcatggtcctggtcactgggagacagcaaggaacagtgggacgtggtcctgctctcacagatgtgatgttctagtgggggaggaaggaaacgccatgcaagcgggtagcgaagagaaagtcagagactctaccatgaagggactcaactagcgtgacctgctagaatgactgggggtctagtttggattgggtggtaagggaagaccctgtgaaggggtgatgtgggacctgaatgacaacatggggtatatcacatacagagctgagggtagagcatttcaggcagagagagctgcaa

SEQ ID NO: 16177 - DNA, 24817 bp, Human
ggagaaagatactgagaaaaatattgttaaactcatgttacagagaggcatgcaggactttgcaaacaaggtactaaacattactgattgataacttgtatggcatgaaagttaaaagtggtagttttttttttttttttttgagatgggatcttactctgttgcccaggctggagtgcaatggcacaatctctgctcactgtaacctccgcctcctgggttcaagcgattctcctgcctcagcctcctgagtagctgggattacaggcatgtgccaccatgcctggctaattttatatttttagtagagacggggtttctccatgttggtcaggctggtctggaactcccgacctcagctgatccgcccacctcggcctcccaaagtgctgggattacaggagtgagcccccacgcccggccaaaagtttttatattataaaaatgccataaataaaagacaactggcatgcttacagaatatatttgcaacatatatagcaaacacttgttgtcttgttttccaatgtgttgcctcctggaagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataaggtgtgtgtaaaaatgctcagttgcaccaacagctaggggaagcaagtgaaaacaatgatacgcaattttatactcatcagattgggaagaattgacaaatgtgatattatcaagtgctggctatggtgccgctaggaatgtaaactggcacatccattgaagagagtattttaggaatgactggtaacgttgaaaatgtgcatgcccctcatctgacctatgcaatatgcttacaaaaaacatttaacctgataatcatgaggaagcaataggcaaatccaaattggtgagtattctgcaagacaactggtctgggttcaagagcatcaatgtcattttaaaaaagaaaccagattaagtctggccgtggtggctcacacctgtaattccagcactttggaaggctgaggcaggtggatcatttgaactcaggagtttgagaccagactgggcaatatggtgaaacccctttccacaaaaaatacaaaaaattagccaggcatggggtggcatgtgcctgtggtcccagctactgggaggatcgctgaagcccaggaagccgaggctgcagtgagctgagattgcaccactgcactccagcctgggtgacagagtgagacctcagctcagaaaagaaagaaagaaagaaagaaagaaagaaagaaagaaaccagattaaagaactttctagattaaaggacaccaaagagccacaacaattagatgcaatgcctgattcttgttgggattctggatcggaaaaaagccaacaaattggatataaaaaccattattgggacaataggggaaatttgtatattagatagttttactgtatactagatacagtattgtgttcatgttcttgtccccgccaagactgatgagcccccagggactcagatagtcaagattctaagcaggctgtcagagccttaacaaggttctgagcccaggactgaggtaggggttacttcgggctgaggggattagcaaaggcttgtgaagtggctaaagccgtgacctggatatttcaggactcaaatccacccgcattggaattctctgggtgactgcccagcccctttggcaggacagccagccacaggccctgattgtgcaggacttcctgcctctgcaaaggcagtcgggggctgagcagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagaggttagttactgatgggggctgcataaattgggggttgtggagggacgccagctgggagggagagactggagaagggggtgtgtggagagcccaagaggaggcccagggggaggtgcgcaggcacagcctctgttgaaggagtctctctaaggctgctagggtccttcacctgtcattgtcaggcctggagagcgggctcttaaggaggccaggccacacctcaagggaagatggaggttaccggaaggtcatacctaaaattacgggcaaaaccagggagaattatgaacaggctgagttaggacttgtgtttacgttaatctgaggccttgcttggatttctttttaacctaaaccacaggcaaatattcccctttagggagagaattcgccgacatctatttaacatcccttaattgttgagagcatccactgtgtgccagacacttcggtacacacagaaagaaacccagaggagggtaagatgcccttatagggagatctttctcctcccttcctccatctctccctctctctctctctcgcttccctctctgaagacggtctagctttgggctaagtatacgtggcctcaggagtcaaatggatcaggacaactccgagctttgtcactgaccagctgggcacaggtgtgagtcatttttttttcttcaagcctcagtgtcccaatctgcaaagtgcatatgatggtaatatctacctcatagggtcaccctagggataaaatgagagaagccccataaagaacttagtgtggtatctgggctcaataaggcatcagctatttttattagccattcaacaaacattttttcctaggacccaatctgtgccatgcagagtgctaggtgctgccagggagagataaatgagacaccctcaaggattcacagtctagtttgttcatttgttgattgatttcatcaataaatatgtatcatgccctacactgagcactggagatgtcaaagtattaataaaagacactgtccctgtccgcaggttgctcacagcctggtgggagagacattgcaacacaatgtgattggtgctgtgaagagagggagcacacggtactgggagagctcagggcagggggttgatccagttccgggcagggcgatggattcacaagacattttggcaaaggtagacccagcttccgtgtttcccagctcacaggtgcactcctaccctggggcctttgtacttgctcttccctctgcctggagctttcttcccctaggatgtccccatagcttgctccttcacggctttactcaagtgtcacctccccagcaagacctttcttggccaccctgtttaaagtggccactccagcccagtgtggtggctcatgcctgtaatcccagcactttgggaggccgacgtgggtggatcacttgaggccaggagatcgagaccaatctggccaacatggtgaagccctgtccctactaaaaatacaaaaattagccaggtatgatggtgcacagctgtagtcccacctactcaggaggctgaggcaggagaattgcttgaacccaggtggcggaggttgcagtgagctgagatcgcaccgctgcgctccagcctggggcaacagagcaagatgtctcaaaaataaataaataaagtggccactcccaccatcaacagtccccgtccccatccccaaacacacacactcagcactcccaccctgctccctgctttatttttctccatttcatcgatcaccacctgacaagctgtacattttacttattcgcttgtctatttctggcttctccctccagaatgcaagctctgccatgagggtagggttctcagctgttttgctctttgctgtatccccagtgtctagaacagtgcctggcacatgatacgtgcttgctaaatagttattgaatgataagtacgttaagtttacaaagatgagtaggagttgagtaagacaagaaagggagggaataacagatgaaaagggaacagggggagggagagagagacagagaaagagagagagagattgaaattagtgagtttaaggaactaaaagccttcacatccagcttattcccaggaatgcgttaggggtggtataaggcaaggctggcgtaggttgggggccaagctgtgcgaggccatgtcctgtgaggggagacaggtgcctctgacttgggcggatgtgctatgtgctgttacagaggttaggaagattgacccaggaaaaaaggaggaagccatgaactctgctggggagctatcagggaaggtgtctcaaaagaggaggcacctcctcttaggcccagggaaaaagtttcagtgttattctagacgtgacggacattctgaaggcctgttcccacatcccctgtcttaacagacagacactgggttagaaacttttcggtgcttgcacgggtggatttcactttgcatttggtcctcgtagtgcctaacgggacctctgcccacaaaattgctcaagaaagatttgctgggttggattgggattgaggcaggtggagcggccttgaattgtagatgattcaggctcatgagcctagaaccttgggcaccatctgtgatcttgccaggcagagtgacagcctttcctagggtttctccctcctcaaaaaaagaagggacattaaccatgtggaaaaacaagtagattttaaccagttagaaaaagagagtggagagcattttaggtggaggaaaaacaacagaaacaaagacagaaaggaaggttagttcatgggagatttcttaagagtgaacagtttaatggattacatttttcaaagataaaacatgtatttgctatgaagttggtgtgtggattgccttcttagccaaagttatggtgaaagttgaacttgagcctgttattaaccaatagctgtaacatatgtataagctgcatgtgcatgctaggctgacacccagatagaactagtggtgtgtatctttacaggaagctgccaatttacagcctggctgaaacccacttggggctgcttctacttccacatttaattggttcatccatcccatcattcttttattccacaaataattatcagccaccagatatgcattaggggccgggtgcggtggctgacacctgtgaccccagcattttgggaggcagaggcaggcagatcatttgaggttgggagttcgagaccagcctggccaacatggtgaaaccccgtctctatgaaaaatacaaaaattagcccagcgtggtaatcccagctactcaagaggctgaggcaggagaatcacttgaacctgagaggcggaggttgcagtgagccgagatcacaccattgcactccagcctgggcgacagagggagactccatccaaaaaaaaaagaagatatgcattaggccctctgctacctgctaataatataacaaagaacaagatgaacatgtttcccgccctcagatgcctatattctaggggcaggcataaggcacatgagccataaacaagtaagtaaaagagagttaaagatgacggtcagtgccatgaaggggaaaaacagggtgaccttgggtaggtagtcaggggaggcctcctggagaaggtggcatttaaggcgagacctggaggataaagaatcaaggactaagtattctaggcagggggagcaggaaatgcaaaagctgttgttggaaaagctcagagagttcaagaataagtcaattcgagagcacagaatgtcagagcctgcgggcatcctggagcccatccacttctctcatgctggtcattgctcttgtaacatatctgcacacgactctggcctgcataaactgttgcagggagggggtcctacagggcagggagcacaaaataattgacagctctctccatgttacggagcaactgaagggcttatgagttttctttgtttttgaaccttggcaaaatgtaattttaaaaacattttttacaggatagaaccgaggcttcataactgacgaagctgacttcatgagctttgacagatcttgtctgcattttaagtgtttccaacacttaaagattaagttccttttcctgagaagtcgagcgggggcatatcccacccactcagtgcccacctcccatgcgacatttcttttcctaaaaagtggcaaataaaaagtgccttccggggagaggaaactcaccactcccaagacagctcattcaattcccaggacacatgagctgttagaaaaacgttcttggattgagccaaaatctgactgcttagcgcgtccgtgcctggtgggtgttggttccgcaatctggagccacatgggacagttctgattcctcctactccccacagcccttcagagatttggagacagactgggtacccccagccactttccaaacccaagtcagccccaattccctcccttctgtctcctgtgatccagacacctcctaagcctcctcacatgggggcccagggccaggcacatccctctgggtgtggcctgctaggaaccctcgttctgggcaccacagtcctgccaccaccgccaaagatgaccactgcctctgtgatgtgactagtactgggtttgggggtcacgcatgtgattgctgagctgtgttacccaccctgtccttgtgcagttcagctttgggggtctttggacagggcctattcactctcttcttatagaactcaggttatcttgttcttgatcaagatcaggataagatcaggacaagatcaagatccaacctccttagcctgacccccaagggcctttgtgacctacccagctccatctctttggccagtccttcccaccattcctgaattcctactaaacacttgaagaaagtttctgagcagtcacttgggggcatgtcccaccatcctgttaaaaataaccagtatttattgagaccttactatgtgcctaaacatctaccgtgtatcaactcagaacatagacatgagacaggtacaattatttacccaattattcatgatggtgaactaaggcacagagcagttaagaaagttgccagaggtcacacagctaataagtggtcgttccagggcatgggcaccatgcatccagcctcagtccatggtgtgcagcttgtattggcttatgagggctgaccagtgattcctccaggcagagagcaattgtgaggcagattagacttaagactgtaaggagtggttaaggactagggcagagcaaaacacataccacatctatgggggcagctacttcttggcaatggccagttgttgcctgtaggagtccagacccaggattcctagatcttttaaaaagaaactggaaatggaaatgtggaaatgtggatttctttctctttttttttttttttttttttgagacaaagtctcactctgtcccccaggatggtgtgcagtggcgcaacctcggctcactgcaacccccgccttccgggttcaagcgattctcctgcctcagcctcccaagtagctaggattacaggcactcgccaccacacccagctaatttttgtactttttagtagagacagggtttcacctcactggccaggctggtctcgaactcctgacctcaattcgggcctgcctcgggctcccaaagtgctggtattacaggcatgagccactgtgcctggcctggaaatgtggatgtctgtctaggatctcttagcatttatacattggcagctaattccattttgttttttttaaagcaccgtgtagatcaagcaaagcatttcttagggctgtatggagccctgggctgaaagtttataaccaaaaatccagttccactcatcggcaattattggaacactgaaccaacttaaccaactgtaactcagctctcacttttccaccttgtttataaggaaaccacgtgacactctggttagatgtcttgtgaaaatcccaatcattatgtccttactgggtctcaacccttttttgtaaagaacacagatttgacagacagatgggtcaggtgtacgattctgggtcctccttttactaactgtgtgaccttggatgaggtacctaacatctgcccctctgtttccttgcttacacgttgggatcataatgccccatgagattttgtgaagattaaggaataccatgaatgctgaacttgccttgcacttgtagcatagcaaatgttcattaaagaccgagttcttccctcattcctttctgagccatcagccttgtaatcccctccaacaggaaatgccagagtggacagcatatcagatgagttctataacattccagagacaggtaagctccctgtggaaagaaggatcatggaagacttcccggaggaggaggacttgatgtagattttctgccaatgagctctgggtaatcctgttgcatgtgccaataaaccatttgacaaggccagggatatctcagcagcttaggttctcagggtgagggagtttccaggtttccatggctacccttggcagggctttagccctggggcgagcctgcatgtgatagacccagcaaatgacagagaacaagtgtgtttatgtgatgtttaattagttctacaaatagttcttgaggatctataatgggtcagacattgttccaggtgctaagatcagaaatggatcagaggacaattttgccctcaagaggcttccattcaattggaggtggaagtggctggggcatctttaatcaccgaagtgtgaatgattggatccattgccaagaaaggggaactgggaaagactgttttgaggggacagtgagtttagttctgaggttcccaagggttattgggatagaatatcagactctatctatcatctgtctatctatccatccatccatctctgtgtaatcatatttgacgtgtggactgggcagtggggtgagaatggagctggagccagaggagtcgtgcattcactcagcaaactcttactgagcacctactatgtgccaagtgttgggttacagaggcgaagcagacgcagagcctaccctcatggagttctcagtttactggaaagacataatcacaatatttatggtagttatgacttactgagcacctacagggtgccaggcactgtcccgggccgttctgcctgacttatctcatcgaattatcagcgttactaagtgagtctggttctatgattatcctattttacacagataaaactgagacccaaagaggagaaaaagctggttcaggtgacacagtggtcacagctgagacacagatttgaacacacgtctctcctacgttggatcttggatctgacattgtgctttctcctggttgctgtattcagtcattccttcattaagcattgtttgttgagtcaaagctagggccaaacttctctgtccgggacacccccggatgcctgcatagaaataagagctaaatccctgaactcgaatgagctcatccagagagtggctgagacagagaagggcaactccagagggcaggtcccacaaacacacctgcatttggggggccagcagagatgggatggggggattagccacaggagggcaggcggcacagtgcagccttgtgaagcccagagggagagagagtttcgagaaggaggaggtggacttcaagatgagtgccctgaaggactgaggaggtgacccccaagcttgggctatgccaggctttgggggtccctgagggcaagctcaaggatgcagcagatgccaggcagtgaagggttcagagtgggggatgacgaagggcagccttctctgtttagaaatttgacttttagagaaaaaaagaagtagaattgtccctagaggcaagggattttttttcttttttgtggcttggttttgtttggttgagaatggcggagcaggtgtgtgttcgtaggtgggggaagaaactggttgagaagaagaaacgaaaatacaggatggggagaggactcttccccatggctctgatcaccgccagacaccatctgtgtttacttctgtcttcacgatctgtttcccaccagccacaagggcagctctgtgaaggcacaagttctgtctcattcaccgtgggatcccagtgcctggcacgtagtagacacttcataaatatttttgatattgagttgaattcacagggttcttccgggagcccagtggttagtcctaggaagagaagggttcatgggggccttaaggaggggcttctctctgatgctaccatgacaagagagagggagagaaaaagaagtcaacacaagtagaggcaggagccaaaaatccaagtctttggcggggtacagtggctcatgcctgtcatcccagcactttgggaggcacgggtgagaggatcacttgaccccaggaattcgagactagcctgggcaacatggtgggaccccgactctataaaaaatgcacaaagaaattagccaggcatggtggtgcccactgtagtctcagctactcgagaggcagaggcaggagggaagatggcttgagcccaggaggtggaggctgcagtgagatgtgattgtgtctctgcactccagcctgggggacagagacagaccctgtctcaaaaaaaaaaaaaaaaaaaaaatccaagtcttctcaaaaaagtgtgtgtggggtggtggtgtgaagggtggaattaacagaagtagaaaatggagaatactagtagctacttatgtcctgtgagaacattctagaaggtgagctgtcattgatttattagcattactctgcctttgctatggctctaagttataaatttaagaattcatttaatcctaacaacagctctctgaggcaaatgagcttcagtcagccctgaggtgatgtggctagtggtgaggaagccaggatttgaacccaggacttggagctgatatagagcctgtgatgttacccactgggccatatacttccccaactgacattagtttatatgccttatttttatttttatgtattcatttattcattaatagagacaggggcttgctttgttgctcaggctagagtgcagtggtgcaatcacagttcactgtaacctggacctcctgggctcgggccatcctcccacctgagcctcccagggtgagccattgtgcctgacccacatgtgccttgttttatatactacattcctcaccaggagcctctgggtttggaggggctcataattctcatgttttacattaagaacagagaaatatagtgacttgcccagggtcacacagatactaagtggctgagctgggactccagcttgcatctctctaaccgcaagcctggcactttccccttccctgagagaagaactgtaggaagttagcacagagtcaggtgccaaaaaagggctaccacctggacgtggcaggcaacattctgtggtgtttctgcaggcatctcccgagtcaccccagctcaggaacaaggcagaaaaagttgggggttggcaagttaggaacaagaggaagaggacggggacaaagctgcaagtccgggagcggggctgcctgtcttctctggcagttcctgggttgaggctgagcaaaacaggataaaatctgagcaggagcccacggctgggggacttggcaaagacccagtgtggtgggtgggagggaggctgtgccctggagggggattccagggttcctgttcttagtggggaagagccctggatcgagggtggcccaagctcaactctgatcactgtccctcctgatagccacctgggcactgtgacctgcttcagaaaacagctgcttctgtggcagtaatcccagcactttgggagtgtgaggtgggtggatcacttgaggtcaggagttcgagaccagcctgaccaacatagtaaaaccccgtctctactaaaaatacaaaaattagccaggcgtagtggcatgcacctgtaatcctagatacttaggaggttgaggcaggacaattgtttgaaccagggaggcagaggctgcagtgatctgagatagggctactgtcctccagtctgagggaaagccagacttcgtctcaaaaaaacaaccaaaataaacaactgcttctgaatacacaatggaaaaaaatccccaggggttgtgccagggtgaggggaagtagggcttcctgtgtgacttaccaggaatcttggagctggcccatgcaggggtgtgggaggtgacagagaggtctttaaaaccaggtgggcccagccccggcctcttctgtgggcctgaggacggagaaaaggtctcactggtgaggaatctcatctttggggctgctttgcctgagggaggtgcagagagcagggccgagagaggggctatgagaggagacacctggcccccttggtcaggggagcagggcccgaagaggagtgaacccccatcacctctctcacagacagcaggagggctcagcagtgccttccgtgcaatgaggctccgcactgtgcgttctttccagccaggagacctgaactgggaggtcttggagctgctgcatgtggacttgggggacccgtcccttggcaacctggccacgtcctggcctccacatcttcctatgggctgtccgtctctattctctcccctctcattactgcaaccgctgccctcctctgaaattctctcgcggctatgcgcttcctctctgtggtcgtttgattaaaatagctgagtccacatcctcctcctggcgcccgctttgggctctgctgagtggatggctctccactcttcggggcagccactccatgcctctgccacctccaccatgaaactgcttttttactctttccagggtgtgggttttctccaggtatggggaggccaacagatcaagaaatgattgccattgaaaagatagcttgttatttacagctcccagaagaaggcgtgcttccacccagggccacgcaggaagtgccaggtcggcaggtcaggaggagccacgggaagcatcgcccagggcctttgctgtgatctctgggaaaggctggtggggcaggggacacagtttaggaccggtcagtttgaatcatgtcagtggaactccaggcttccctagttgtccagtttctggccctggggtgatttagggcaggagaaaccttggcttggagtgtgagagtgagggaaaggtggcccgggtgtaccaaggcactggttgtgtcagcagtgggacgtatccatacaggcctcagcatcctcaggtcttgcctcctcagaagaaagaattctcatggctgtaatcccagcactttaggaggccgaggtgggcggatcctgaggtcaggagattgagaccatcctggctaacatggtgaaacccatctctactgaaaatacaaaaaattagccaggcgtggtggcaggcacctgtaatctcagctacttgggaggctgaggcaggagaatcacttgaacctgggaggtggaggttgcagtgagccgagatggtgccactgcactccagcctggcgacagagtgagacaaaaaaaagaattcgactgagggacataaggcagaaggagagactgaggcaagtttcacagcagaagtgaaagcttattaaaaagctttagagcagggatgaaaagaagtaaagtacacttggaagaggggccaaccaggcgacttgagagattcaggggttctgtttgacctttgacttggggttttatacatggcatacttcaggggtcttgttttccttatcccctgattcctcccttgggttggtggggtgggctgtccgcacgctcagtgacctgccagcacttgggagggagcatgcacagtgtgttgactgtagttgtacgcatgctcccttgaggcgttcttcccttaccagccgaacgtccctagcaggtcatataccagttaaatgccgccattttgcctcttcatgcacatgtgtgagcccactcacccagctcctgagatcttactggaagctgctgatcacctgcttcaggtattcctgtttattgggagactacctttccctggtgctggctgtgaccagttattattttagagagatggttaataatttcctgcccatcacctgatggttgcctgacattcctgccctgctcctgtctgaccagctacctactgtcacagttggtctgtatatgaaaggcatgctcacagaggagccatctgaggtgtctaggaattaactagcagccctggaaggagcaggctgtctctggcctccaagatgtcaaagcgtcctaaaatatagaaaatcaaaagcatgtttagtgcccagggatgctcagaggcagtggagtagagtcagtcaaggaaatagattcacagttatgggctaaacccttggggacctcacttcaattgtctgagcctcaatttccttatctgtaaaatcaacaactgttattcattgaacaagtgactgtttaaaaggacagacaccgggcctgccaaggtcattgatgggtttagagagatagaggatagtgcttggcacaccagaggtgctcagtgagtggcaggtggtgtccttgtgccacagctccagggagcagcagagaaagattggtgtggaatggtggggtctagggccatttctttggctgtttggagcccttggagcagaggctatgggtggacagaaccctcaggaatgttcttgggattcagagttgctgctggacaagggttgtcccagaggccagctgtggacagaaccttcaggaatgttcttggaattcagagttgctactggacaagggctggcctgccagcccagtagccaggagcccaggggagtctgaagcatgtttggaggccaggtcttgggaggcgccaggggttcaggtagagctctggcacaagcgaccgttcaactcagggacttgagacaacagagcactgaaggggagagccccaggcctgccgagctgtggacaaacaaggactttggatcctaggaggaaggcaatcaggcagctgccggcaaggaacctctgagaagccaaattagaatcaggtgctggcctgagacacatggaatttcctggactctaagctggcaatggctgtttttaccaaagacagattctaaggagtgaagccaagggctctggcctgagaggtagagcatgagaaggaacaaacacagacccctaaaggattcatgcctctgggaagggaggctgcgtggtgcagtgaggggtgcagaaggacgcggctcgaatccagcctccactgcttaatggctgtgtgacctctggcaaggtccctgagctttctgagcctcaactttcccagtggcaaaatgagaacagtaatacctaccctgcagcactctcgtgagcccccagggttgacttattctttaggtagacacagtgcctgggtcccaggagagtgtcttaattttataaattcttttaaaatcaagaggaaggaaatgaacataataatgaatatataataataaatccagcttggattacatttttctttatagcatcatagttgtcaaaaataattatgtgaatatagatataaagatatagcagaaagatgcctacaaaggcaaaagcgcttggggcccataagagccataatcaggccctgaaagccactggcacattgtgggagcccaggcttcactgctgagcacctcctctgggccaggcactattctcagtggtagaatagaggtgtgcatccgcccagcctctgcctgcaaagaaccatcagggtagacatccttaaaaacaggcaactacagcactgtgagctaaaaggagtatgagatgtagaatcaccggctttccttctgccctcctgctgtgggcgtcaagtgctctctgtccaggaatttttttcttccgtcttacatctttcatcaaaggccatgtctaggttatatcaagtcctgcttctccacgtatgccaccaaatctccatttaagaatcctgcccattctctggtcccttttagccattttgccaacggggtgagtatgtctggggtgtttgtggctaaaagtgcactggtggtagggacagtgtccctgcaaatgcttccattattgtccctctgcctccagggccctcagtggacctacagttttttgcctcatcttttctggctggactcatcttgtttattgcccaccatgacggggagtggaatagatggggcctggtggagagccagggtgggatctgaatgggccacgggggcattgcctgatagatctgttgtgggatgtgtttttttttccagaaccccagagatgaaaggcctcctcccactggcttggttcctggcttgtagtaagtgctggccccgtgaccttcgaatgaacttttaccccatgggagtaacagggtggtgaaaaggacaccagccattgaggtcgtagagacttgggtttgaatctcggctctgcactgactgcatagacattcagcaagagccttcatgcctccgagcctctgcttcctcatctggcatgggctaatgcagtccatgcgtaaggctgtggcagggtcctaggagatattgtacctcagctgtgtaaaggttgtggacatagaggttatgtggctggcaagtgtaggaggcagattttttccctgtatgcaaataaaataagatttacaaaatcccccaatcaatccaaataaaaatcaaaactcttatctaaatatcccaacctatgattcctgggtcattctcagctcaggcttgtccagctgggaagtgactgtatagatggctttagtcccatcctgcggccccgtgaccgtatatacaacccccgacaggctgtcctgctccttgatgtcttgctagatccctggagactccaggaggagctggaggcctggtgcaaggagagagccttgggctcactgtgaaaccctggacagggcacctcttccctccatgcctcagtttcccattagtaagatgagggaactggcttcagcgatttctaagagtcccatcctgcttttagattctctgccttatgttctaaagggtgtgaggggagggagtggtggggaagagggatgtattgccaagagagacaggaagctcctatctgcctgcttcatgcaaatacattatgaattacaccttatatgtcatggtcacttactatgtgtctgccaccgtgctcaaaatttacatagttgatcttattttaaccctcatgacaactccaagatgtagctgctaatttggggtccccgttttccaggggatgaaactgaggctctgactccattcaataccatactttgaattagtggcagagccaggatttgaacccaggtctgctcatttttcaattccaaactcttaaccagttctccatactgcttgcacctcccttcccactaatggagagaataaaaaagagacatgcaggtccctccaagccctgggtgggagaaagggtaggagatgttgggcagtgggcctaaagcagggctgggctgcctgggtgtcacctggggacatgggctatcttccaggtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgagctgatcgctataactgccctttaggctccaggctctgcacccatgttttcttattcaattccatatcagttctggaagatgagtattaaagtaccattttacaaataagaaaactaagcctcaaagaaattagctggcaatcccaagatctcagtggcctaaggtgtcagttggtcaactgtggcgtaacaagtggtcctcaatgtagtagcttatacagcactggtcatttactttgcttatgaatctgccatttgggtagggcttgtggggatggcttgtcgcagcttcagcttggacaactgaggctggacaatccaccttccagatggctcactcctatggctggcaagtggtcagcatctcctggcctaggagcgggtcagaggcctcaattcctgtcacttaggcctctccaaggatgttcgggattcctcccagcatggtgactcttgggttgcaagagtgagtgaccccaaactgcaagaccaaaggatatggtgttttatggtcagcctcagaaatcccattgtgtcacttacactgtactcttggtcaaagcagtcacaaaggctttaagagggagggcatctagattccacctcttgatcgggaagtgctaaagttctagaagaacatgtgaaatgggagattttgctccttggaaagcatacccaactgggttaacaattctgatactgctagacatatataaaggaaagggatgattaagcaaatgaaggacagatggttggggccaagtttctcactgttggagtgggataagccagggcaggaagccagaatgatccatgtgcaaaaggactaaagttggagacatcagtatggactcctgtttagcttattgtagatacagatgtttacatgtggaagtatgcataggtagcagtatgcatagatatcatggatatattagtatcatactaatataagatgtaagtaataggagaaaatggtgtttcctctgtaagatcttctcagtttttctgtaaaccaagaatactttttatgtgcaatctgctacacctaacatacagtcatccctcggactggttccaggacccctgtgaataccaaaatctgcagatgctctagtccctgatataaaatggcacagtattttcatataacctgtgtgatcatatactttttttttttgagacggagtcttgctctgtcgcccaggctggagtgcagtggcgcaatctcggctcactgcaagctccgcctcctgggttcatgccgttctcctgcctcagtctcccaagtagcatatacgttttttttttatacacatgggcaaatagaaacattcttttgctatcagtggagagggtctaaaagaaatgacatctcagtagcaacaagcacacttaatgcctagatctagtttccaatgtcattcttcaatagaaggccccttccaagtcatatatatatatacagggttccttgaagaaatggtcaattctaggaccaaggcaggaaatatacgagatgagcctggaacttcttttagtgccaaaaagtaaggaagtgcttaaataaacgcaaacaaaacggaagcccacattgatggggatgtgacaagtggcacctgtgctgactgaaagagcccccagtggccaaccctggaacaatttagcaacaaaataaatggccccaaactccagtcttatcatgagaaaaaagaaaatcagacaaatcccaatcgtggggcatcttataaaatgtctaaccagtaccccctcaaaacagtcaagaacaaggaaagcatgaggaactgccacacccaagaggagcctaaagagacaagaccatgggccgggcgcggtggctcacgcctgtaatcccagcactttgggaggccaagacaggtggatgacctgaggtcgggagtttgagaccagcctgaccaatgtggaaaaaccccatctctactaaaaatacaaaattatctgggcatggtggcacatgcctgtaatcccagctactcaggaggctgaggcaggagaatcacttgaacctgggaggcagaggttttggtggtgagctgagatcgcgccattgcactccagcctgggcgatgagagtgaaactccgtttcaaaaaaaaaaaaaggcaagacaatgaaatgtaacatgggatccccagtgggatcctgggacagaaaaaggacattaggtaaaaactagggaactctgaatcaattatggcttttttttttttacaattagtgagataatgatgtattatttagtgaataattatcaataatgtatcaatattggttcattaattctaacatgggtctcatactaatataagatattagtaataggaggaactgggtgtttcctctgtaagatctcaattattctgtaaaccaagaaaaccttttatatgcaatctgctacacctaacatacagtcatcccttggactggttccaggatccccgtggacaccaaaatctgcagatgccctagtccctgatataaaatggcatagtatttgcatataacctatgtgattgtatccccccaaccatttttttttttctttgagacagggtctcactctggttgcccaggctggagtgcaatggtgcgatctcagctcactgcatcctagaccttctgcactcaggtgattctcccacctcagcctcctgagtagctgggactgcaggcacgtgccaccatgcctggctaattatatatacatttttaaatagagacagggtttcaccatgttgcccaggctggtctcaaactcctggacttgagcagtctgccttggcctcccaaactgctgagattataggcatgagccaccgcgcccagctgcgatcacatactttaaatcatttctaaattatttatcgtagctgatgcaacgtcagtgctatggaagttgttgttgtattgtttgggaataatgacaagaaaaaagactgtacatgtttagtatagacacaagaaaataggcctgcttacattttccatccatattggttgatccacagatgtgggacctgtgatacgagaagtttatttctggatcacataacagttcagtaggaatcacacgttggctcctcccatcttgtagttctgccatcccctatggcctcagaattctttgctgggtcatctccatccagccgaaggatggcggcagaaggacagtggagtaaactgtgggaagtttgtctgggcaggtctggaggtggagtgtattaattccacctacctcccctggccaggaccaaatcatgtggccacacctactcgcaagggaggctgggaaatgtagtctagtcgtgagaccaggaggaaaaagagggtccatgacctgctggctagaaatgaggagcaggaaattactcagtcacactaccagatcctccctgccacatcgcgtccaccaaggtggcctctgctaaagtgacatggttgaatttttgctcctattagggatggggtcaggagggcacccctcccactcgggatctaagtctcttgcacggacaggtgctgttgggcgcatgaccactgctatgggcggctggaggagaagggctgcaacattcgcacacagtcctacaaatacagattcgcgtggggcgtggtcacctgcggtaaggctggggcttcccgttcgggccattggaagagcacctgactttaagttcagctgccctagagaacagccagcctgtatcttgttgggggaggaggagttgggtgcagaactgggacgagaggagcaggattattgcagctgtatcagacccccagggtagggctgaatcatccactgggtgcaaaagtgcttgacatgcttcctttttcttgattcccccacaaaatacctgtagagtatgtttaggcttctccattttagacatcaagaaatggaagctagaaagcctgccagtgcacacagcaggattcaagctcagggcctctgagttcaaggctaaatctggggatggttctgctctatgagaatgagagttcctccagagcagcggctgcctccaccatcagactgggagtcccccagaggaaggaaggtgcttcctctatcagactgggaactccctgagggcaggagctgtctcctgcactgaaacctcaccctgagcagcagctgtgccccttccatcagattctctattcccccgatttaggagccatgcctcttccatcaggctgaaagctcctcggagcaggaagtccatggggtctctgctgagactggagcatgctcttcccaccctcattctgctcttggtgtccttttgcagagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgctgtgggggatcgctggtgcctctttctctgccactggggcaataaacccaaagatgtctacattatctccgaaacagaagggaagattagtaaatgcagggttttctgggatgagcttcaggctttctcttgggctaattttcttacaccttggggtcctctccagtattgggtctcattcttcctcgatggggtcagggaaagataactggtgattatgccagcttcagcttccaggccagagagggtggcattcaaatcccagtgctggcttcttcagctgtgtggtcttggacccgttactgaacctctttgactttcagtctctttgagaaataaactgtcttgttccttgcaatgtaaaatgagacttctaaagcccaccttgatgctgatatggagaatgctgaggttctaggatttcacacagcaggaatttttttttaataggtgtcagctgtggggtttattttttacaaagtaaggacattaaaaaaaccaacccgtctatcaattcataaaagaaaggatgttctgataccaagactgaaagaagaaaggatgtattccaaaacaaaggaacatccttccaagaaaggacctatggcttctttattccgacataccccaaaataactgcatgataaataggtctatatttaaaaagctctagtgtcgaatgttttcaaaataaaatttaattttatgagattaccctgaatgcaccagtgctttagaaaagtttgatttagactcggtgtctatatttgacaatgccacacagggagggacttaaatgctgaatttgctcatgaaatatttaaaatcaaagccatttcccagatccaattttgaatgggtatgtgggggaaattgaagtcttcactctaatcccattttccttcaattgtgatattctggatgacagagaagagaacccagtccagacttctcccttctcccatgggggtcaggtgggaggcagggcagtgttttgctggtaagttctgcaggagggggtgtgggcaggcccttctcattggcacatcccagctcagagtcccagcatccacacaggagcaggatgctatgaggttatgaaggcaacactacaggctggtgtgggattgagttggaaggaaccatggagaaccttcatttatctaccaagaaattgaggcccagaaagttttaggagactgtccaaaagtcacacagcacatcaacagcagaagtaggattcgatctcagatcctagctttaaactctgggctctggccactatcccacattgccttcaaccccagcccacaaaaggagcagttcagggagtcacccacattaggggttcgtcaggggaacccctggattccagctgagggccagctccatgtcttccctgctgcaactgcctctttggattctggaggctgtccccgggtggtcagtcagtctggggctctgggcttcatcctcagtggaggagatcccattgctgtcttccaccttggctgctgtgaacagctctggggaaattatgagagcaaagggagcctcgaaacttggggaaaggcgttctcctcaattgttgcatttgctgatcccttggctggcaggagaaccatcagggaggtcatcccattttaagaaagctagggaaacatacagaccagatcgcaatgcctccctagctagatctttatacatccttaatggacagactgccctgtacatacagatcctttactgtcatctgaattgggcttcaggcacaaatgtgagcctccaaacataagtaaaatgatctctataagcatatctacagaggggttgggcagcggggagcccccttgtagttgttaccaaactgaaaaagcctcaagtaaagcccactgatcaggatggaagggaggaggacagagctaaggtgggctgatgaggtaggaggtgtatggatattcttcttcttct

SEQ ID NO: 16178 - DNA, 12437 bp, Human
tgatgtactggtggatggattatggagagggctaggatgtctcagggagggactgggttgtctaacatagtggtgaggcactccagggccaggagcaatggttctctctaggcagtatgaaagatatttgactttttttttttttgttaaaccaccagtacaaccacacaagtgtattctggctgaacactgatctgtccattctcctccttctctgatcagtttagcctcccctaggcttcttaaagttctccccttcaccctcatccacgatcagcatgcaaacctcccgggatgttatgtgctgtacttagcccttttacttggaatgtctcatttaagccttatcacaaccctatgagtagattctgtacttgccttccttttgcaattacacacacaggatcatatgtgctattaattgttaggaccttgatttgaactcaagctttagaaattgacctcctaaccaccgtggttagtgtcttcaaggagatgcacatctgtttaggtggataaggagtgcatgtacaaagaccatacaggcaatgtggaggcaccaagtggcaacccttagtccacatgcattcataagttgcacagaatcttgtcatatagaatttaactattacagggaggaattcttgatcatgttgtatgaactcttatctactgtataaggccaaacctgtatactcttgaatagatattccataataaaaagattacagtcaacttcagagcaaatcaagtgaaaactccaatttatgttggctacgtaacagtctagaataaagtatggtattctaaagtatgtaatgaaatgaatgaatgaatgaatgaatgaataaaatctatagtcaagagtttcacttataagacctatggtcttatatagtacatgactctctagctagaatattatattcaactttctcaaatgggttaaaagagtctcagggacaagagaagcagaagaaaggaggatgataaaaccatttctgggctttggatctttaattaacctctacccggtcacagatgcagttagaaatgtgttgctcacacccagaggaaatagtatctaacagaaataagtaacactaccctaagagaaaacgaatcatttatgggtatattttattttgctgtttggaaacattttttggtttggacaagaatgagcattagcaagtttgactcatttaattgatgtattatatagaagagatggacattagataatttttaaaatgatggtagagtgagatcttgattgggaaggatagattttctatcaactcccttagaatcatttgtgatattaataaatcagattgttaaataacatgacagaagccaaaataaatgcttagtaaagatgctttggtgaacagttggaagcaaattctattttaaacccttgaaacttggtaagaacctaaaatattcttgctaatttggaaaatacctctttatttaaaatttcctaaaaggtagcctctcctcctacttttatgatggaatactggatgattttagtcaaaagacatagttattaccataagaaaaagtcctgcatgaaagcacatgttgccatcttactcattatcaaagtgcccttatgactgtcagagagaacaggtaagatgccaggggaggccgagaaaaagagatcaaagtgtttttgtttacttttttgaagtcttgtagtacctactgtttattatacatacttcttgattcatgctgaaaattggaattcacccattctctctttttcctgtcaaagatgcagatggggcacatttcgttgactccatcaatccctgcccccacacattagcacatgcacacgtatacctagccagtggaaaagaaaaaagagttactcacattcatccattttacaaagatttccaggctgcaatgggagggctttacctctccctgaaggatgaataaataggtagcttaactgacaacctgttctcagtcaagctgaagtgaaaacgagaccaaggtctagctctactgttggtacttatgagatccagtcctggcaacatggagaggattgtcatctgtctgatggtcatcttcttggggacactggtccacaaatcaagctcccaaggtcaagatcgccacatgattagaatgcgtcaacttatagatattgttgatcagctgaaaaattatgtgaatgacttggtaagactatatttgtcacaacaaaatctaaatcatacttttcaattaatataaaaggagggtttggcttataaaaataactcagaacaaattttcttttgctctaggtccctgaatttctgccagctccagaagatgtagaggtaagaccagttgaatttatttctgaaaatacattggacataagtttttaaatccaataagaaagacattagcatgattatataggagtatactgaattttaatgaacttagcggtctaataattgatgaaatatttatttatattttggttaaattcattgatttaccaaaaaccaactaaaaaatgctatattatattcctcataaactatgtttatcttcaagaatctctaagagtactcctaagtagtattgctgagacagaataacaaaactagaaacgaaatctatactctgatcagtttctgaacaatgcacagctagttactctttaagagcccttgggcatgaaagcttttgagccttctttgttatcctaccgaagaaacatagatacatacagtaggaagcagaattaaccttttaataacaaacttaaaaaagaaagaaagaaagaattagattacagggacagcatggagaaatggtggtgtggaaatcaaagctgtcctttagaatataattcacatataccttggcctcagtgagtcttgtctttggccttccgtgaggtcttttgaaagaaccattttcaacaattcatcccgtctcttaagccatttaaatccattagagttccaggaagaagaggcctggcatgtagttcaagagtgctgtccgctgatctttttctccagtaacttctacgatctgatcttctggtctggtaccctgagagtataaatgcaattggggaaatgttttcattgtcacagacctttaattgcataaattagaataactaaaagtgctaccagtaattaggacactacaaagggggagacttaagaagatacattgcaaagaaaacaattatcgtaaatgactatgtgtaaaagtttagaaagtgaatgagtcacaactattgcttttctctaaaattcactctctagctctgaacccaaacactctcatttactaggtccttttctaataagcagcatctaaaatgaaagtagcacattcagcttattggaaagacttttccaataactgaaaatacttcttaatcaatgtgcctaattatcaaaacatacatttctagcatctcatgcaccttgtttaactgttatggttagagttctttccagagtttcctggctgtagtctataacttgcaaaataagaaataagaaagagattccaccttctaacctgagttggtccagtgggtacttcctttacgtgtgttgttaatgaaagatattttttatcttacatcataatgaaaggattttgtctccgtgatactgtatctatctgataatctgatcaagcaatgctggctatgatataagtgagtaatagtgtaacttggatctttaagctatactagtaggcaaactcaggaagaaagaaatcgttcaaggtcacattagcattatatcaagctagcttcaaagtagggtctgtaagagattttaaaagatttaaaagtttaatgaaaataaaactatctaatgttgcatgcatatagtaattatctaagatctctaattggcctagccaggcatctttctttttctctttttctttccgtctaatcatataaccagtggttctcaaccggtggtgatttttgtgccccagaaaacatttggcattggctggaaaaatttctggttgtcacacttggaggtagaatgggggtgctactggcatctagtaggtagaagccaggtactaaacattctagaatgcacaagacagccctgacaacaaagaattatctagccccaaatgtcagtggtatcaccgttgagaaaccctgatataaacctagtttgtgtgtaggacaaaggtaatcctttttttttttttttttttttttttttgagacggagtctcgatatgttgctaggctggagtgcagtggtgcgatctcagctcactgcaacctctgcctcccaggttcaagcgattctcctgcctcagcctcctgagtagctgggactacaggcgcacgccaccacacccagctaatttttgtattttttagtagagacggggtttcaccatgttggccaggatggtctcaatctcttgaccccgtgatccacctgccttggcctcccaaagtgctgggatgacaggcgtgagccactgcacccagccaggacaaaggtagtcttgcccaattagcaagacttcttagtgtgaatggccagggctttctttgcaaaaggaaaaaaatgtaaaaataggcctcagctgggtgaagtggctcctgcctgtaatcccaatgcctgtaatccttttgggaagccaagtttggaggattgcttgaggtcaagagtttgagaacaacctgggcaaaatagtgagacatcctgtttctacaaaagaaaaaaaaaaagccctaaggaggtaaaaaatttcaaaaattcaattgcaaaacaacaaagccaagtgtgactcctggcaaaagcagcacttgacttgttcttcagctgaagaggaatggtttgttaattcttgcgtttgactttactaccgctccttctagtctgcaaaacaatgtagcagcagaaaactcctcatgttctcatatgttaaagcatgagggaaacaaagtcttgcctttggagtctgttgtcaccaaggcatagcaaaggaaagcaatgttcatgcttccagacagtgctaaatatggagttggcatcctgtagactcctgagtgatagggcacctgaggctgcctaaatcaaggttaatcttttcactctccttctcaatacatccttaaggcagtttagtggcgacagccctctacttcttttcctcttttgaggctgcctttgatgtgcatataaagccaattcccgcagttatttatcctggaccacatattgccagacacagctctgctgcttgcagaacaaaagaaaacaaaaccccattgtctgttaacagaggtaaacaaggaagggtgggagaggaagcacagccccatcaatatgggcgtcagtgtccaggtaccattcaaaggctttcagaaaagattttcagttgtttttacaactgaaattgtagttttacaatttcagtgctttgagtaccggtactgaccattcctggcaatattatctcaagggagttcatttggctggcagggcccctctacttctttggaacctaattttctttcagcatacacatgtaaatgttaactcagcaaaatgagcctctgtgagaaatgctggtttttcagatcatcacggatgaagcagtcagtattttcagtttcagctggaaaatttacctctttaaatatgaatattattttttccagtaagttaagccggttgtggtcaaaaagaagagaaaagaaaaaacttcaacaaacatgaacgtgtggttttcaaggaaaaaaaagtgctatattgaacatttataaatagtttctattaaataagcattttggcaaacatatggaaaggacaccaccttgcccttatgagaggcaatctgccttgatataaggaaaccagataagctgcttctcggcttgtggctatatatgcaaagcaaacctgataggtttgtgtcttagagatgcatattattaatctacattcatattgggtaagcatatgggttggaaaatgcaaagcaggccagatgctgtgttcagctgattgtccataagaagattcaggtaatattgttacgtataggcctgcctttgtagggactgggagggattgaggcttctggttataaggtagtagcttccatatgcatagtgaaatgaaaatatagcaacttcagggggaaaatagcatcacatacacacgtttgctgaaagaaaaaagtaagttggatacaagtcacctggatataagcttttggatcagcattaaaatttttcaacaagtcagtatatgtttggtttttccagtaaattccatttcctttccagtttgatggctaagcttttggcttgttagtcattagctatttttccaaaccaagagataagtgtttgatgcttattttatccgctcctccattctctgagaccctattcttaccttctaagaaatgactttccgtctcattggttggacaagcctcaaactgttcctcaactgcttgattcaggcagaatcctaaccctaactgagctgggagtatgaaaagggttttagaaaagtcatgtgtgatctatggcaagtatattgaatcttagatgtaaaatatgctatcagagggaggtacccacttcctttctccaaaggaggggctttaattcattttcttcatctgttaactttacaaatatatgttgatcattaactggcaagacactatgcctggcgctgtacagaataaaatgctgctcaagacatgtcatgatagatacattaacagaaaccacaaacaaatgaaaaatgttcttcatcagactataacataatttacccaaagctgccactagtcacagtgtaagttttagagcctcataactcagcaaatgtgtcctaaaccgaactaactctcctttataaaacacaaaggtcttgtccaccacccagacatcaaaatggtcctctgtgtagcatcaggaataaagcattgtgaagaagtgaggctcctttctctcttatctgcgaagcaggggattgtccctttttcccatcccaaagattaagtaggaggtgaaatcatacctcactcatctgttgaaacgatgtaatgcacgacattgcagaagagatagaaatagaggattgggaaagctatcttttactttctgaataatgtttgttaacatatatacaaattgtttatctttcagacaaactgtgagtggtcagctttttcctgttttcagaaggcccaactaaagtcagcaaatacaggaaacaatgaaaggataatcaatgtatcaattaaaaagctgaagaggaaaccaccttccacaaatgcagggagaagacagaaacacagactagtaagattgtcatttgtcatctctcttatttgtacttataaactatatatcttgcattacataaacatacacacacacctgtagccagggctgctggtgtcttccttacctatagttatgccttattatacatggtgctttttttttttttttttaagacagagtctcactctgtcacccaggctggagtgcagtggcgtgatctctgctcaccgcaagatccacctcccggtttcacgccattctcctcctacctcagcctcctgagtacctgggactacaggtgcccgccaccatgcccggctaattttgtttttgtatttttagtaaagacagggtttcaccatgttagccaggatggtctcgatctcctgaccccgtgatccgcccgccttggcctcccaaagtgtggggattacaggcatgagccaccgcacccggcctatacgtggtgcattttaagaagtagggtcactcttttaagcccacagacttgaaagtattcaaaaacccaattataatttcctagtagtccttggcagctggaatatgttaatatagcttctcaaggtgaggaagtcattaggcagagaatccaactgtgattttggagttaagaactatttcctctcatatggtcacagataacttgtattcttattaacaggagctagatcctagctttctaacaagaaaagagcctacaagaagactagggcaaatcttaaactttgcctcctctcttaaatcatattactatcctgtacatcagcagagtcagtattgaattgaaatagggaggcctcattacttggctggggaattttaacagtcccaagcttttaggagccctgagatcctcttgtatatgccaactcatgagcaatgcagatacccaagaacatgagtaattcaaagattaaagccagtgggaaaatacataaaataaattactctcaaaaaaaatttttttttttgagacagagtctcagtctgtcgcccatgctggagtgcagtggcaaggtcttggctcactgcagcttccacctcccagttcaagcaattctcctgcctcagcctcccaagtagctggaactacaggcgcacaccatcacgcctggctaatttttgtatttttagtagtgccggggtttcaccatgttggtcaggctggtctcgaactcctgacctcgggtgatctgcccgcctcggcctcccaaagtgctgggataaacaggtgttagccatcgcacccagcctcaaattttttaaattagttcttttgcctccaaaaacattccacatgtgattcaaatgaaatcttaattatattatcaaaattattcttatttcttttgattgcttggcctggtgaccatgtgaaaaatatccctctaaatctttcctcagaaagaaaggagctgaacatatttttgaaactcatgaagtggtagctttggagctaaacttagaactctccagttaagcatgttcatcttatagatgaggaaagtgagatctacaaaggagttaagtcactagccccaagttccataaatagtgtcagaatgagaattagaacgtatatctactatcttttagtgaaatgctctcactacaacatcacactggcattgagatgctaactaccaagcaatggcttggtgtttggtatctaaatagggataaagacaaagagcataaactaagaaagctttttaaaaatctaagtgagcaatccatatatgaaaaactgttcaatctccctagtaatcacataaatgcaagttaaaacaaggaaatcctgttttttccaattaaacattttaaacaataccctataataataagaatgctccaagtgaaaagaggtaaaaccctttataatgtatatcaaagccttaaaatttttatccctttaatttagtaattctacttctaggaatatatcaaataagcaaagatatatatgaaaaattatttacagagatgttctttggagtaatgtagacaaaaataaaaagttagatacagctgggtgtggtggctcatgcctgtattcccagcactttgggaggccgaggcaggcggatcacctgagatcaggagtttgaggccagcctggccaacatggtgaaacctggtctctactaaaaatacaaaaattagccaggcatggtcgtgcgtgcctgtaatcccagctacttgggaggctaaggcaggataattgcttgaatccaggaggtggaagttgcagtcagtggagatcgcgccactgcactccagcctgggtgacacagcaagactgtctccaaaaaaaaaaaaaaaaaaaaaaagttagatgcaacctttgggtccaaaaatagtaagagttgcatcctatgttggaatacagaacaaccactacatgtcatatttttgaagattatttaacacttaggaaatcctgtgatatgttaagtgtgaaaaaaaaaaagcaaatcaccaactggtataaataatgtaaatgcacaataataattaaaaatacccaaaacacagagagaatatacattaaaacattgcagtgggattcctatctctgggaatgggattacaaggactttttccattgttactttccaaacagttttatgtacttctcgaatgtttttcagtgaacataatttatgtttttaatgaaaaaaaattttaagaaacattttattacgaaaaaaattttaaagaagactgttactttttcattgatttctagacatgcccttcatgtgattcttatgagaaaaaaccacccaaagaattcctagaaagattcaaatcacttctccaaaaggtatctaccttaagtttcatttgattttctgctttatctttacctatccagatttgcttcttagttactcacggtatactatttccacagatgattcatcagcatctgtcctctagaacacacggaagtgaagattcctgaggatctaacttgcagttggacactatgttacatactctaatatagtagtgaaagtcatttctttgtattccaagtggaggagtacaatatattagcgatgggaaaaaaaaactcataagtgtgcaaagtcaggattatttccccataatcactatacaatagtctgatttcctatgttattgatttctatgacttctgaagtttttactttatctcactgcccaactttgacatttcttggttgaaggagaaggctaaaatttttaaccaaaaatacagttttgacatctattgattttatattaaccttgagcttgattaccaccagaatgaggtctattatgatcataacttaaaacatatataccttcattccagctgataatatagaagcatagaagcaaaatatataaaagcaaaatgaaaagttgacatctttattcttttaaggaaatgaaaactgagtgtttaaaaacttatatctgaatagttttttaaatctcagaatgtctaacatataaatatgtaatttatttatgcaccgggggatactagatggctataaaagccttacttctttattggggtttataaaaatatttaaatactatagatatgaatgtatttatggaatagactcttagtcagtggcaatagagtattaagaagtggatttaatattaccttcctccagcccccagtccccttataagctaacatttcaagcttgtggaaatggcaatttaaacctatagagggacatatgccaggttgtcttctggaaccaaacatagttttaaaagtattgtagctctcttctcaaactgttataatgatcatattatgagcaagctagtaactccaaatatttgtctccttctttcttctttcgtttcttttcttccttctttttaaaatgaaacttctgctttgacaaaatttcacaacatgtttaacattttggacacttatagttactatactttggataagacaaattcaatcacctatataatttaaaaatcaggagacaaaccaagaggccaggactcctgtccaagttgaaaacagactttcgcataagcattccaatctttcagacttgggtagtaaaaacaagcaacctactctacctgccatttcatatcaactccagcacagcttgtttaaacatgaagttaaaaactctagaaaagtaaaatgttcgctagaatggtataagctatttgagaatctcttattgttaaaatagttgtgattatgcaagaggatgtgggatgagaaatgctttatgctctgagaagaaaaattatgtgcttaaaacaaatacagacttaacctacagttctaaaagatatattgagaattatttaatcaaatctcaatgaaatgttttatcatcagcaagtagactcagaaaaaagaaaaaaaaatttatcatcagaaacaaggtactctgttttaacattttagaacatgtatgacaaaggaattatgtgcctgatgatgataatatatatctaaaatgtgcctcagtttcaaatacgccagcccgggttgttgtgacaaaatgtggaagcaggcacaaagatagtgagaaagatggaatctgtatttcttgtttctgaatgtatagctattaacttcttggatattgtatttcatatttaaaataatgtatttcttttggcatgtttattgttaaaaatttctgttccaattattttgatcagggtctctatcttaaaagtaaaaataactcagtgagggtttggctaagagccttcattaaacagagtttaaacacccagataaactctgctgtttaaccagagttaaacccaccagcactccaggaaaggcaatgcattggaataaacaagatgaagcagtgagacttgaacagctccatcttcactgctctatgttcaagatggccagttcttaaaaggaatataaagataacccataaatataactgttcatctatggacagtaatacaggagacgtgaaattttgttgactatgaaatagtggtcactgtttaaactctttgggtttccatttctttatctgtagaatgagag

SEQ ID NO: 16179 - DNA, 157644 bp, Human
  misc_feature (1)...(157644): n = A,T,C or G
ccacttagtgtgtgatcttgggtattaaactttacctctgttttttattcatacaatgaggatcctgttagttgctatattcatagggttccagtaaagatagagctgatatatatatatatatatatatgtcaacatatttccattaattatagtacttaatggattattatttagtcactaagaatgctaggtgtaaaactctgtgccaccatgaaaaaagctgtttataaggtttatttaaacatgcgtgtctgtggataaagacagagggaaatgttcagataatcattgttttgggaagggcaagattaggtttttagaatttttatattatgtggttgtctgtttgttcaagtaatgaagttcttgtgcagttgcaaagtacttaacaaatggatgatggtgatcttagatctgactcccttctaactctaactttcagtattacattgtgtacccctaattttattttcttctttattgtatgaagtaaaaaattggctaacatgaaaaccatggaaaatgtttgcaagaatgtgcagtaatcagaattctcatactatcaattgtaaactggtacaacgcttttagaaaaatatttgctgtgtagcaccaaaattgaatatatccatatcctctgatccaacaattttactcttaggtatatactcaacagaaatgcatatgtatttgctagagtgtttctgccagcagtatttgtaatagtcaaaatctagaaagtacccagatgcctaccactagtggaatggataaataacctgtcttatactcatataatagactactatactgccctgaaaatcatctatcactttaacacatagtgtggatgaatctttcaaacataatgttgagcaaaagaagccagacacaaaatagaacatgctgtatgattatatttacataaagtagagaaatattcaaagccctcatctctgttagaagataagatagtggttatttggagaggccagtggctagattggagggagtgtgagaatgaattttgggtagcaatgttctgcttcttgatctaggtactacttacatggatttgttcaactgtaaaattcattgagttgtacttttgtacttttgatgtatgtacttttctgtctatatataatacttaaatacaaaacttaaagaatgcagaaacatttattggcctcaggctgtgataatctgatgcaacttatctctattacagagtgcccctgtctcagtggatagggtgtttcagtcactgagcctggtcatctctgccttagacaaggcatgactggatactatcagctgttgggttgtgagattttttttcccccattgaattatacttactcaactttttcattccagacagtgtctccagacagagactaagatacttggtcaattttatcctttctaattactgtaatatttcagtagtgagatcagttccaggtcattctcacaagttcttgcaaccatttcttttgtggtagaaaaaaagcctattgaatctgggggaaaagaagtggtaaaatttactcagcatattgttgagatgataattttttgtttttttttagtagagacggggtttcaccatgttggccagactggtcttgaactcctgacctcaggcaatctgcccgtcttggcctcccaaagtgctgggattaccggtgtgagacaccgcgcccagctgagatgataatttttatcttcattacttggacaaatcattttccatttatgggcctctgcttttctcatctgtaaaaattgtgaattaatattgaagaaaactgtgaatttactgaatgtattatttactgaatttaatggttgaatctaatggttgaacctattatacagtttttttgttttgcttattttcttatttccttggtgtttgtgtagctgagaggccagtacagaaaacattatttgagttacagtttcttttaaaaatattaattgtattctcccattacaggtattaagaaatggagagaaaaataagcagaatccaccttgtttctgaacccagtataactcattttctacaagtatcttgggagaaaacactggaatctggttttgttattacacttactgatggtcattcagcatggactgggacaggtaatactaaaaacaaagtttttataagtaaaatttaagtgtgctattcttcagtcctcagggatacttttccattagatattgggtaaaactgatattaattttacttgctattgctgtcaaatttatacacaggtttgtaatatttaatgccactttctatatttaatagtaatagaaaaacaaacgtgtcctagaaaattccggttaccatttgaatcttagtaacttggatttgttcagaggtttaaaatgacctctttatagaaaatataaatagtactttctaaatacatcttttctcaggaccccagggaagaagtctggggcagaggaaggagattggttaggtaaatgggtatgtgtgttgccttggggcaatggggtagtggtgggttatttatttatttattttccccagtgaacatgtattacatttgtaacaaaacaggaccagagtctaaaaatttgtaatgcaaggttcacacccacatttaggatcttggctgtgattttaggaaatagatttttttaactctttggtaataatattttaaaaatgctaatgaccctcaaatcatgtatggaacatggtggatataaagtaaaaatatgtagccttatattttccttatatacgaagttttaatactcttctaaagtatcttattgaaagatttaaagaactatttttataattatgcaaaagtcttttctagagttatgttgtgaataatgttttctgtaagataatttttacatgttaatttacatactatttatatcttctattaactttagaaatatttctctagaatttgttaccatgattattatatcgtctttaaaattacaatacattgtaaaattttgtttctttcttgagcgttatgaattatgttatacaacacagtcaaattgaatttatacttacagagtttcaaaaaaattgtcttttttgacacagaacaggtaatgttgatgtagggattcctgtaaaataaagaattttcaggggtaatatttgcagtacttattatgatatctatttaagctacacatttatctgtaagagaaagcagaaatcagattggttgttgcagttcaagagtagaagatttgtcagcttggttttatgtatgccagagagattatatccagaagacaatatttcttgttttagggtgaagagtgtataaggctaaagacaagggcaatagattaatgctggtcatctgggtaagaagagcagttctaacaacacagcttggaagcaagtcctaggggaagtggttgcttgtatgtaaggaatactgtatttataactttaggtatttctaattggcaaatggcgtattctgtatacttagttgttgtcagacagatgaccttaaggtgtttcaggagccttaattatcaaaggaagaggctgaattctaatctagtccataagcctcattcaccaagataaaaatcagtgataatatgttatttgaaattttttaatcattaagtattgggggaaaaaagaacactccattaactcttatctcttaatttaaccagaaatgtaagaaccttacatttatggaacatttcgtttatatcatacaattgtgctggcatcattcttaataatattaacatgaattatcatttcactagatggtactgatttatactgagggtaagagacacatttggtttgtcaacactctttgcaattatctagaccggtacctacgaaatacattctcaatgaatacttttttgattgaaagaatgaaaggatgtctcaaatatataaaactggtctgcgaaaaaagaaaataaattgttcattttagagttagcatgtttttgaatgaaaactccagttttatatttacttattgttgacatttgtcataactgcagtatattctaccatttattttttagctagtggaatttaatgtgacaaaaatgtgatatcaaacttatgtattctcaggtggattgttaccattttggtttcctgtaccaaacaagctttaaaacagaaaattttatagtgcactatgtggtcattttattttcaaaaatatctaatagtgtttaaatctctcatgtgttttatgccttcattcatttctgttttcttgtttacatatcagggacaaaataggaaatcaaataatataacactgtgcccatgtttagttaaggcttattccataaatgtgatctggtactttacatgtagacaataacatcactaaggacattgaaacaattaaataattgaaacatggaaacggatttccttccgatacctcatcctgtttttttttgttcaacattttgattactgcaaccttcaatttggacaattttttttctctttttatttgagtgaaattaaaaggatgtaagttttcttttaatctcccctacactaaactcactgatttccattagcaatgttttatctaatgaatgtttttgaggtccaattatctaattatcatgtggtctatcatcacatcagtattacaggcggttatatcacaggggtaagtcacaaagtgggttaatgatcgatgactctgactttcataagaattcctattggcagtaggaaacttatatcacccatctctggagtagtttgaagtttattaaagagtaaattaaactttactaattgttctattatccactaattagatccacttataattatcttgagtgtaaatattttttgacttatatggaaatagtgacagaactcagtggaaagaggattttaataaatcaagcagtgaaatgggtttatgatgcaataccaactagaatcctaatggtatgataagactgtatgtcttctgagctccagtacaagcttaggatgtgtgcaggcttttggctagttatatataggtatctgaaggaaaaaaatcttctttcctcacttacatcttcatctacctataaacactgcaaaagtgatgcttttcagtgttaaagtgagtctcagtctgacttctaccagttccttgttttttggtcatgttgggctgctcatgttttatgccttattatgtggttcagttgcattcttgctgaattttattatttccattgcctttattcttggtcactgaagttttagagcatcgcgtgcttacagctatactttttccagatgttcttggcacagaattcaaaactggtgaccaggttggttttttaggattgaagccctatgtaggcagtcagatttccatgtttacttttataggaatttttcaagtacatttttgaacaaatagctgttttacataattaatttcctttcatacgtttttttctccttcaaaaattaaatattccgtaataatcagcacagtatttattaggagaggaaaataagaggatatctaggatgataactgacagatatctaaaatgttgtctaagatattagcacttgaatttgagctccacaggctagcatttttggaatgaatgaatgattacatattttcagacaggtatcttttcattttaatgaaatttagaatacttttaactagatgctttttaaatagatgttctctgttttcttttgtgttttcttcaagtttttctatggccgcattaaagatggcatctacaaatttatttcctatttctctgtgaaataactgttcttcctaggtattggtgagttaaagttagatagttactttttaacataatgcaaacacaaaatatgaaattattccttaaataggaagcatttatcttcttctttttttttttttagaagagctactagggcatttgaaagatcaataggtttgatagtgatgatcatattaaatgtgtccacttccaatagagaaaatgtgaaagtgttttagaagctgttaatatatgaatataagctatttttattcttacctccttccaaaggttgtgtgacgtatgagaatcatattttattatcaaaacttgttatcaaaaattgatcatataaaaatattggtaccttgcaagactccctttttcattaactgtcatgggtcttccagacacttgatagcatagagaccaaaggtatgaaaatgtgtgttccattttagggattctttaatcatgatttccttatattctgtaatattttatactaatgttgtttttcaaaattatggatggaaataatttatccaatgtttcatgtctctgcttcacctcaaaataaaacatgcagagagatatgagtattaatcccagcttcactagttacttacttcatcaccctagaccattacttgatctctgtgagcctcagttttctcttttgcaaaatgaaaataatatctgtttttcagttttataaggaattaaaatagataagtgtaatgcataagtatgaaattatacaaccatatgagacttttatcattactgtgatagcctaaattaacacaggaaaccatccaaccacacacacattccaacaaataacgagattgaatcttgtaattttaaaaacaaacaagtatgcagacccattgccacttttgagtgtaagaaagggaaaacctcagacaccatgtttgaagaggtatttcaaaaccaaagtaattgatgagaattaaagcttacttgtagattcatggaatatctgaactagatatacttctagatgacagtgagtataatgtttgagtgaggtagaatgttgaggcttcagacctcttagggaattggagttgagctctcagcataaagaaaggaacctggaaaatatatgctgttaataaaataatcttttaaaaaaactactactctctgtccagaggatgcagcataaaaacagaacaatccctaaggactatgagtgaataaaagtctcaagaaaaatcagaaccctaaacctgtgttatgtgtggatgggaggtttaaaatggaacactttgcctcaaatgtaaaaatcgaggtgagaaattaactttcaaaactagtcccaaactgataaaacttgtaatgacccccagaaaggcaaccttcatttaagaccacttcttcccagagcacttgccactttggctagaggtgagctgtactcaaatgttacaaagcatgaaaggaaaacaagtaaaacaagaatttttccacagatagaagaaacataatttataccccaggagccacacataaatacagaaatgaaagagatcttaaaatacgtttatttaaatatttaaaagaagggtaggataagaacaggatataatgacaaaggaacaaagataatatctagaattgaaaatataattattgaaacaaaaatctcaatgatagtaaaacatcagctttaaaaatacctagataagagaattggaagcggtctctagtatagtatgtgttgcagaggagatgctcgtacattttagtttccttcctattatttccttatcatctcctttcatccatattttctgttgttggcacatgatatgagaatagtgagctccacttttgcttttgttttactctgcccatatgagtgagaaacacagtataggctattgaatctttgatgcaaggaagaaagatgttataaaatactgaacttattattcattgtaggaaattatctggctttgacctaagagcagttacacaaagtgggagtttctgtaataatttacaatgcgtttcatctgaagacagagaaagaatgtcaagggtttaatgtattttacgagatgtgagtctaaattaatgcatttctcaaaaattgctagttcagtaaaaaggaataatttgatttaaaaatgtgtagtatagggattgattttacttgtttgaatttctgttacatgtgataaattagtactaacagataaactaatattttctcatgtgtagtcatttacttttcattttaaaacttttgttaatatttcccatagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcagtaagtaaaactttccaaaatgttacatagtaaaatgtcagagcatttattgaggaattatatttaaatttaagtgactactatattattcccagaacacctcagaagcaaaagcttgaaaagtacttggtttccaaattagaagaatacttcaaagctaaagtcattaaatatattaatgaatcatgaaaaataaatattggaaaatgtgtttagtttttaatgcttgaaaaattttaaagtattacagagttaattatacaaaagaataatcttgaaaaaggtgagatcagaagttttaggccatcgtgacaggtcttattgaaaaaagttttgtgaaatattgattttaagaaataaaatcaatcaaaatatatctttgaatatagaataattatgacttattttctactttactagagtatatttgaaattgaaaaatgcatagtaagtattaaggatactttatattgtcagatttaaaaatattaaaatagaaataacttgaagcctaagctttgcaaacaagagtatctgctacttattctgctcagttcctgcaccaattcagatcaaggcaggtggtttatttattaaagtctggcactaattatttgtatattttacctaagtttaatagatactgaatttgtttttttaaccagtggttttcagtcatatatgagatctatcatttctgaaggagagggaaggaaatgtttgctacattaagttaacagaaatgtattgagaatttgttttagtgctcaactgagtttaggaaattcttttaaatcaaccttttaaatttggaataattaaagagatttcattaattagataaacatttgtagaaacaaatggagtcattataaatttatattatcgtgtagggaataatgcagagaaactacccttagtaatttatatttaaaataaacatactttttctaattagctgccaatttatataagtttcaatatgctgaatttcttaaaatggtaatttaaaataggttcagtaagaaggttggaactagctactacaattttgttatttattgtaagtgttctttcctgtggcccaagctcaatcggatgatattatatgttacagaagtgcagactcttctaatgttttgaagcagatcattgccaaattgggattaatgccatttcccattcactaaacatttgcatgtaacaactagcattattttgtgcagcgattttctagtttttatctgtttcacacatattgatacataataaattccaaattagtgaggtacattttagaaggctgaaaggcttttgaaatttttgacatgctaaaagacggggcttggtacagttggcatgtatattaatctgttctcacactgctaataaagacatacccaaggctgggtaatttataaaggaaaaagatttaattgactcacagttccatatggctggggaggcctcacaatcatggtggaaagcaaaagaggagcaaagtcacatcttacatggtggcaggcaaaagaacatgtgcaggggaactcccctttataaaatcattagatctcatgagacttattcactatcatgagaacaacacaggaaagacccctcattcaggattcagttacctcccgctgggtccctctcataacacttgggaattatgagaactacaattgaagatgagatttgggtggagacacagccaaaccatatcattccgcccagcccctcccaaatctcatgtcctcacatttcaaaaccaatcattccttcccaagagtcccccagagtcttaactcatttcagcattaactcacaagtccacagtccaaagtctcatctgagacaaggcaagttccttctacctatgagcttgtaaaatcataaacaagttagttacttcccagatacaatgagggtacaggcattgggtaaacatacccatttcaaatgggagaaattggccaaaacaaagaggctacaggcgccatgcaagttcgaaatccaatagggcagtcatgaaaccttaaagttccaaaatgatctcctttgactccatatctcacatccaggtgatgctaatgcaagaggcggactcccacaaccttgagcagctccacccctgtggctttgcagggtacagctcccttcctggctgctttcatgggctggcattgagtgtctgtggctttcccaggggcacagtgcaagctgtcggtggatctaccattctggggtctgcaggaaagtggccctaatcttatagcttcactaggcagtgccccagtggggactctgtataggggctccaaccccacatttcccttctatactgccctagcagaggttcttcatgagggccctgcccctgcagcaaacttctgcctggacatccaaacatttctttctttttttttttttttgagacggagtctcgctgtgtcacccaggttggagtgcaatggcgtgatctccatctccactcactgcaagctccgcctcctgggttcatgccattctcctgcctcagcctcccaggtagctgggactataggcgtccgccaccatgcccagctaattttttgtatttttagtagagacggggtttcaccatgttagccaagatggtctcaatctcctgacctcgtgatccgcccgcctcagccccccaaagtgctgggattacaggcgtgagccaccgcacccagcgcagacatttctatacatcatctgaaatctaggcagaggttcccaaacctcaattcttggcttctgtgcactcgcaggctcaacaccatatggaagctgccaagacttgggacttgtaccctctgaagcaaggcccgatctgtacctttgcctgttttagcgactgctggagtgactgggatgcagggaaccaagtccctaggctgcacgctgcaatgggggcctggacctggcccaggaaactgtttttaccgcctaggcctctggagcctataatgggaggggctcctgtgaacatctctgacatgcctcggagacatttcccccattgtcttggtgattaacatttggctccttattacttatgcaaatttatgcagcaggcttgaatttttcccccaaatatgggcttttcttttttattgcatcgtcaggctgcaaattttccaaacttttatggtctgcttcctgttgaatgctttgctgcttagaaatttcttctgctagataccctaagtcatttctctcaagttgaaagttccacagatctctggggaaggggcaaaatgcccccagtctctttgcatagcaagagtgacctttagttcccaacaagttcctcatgtccatctgagaccacctaagcctggacttcgttgtctgtattagcattttgttccaagccattcaacaattctctaggaaattccaaactttttcacatcttcctgtcttctgagccctcaagtctctaggaagttccaaactttcccacattttcctgtcttcttttgagccctccaaactgttccagtctctgcctgttacccagttccgaagtttctttcacattttcgggtacctttatagcagcactccagtctaccggtaccaatttactgtattagtctgttcttacactgctaataaagacatacccgaggctgggtagtttataaaggaaagaggtttaaatgattcacagttccacatggctggggaggcctcataatcatggcagaaagagaaggaggaacaaagttacgtcttacatggtggcaggcaagagagcatgtgcaggggagctcccctttataaaacctttagatctcatgagacttattcactttcatgagaacagcacaggaaagacccacccccatgattcgattacctcccaccatgtttgtcttacaacatgtgggaattatgggatctacaattcaagatgagatttaggccgggtgcctcccagcactttgggaggctgagatgggcggatcacctgaggttgggagttccagaccaggctgaccaacatggagaaaccccgtctctactaagaatacaaaattagctgtgcatggtggcgcatacctgtaattccagctacttgggaggctgaggcaggagaatggcttgaacccggaaggcagaggttgcggtaagccaagatcacaccattgcacttcagcctgggcaacaagtgtgaaactctgtctcaaaaaacaaacaaacaaacaaacaaaaaaacaagatgagatttgggtggggacacagccaaaccatatcagcctggatggagtacttgccatgactggcagtacatcaggttttaccctttctatgaagaaagagctttaagtcctcttgattcatgtcttctacagttggtttggcatatatcaacatcaaagactcataataatcctgaaagatttttgcttaccaccctgaaagtaaacaactttatcagagccagcatcttgaactacaggtactaccttttcaacaaatgttcacaagtaatggaagcagcctgaaagattaccagcaatgcaaaaagtgtgctggttccccagagaatgtcttaaagcactacattgcagtctaaatatctgtctccttatttattcatttatttatttgtttatgagaaagaaaagaatattctcagaacggcttgacaaggaggagtttattcatggcttggcttgagagatattttggatatttagatgaggtaaaactttcagtggatggatgcagctgagagatcacaagttcatttggccaaggtgtcatgggagtcttccagtattcaggatgtgcttctgcagactgatttcagagtgacaatgtcttgtagattcatctgctggcaaaaaaaatctgcagacaatgggaaacatggcagacagaatacttttttaaagctaattttgcttggatgacctaaaaattgagaaggagtttgtaatccttttcttgatgatacaaacatctgattgttgccaaaaatgacctcctaaacttagaagaaaggaaaagaatgaacataaattcaactaaaaaagttgtgaattctgttgtttcttaatgtaaggttgctcctccgtgacaaagacttgctcccagatgcatacctctgggagtcagggttttaggcatttattgccatcagttcaagaaattttgtgtatctaattgtgtgttcactgtgcaatttgaacattttgaatatctaacttatataagaattgtttgaaatttacatttataacaaactttctttttttcttaaaaggaagtaaccactattttagtattcaaaaatacctgatattttgaaaatcctgtcttatgttttgtctgagtgaaagaattaccagtttctctctctctttttttttttttttttttttttttttttttgagatggagcctcactctgtcacccaggctggagtgcaatggtgcaatctcagctcactgcaacctctgcctcccaggttcaagtgattctcctgcctcagtctcctgagtagctgggattacaggtgcatgtcaccatgcccagctgatttttgtatttttagtagagacggggttgtgccatatgggccaggctggtctcgaactcctgacctcaagtgatctgcctgcctcggcctcccaaagtgctgggattataggcatgagtcactgtgcccagccagaattaccaatttctaatgtagtgaaatatttaaaatttttagcttgtttgtcaatatttatactcatgttttgggagcagtgggtcagcaattttcatgagattgcttttgagcttatcctcccaaaacttcccttaggctttaattggcttttctttatagataacatagatccttttattttaacttcattctcatttgaataaatgttgggcgaacagctacacactaatttcttttctccatagagtgcgaacccatgtgacccttcctgccttagtgctcttcatttaacagtagattgttctggttgaaagcatactatagtgccagcatttggaactcctcatctcttcagcacaaggactgtcactcacacaagagatcatttgtgtgctttgggccactgttttccctctacctttaacaatttatcctgattttgccatacagactttgtcatgctaacaatgcatcttaatgaataatgtattcatcttccttttttgctttcatatctcactctgtttctttagaaaaatattcatttatgagtcaaagaaaaacaattatttttgataagaataaccttgggctagtcatttaaccctaatttcctcatgattctgttttttcatctgtgcaatttttaagtgatttcttagattaattccagcttagctaacatattgtagagctacaatatatgtgtgtgtgtgtgtgtgtgtgtgtgtgtgtgtgtgtgtgtgtatgtatgtatatgtatgtatatataaacattttggctataaggatatgtctttttaaaaaaattaatttaattttattttaagttctgggatacatgtgcaggatgtgtaggtttgttacataggtagacgtgtgccatggtggtttgctgcacttatgaagccatcacttaggtagtaagcccagcatgcattaactatttttcctggtgctctccccttgcctggaccccctgaccagccccagtatgcattgtgcccctccctgtgttcatgtatttttgttgttccccagtgaaggaagctatgaggtttgaagaaaaattaaacatgatttaatacatatatatatgtgtatgtatatacatctccacacacacacacacacacacacacacacacacatatgtatatagtgaatatctaaaactctagaatttgctacaagtctctagtagaattaatgcaaagtctacttctatttctttaccctcatttcccctactacttaaatagcatagaggtttatttttcagtgatataaaaatccaaataggcaaacctgggttaatataatggctttatgatattggagacacaggcttctttgatcatgttcccttggcttttttttttttctttaattgagacagggtcacacttttttgcctagtctggagtacagtgatgtgatcatagctcactgtaacctctgacacttaggctcacaagaacctcctacctcagtctcccaaagcactggattacaggcatgagtcagtgtgcccaacagtctactttgtaatttttaacaggtagtttttatttcatagtccaagatgacttgtctagttttactattatgttcacctttgaggcagcaggacccagttaaagagacaggaaataatatgtgctttttctttaagacagtcactcccaaatttgatacattccttttgctcacgtcccattggccagaatgtagtcacatggcttcacctagctgcaagggaatctgtgaaatgtgatcttcagctgtgtcttgtgcacagaagttttcattactgtgtaaaaactggaagatggatatcaatggtcaactagcaatctatgcatttaacatgcagggaagattgaaatatcattcagaaggctttgctgtttttgttgcaaggatgtttgtttagcatttcattacaaataagggtttcagtcatatttcaatttaagaaatgttacaacataaagtaagtatactttaaaggataaagtaagtatcctactctgtatcttactatattttagaagttttatttattttttagtggaaaatccattctaagtttcagacagccttcccaccattatttaattgacgtttctcaaatatatgaaaatgaggtaaaaccagtttgccaaaataaacatccagagttctttttaaaaacagcagtccaaaatcctatattattgccatgtgtccctgtggtttcagggactctgaattcaaagggctatttccagatgaaatatcagaattgtagcatttattgtgtattctgccaaagattttgtcaaaaatagtaatgactttcaggtctgtgggaatatgggttgcagatgtgttgtttgaatgcctgaaaaggaaatcatagtattctttattttggtgataaaagtatttgtgtacatgtgccattttgatactgaacactatataatttttgtgatctttttggaatgtgaggactaagtaatgtaagtggtgaagaaatcccattaaaagtatacgttttctagctaagccatatattaaattttataatttgaaaaacaaaaatatcagtgtttagttatactgttttttgtttgtggacccattttctttcttgcttcatatttttctgcctttatttaaaatgtttgcttcaataataaatattttaaagtcattatatcttaacttttttgttcagaaaaggaacaacttagcataagaacagagcagaagtaggcatggcatagtggctcatgcctgtaatcccagcactttggaaggccaatgtgggaggatcacttgaggccaggagttcaagaccagcctggacaatatagtgggacccttctctctaccaaaaagaaaaaagtaaattagctgggcatggtgggacatgcctgtagtcccagctacttaggaggctgaggtgggagaataactttagctggggagtttgaggctgcagtgagataagctaaggttgtgccagtgcactgcagcctgtccagcctgggtgacagagacagagtgagaccttgtctcacaaaaaaaaaaaaaaaaacaataacagaaacaaaaacaaacaaacaaaataaaaaaccagaagtagaaaatagcattgtaaaaactatgttgtaaaaggacatttcaatttaacaatattaatatttgcttattttcagttaatctacttcagcatgcaatctcatacttcatcaagcgcacttggtattgtcactgtttatacatgaagcaatacatgctgaaagtataagtgagttgctaaggaaaacaggtagtaagctaagctaggatagaattcaggccgctgttttatgaataccaaatcagtttttttttaaatttgtttagggataatttacaaacaattaaatgtacttatggtgagtatacagttttcagtattcataaaagcactttcaagcctctttgcagtcaggctcccaactacctgttttcttctcccaaccctacctactctcaaggccccaggcagccattgggctgctttctttcgttatagatcagctttacatgttttagaatttcatgtgaatggaactatgcagtgtgtattctggctcataactttatttgcatagtataacatttttgagatgtctcattgtgtgctgtatatcagcatttcattccttccattgctgagtagtattccattgtattgatataccacttttactttttgatgaatatctggtgatttcaagttgtgggctgacatgaataaagcagctatatacattcatgtctaaatctttttgtgggtatgttttaatttttaacaactttattgtgatacaattaatttataaaatgtgcatatagaaagtatacaactgggtaaattttaaaatgtgtacatacccatgaaactgtcaccataatcaagatgataaatcctcaacctgcccaaattttttagtacccatcataattcctttctccctccttcctacctcttcactcagtccccagaaaaccactgattagatttctgtcattatagattggtttacattatccatacatttaaccatacagtatgtacttcttttttcggtctggtttcttttattcagcgtaattgttttgcgattcctccatgttgttgtaagttttaataatttattctttttttcctgctgagtggtgttccattttatggatacaccccaatttgtttatgcattcaccagttggtggacatttgggttgcttccagttttggactataaccaataaagctgctatgaacatttaaatctttgtatggacatatgttttatttgaataatatataggagtagaatagttgggttatatggtaggcatatgtttagctttttaagaaactgcccaacagtgttccatagagttcgtactattttacattcccatcatcagtatatgagttccagtttctccacatccttgtcattacttggtatggtcagatttttcattttagacattttagtgggtgtgtgaccatgtctcatattttaaattagcatttccctaatgtctaatgatattatttgccatctatatatcttctatagtgacatatttgtttaaatctttcacatttgttttatttgggttgcttattttcttactgagttttgaagaactcttcatatccttaacagatacacaatttgcaaatactttctccaagtttgtgggagaagcagataatttcttaactttgaggaacttacttttttttcttttattaatcatgctttgagatcacttctaatgcatttttgcctaacttgttgcagacttacgctttcatgcatgagcgctatagttttagattttacatttagagtctgtgatacattttgagttaatttttgtacatactttaaggtatgggttgaagttcattttttatatgaatatttagtcattctagcaccatttattgaattccctgctgaatttttcttgcactttgttgaaaatcaattaaccacgtgtgtattggtctatattgggactctatactgccccatcaatctatttgtttagctctgtgccagccataatctgtcttgattacttaggcttataataaatcatgaaatcaggtgaaatcatgtagtataacttcttcaactttgttatttttgaatttgctttagttatctattatttcaaatatttttatgaggtgtagaatcagtttctcaatttttccaaacaagtctgctggaatcttaattgaggatgcattggatctacagaattgacatcttaaccatattaagccttctgactcataaatataatacatccatatatttaggtcagtgtttcctacccaggggagattttgctcatctagggtcacttggcaatatctgaagacatttttgattgtcacggccagcagctcctaacaggcatccaatgggaagaaggcagggatgttgctaagtattctataaggtgcagggcttccctccaccccaaaaattatctgatccagaatgtcagtagtgttgaatttataaatcttgatttagatctcatcaattactcagcaattgtttgtagttttcaaattatagatcttatgcattttatattaggtttatcactttgaagcagaaagtgaggtcactgaattaaaactttccttttttctgatatacaatttaggatctaaattttattccaaatgcttcatttggaataacttcattcctcacattttggtatgttgtgttttcattttcatttaaagtatttcctaatttcccttttcattttagtcctcacccttgaattaattagtagtttgtaattttgttttcaattttgtttgatattacagatatcgtgccaatactggtttttaatttaggtccattgttgttagacaactttatgtgacttgaatccctttaaatttattgggacttgtattatggcactgaatgtaaccgttgttcaatgttttgtatgcacttgaaagaattattcatttgctatttttgggtgttattagatgtttgggtatttttaggaattaattagatcaggttggttggtggtgttaagttttctatattcttgcttattttctgtctacttcttttaaaagtgactgataatgtattaaaatcaagaactgtaattctatatttgtcttacttctccttgaagtaatatcagacattacttcatgtattttgagtctttgttaattaggtgtaaaacattaagctttgacatgctctcttgatgagctgacctctttttcactatgaaatgaccctctaattctattgatgttatttgtcctgaaaatctactttatgcatgttcttatactcctctagttttcttttgattggaatccacgtggaatattttttcatccttttgcttttaattatttttctctttatgtaaattagatttcttttaggaagtgtatagttgggtgttgtttttttaatccagtctatcaatctgtgtttttccattgggatgtttaggccatttatgttttatgtaattattgacaattacataaaaaaatggtggtttaaaaatctactatctctgtttgttccatctttattttatttacttgttcctctctgttttattttgggttaagtattttttattattcttttatctttttagttatcttgttatctataactcatctttatgctatttttatgtttgctttagggtttatagcatacatctttaccttatcacagtctacattgaagtgatatactacttcacagatattatggcaccatactttcatttctgcttttatgagcttatgctattgtggtcatacattttacttctacatatcttatacacttcacagttattgttacattgattttttttacttttaacagttaacttacttttttaacttttcattttgaaataactttagagtcgaaaagtttcaacagtaatacacagaggtcctgtgtacccttcactcagctttcccgatgataacaatatataactgtagtacattattgaaagcaggaaattgactttggtacaatattattaactaaactacagactgtacacagattttatcagtttttatgtgcactgtttttattgttcttgttgttgtttcggcatatagttatgtgaatttggttccacatatggattcatgtaactaccaccatagtcagggtacagaactcttttattacctcaaagaaacctctttattcccttgtgttaccccctttatattcagactatccatccaatataatccctggtagccaccgatctgtttgtcactgtagttttgtcactttgagaatattagtggaattgtacaatatatatccttttgagattggctgcttttcactgaccctaatacttttgagatccaccaaatcgttgaatgtatcagtagatcattttctttattgttgagtagtctattcttacctcatggaatgccatggatgcaccacactttgtttattcatttattcactgaaaaaaacctttaggttgtttccacttttttggctattagaaagctgctttggacattcatgtacaggtttccatgtgagcataaattttcatttatttagtacaagggttggcaaacaatagcctgtgaattggctgcccattttgggaaataaagtttcactggaatgcatgcatgcttatatattgtctgtgtgtacttttgtgctacaatggcaaagttgaatagttgcaacagagtcctctatggtgtgtaatgactcaaatatttacctttcgcccttttagaaacaggttgctgacccctgctctaggataaataaatatctaggattgtgaatgcagggctgtatggtaagtatgtgtttaactttatcagcaagtgctacattgttttcccaaatgggtgtactattttacattcttaccagaaatatataagatctacattcttatcagcacttggttttgtcagaatttttgcctttagccattctaataggtgtgttatggtatcttattgtggctttaatggacatttctttaatggccaaggtgctgaaaaatcttttcatatgtttatttgccatctctgtatcccatttgttggtttgttcaaatcttttacccctttttgattgtatttttatttttgttgtatgtgtaatgtgaaactattttcttctagtctcttgctggtctgatcattttattaacagggtcttatgtagagcaaaagcttttatttttgatgaagtccaatttgtggactatttttcttctatgcttttgcttctggtgtcatgtctaaggactcttcccttaaccctatgtcatacaaatttttgaatatggtttcttttaaaggttttgtagttctgtattttacatttatatctataatctattttgaattcctttttgtataaagtatgaggttgaggttcactttcttggctatgaatgtcaattgttctaacaccattagttgaaaagactcttctctctccattaaattgcttttgcatcttcgttaaaaatcattgactggacttgagtgggtctatttttgtattttctatgctgcctcatggatctatgtatctgtccctccaccaacaccacactgtcttaattactgcagctacatccttaccctttaagttgagttatgtgggctgggcgtcgtggcacatgcctgtaattccaacaggccgaggcgggtggatcacctgaggtcaggagttcacaaccagtctgaataacatggtgaagctctgtctctactaaatactaaaaaattagccaggtgtggtggcgcattcctgtaatccgagctacttgggaggctgagacaggagaattgcttctacctgggaggcagaggttgcagtaagctgagattgtgccattgcactctagcctgggcaaaaagagtgaaactccatctcatcaaaaaaaaaaaaaaaaaaaaaattgagttacgtgaatcttccaactttattcttttgaaaaattttattttagataatttacttactttgcctttccacatacacttttaaaatcagttttactctatttatttaaaaaaattgagtcatagagtttatcaacatggtatgtctatataggtttactttgaaatcttgcatcagaattttgtagtttttagcatacagatcctatacatgttttgttagatttatgcctaagtatttcagtctttttggcactgttataagtggtattatatttttaatttgagtttacagtggctcattatgagcatctattaatagaaattcaactgacttcttttgtgttaaccgtatattctccaaactttctaaattcccttatttgttctaggtggttttttgttgttattgttgtttgcttttaagattctttgagaattttttctgtaaacagtgatgttatctgcaaatagatgcagtttaaaggctgttgcagagagcttcaaggcccaggcagagacttgctatggggatggggctgccacagagcccccacaaagtcaatgcccaggggaactgtggggtataagctgctactgagagcccccttctccactactgcaatgcctggtagagctgtgggaagaaggccacctgaatactccagaactaagagccacggtatgcagtgccagcctggcaaagcttacaagcataggttttaaatgtgtgagagctgtaatgtgggctgtgccagcaaagccatgggggcaggaatgtccaaatcttagagactcaatccttccaacgtatctggaaggtgggacatggaaccacataagattattctccagccttatggtctaacattgtatgccttgttgggctttagacatttctgggacttgcaactcccttcttttttcctgtttctctttttggaatagaaatacctgtcttacgcctgcattgtgttttagagcgacaaaacttacctgtttgattttacagggaaatttgcttaaggattaattgttccttgagtctcacccatatctgatttagatgagactctggactttagacttttgtgttgctgctgaaatgagttaagacttttggggctactgggatggaatggatgtattttgtgtgttataaggacatgaatttggggggttaggggtggaatactatggtctgaatatgtctcccaaaatttgtgtgtggaaaacttaacccctgatatggtttggctatttccccacccaaatctcatcttgaattgtagctcccataattttcacatcttgtgggagggacctggtagatgataattgaattatgggggcagtttcccacatactgttttgtggtagtaagtctcacgagatctgatgcttttataaggtgatacccttttcacttggttctcattctctcttgcctgccgccatgtaagatgtgcctttcaccttctgccatgattctggggccttcacagctacgtggagctgtgagtccattaaaccgtttttgtttttgttttttttttaaataaattacccagtcttgggtatgtctttatcagcagcatgaaaacggactaataccatccccaattcaacagtgtgaggaaatggggcctaatggtgcatgatcaggtctggagcaatttattcctccatatagatccagatttccatgtaataatatttttcttctgtttgaaggacttcatttaatattccttatcatgtgagtctgcttaggatgaattctatcggattttatgtatcttccaaagtctgtactttgtctttctttttaaaagttattttcactgggtagagaattctaagttgactttttttttttttttcagtactttaagagcattgctctgccttctggctagttttgttagtttgtttgtttgtttgctgagaagtcatctgtcatttatttatttatttatttttattatactttaagttctaggttacatatgcaggttttttacatatgtatacatgtgccatgttgctgtgctgcacccattaactcctcatttacattaggtatatctcctaatgctatccgtccaccctcctgccaccccacgacaggccccagtgtgtgatgttccccatcctctgtccaagtgttctcattgttcagttcccacctatgagtgagaacatgtggtgcttggttttctgtccttgcaatagtttgctgagaatgatggtttccagcttcatccatgtccctacgaaggatatgaactcatcctttttaatggctacatagtattccatggtgtatatgtgccacattttcttaatccagtctatcattgatggacatttgggttggttccaagtctttgctattgtgaataatgccgcaataaacatacatgtgcatgtgtctttatagcagcatgatttataatcctttgggtatatacccagtaatgggatggctgggtcaaatggtatttctagttctagatccttgaggaatcaccacactgtcttccacaatggttgaactagtttaaagtcccaccaacagtgtaaaagtgttcctaattctccagatcttctccagcacctgttgtttcctgactttttaatgatcgccattctaactggtgtaagatgatatctcattgtggttttgatttgcatttctctgatggccagtgatgatgagcattttttcatgtgtttttgggctgcataaatgtcttcttttgagaagtgtctgttcatatcctttgcccactttttgatggggttgtttgatttttttcttgtaaatctgtttaaattctgtgtagattctggatattagccttttgtcagatgggtagattgtagaaattttctcccattctgtaggttgcctgctcactctgacgatagtttcttttgctgtgcagaagctccttagtttaattagatcccatttgtcaattttggcttttgttgccattgcttttagtgttttagtcatgaagtccttgcccatgcctgtgtcctgaatggtaatgcctaggttttcttctagggtttttatggttttaggtctaatgtttaagtctttaatccatcttgaattaatttttgtataaggtgtaaggaagggacccagtttcagctttctacatatggctagccagttttcccagcaccatttattaaatagggaatcctttccccattgcttgtttttctcaggtttgtcaaagatcagatggttgtagatgtgtggtattatttctgagggctctgttctgttccattggtctatacctctgttttggtaccagtaccatgctgttttggttactgtagccttgtagtatagtttgaagtcaggtagcatgatgcctccagctttgttctttttgcttaggataatcttggcaatgcgggcccttttttggttccatatgaactttaaagtagtttttttcaattctgtgaagaaagtcattgctagcttggtggggatggcattgaatctataaattaccttgggcagtatggccattttcacaatattgattcttcctatccatgagcatggaatgttcttccatttgtttgtgtcctcttttatttcattgagcgtggtttgtagttctccttgaagaggtccttcgcatcccttgtaagttgtattcctaggtattttattctctttgtagcaattgtgaatgggagttcactcatgatttagctctctgttattggagtataggaatgcttgtgatttttgtacattgattttgtatcctgagactttgctgaagttgcttatcagcttaaggagattttggcctgagatgatggggttttctaaatatacaatcatgtcatctgcaaacagggacaatttggcttcctcttttcctaattgaataccctttatttccttctcctgcctaattgccctggccagaacatccaacactgtgttgaataggggtggtaagagagggcatccctgtcttgtgccagttttcaaagggaatgcttccagtttttgcccattcagtatgatattggctgtgggtttgttgtgaatagctctcattattttgagatacgtcccatcaatacctaatttattgagagtttttagcatgaagagctgttgaattttgtcaaaggccttttctgcatctattgagataatcatgtggtttttgtctttggttctgtttatatgatggatcacttttattgatttgcatatattgaaccagccttgcatcccagggatgaagtcaacttgattgtggtggataagctttttgatgtgctgctggatttggtttgccagtattttattgaggatttttgcatcgatattcttccagggatattggtctaaaattgtctttttttggttgtgtctctgccaggctttggtatcaggatgatgttggcctcataaaatgagttagggaggattccctctttttttattgattggagtagtttcagaaggaatggtaccagctcctctttgtacctctggtagaattcagctgtgaatccatctggtcctggactttttttggttggtaggctattaattattgcctcaatttcagaacctgttattggtctattcagggattcagcttcttcctggtttagtcttgggagggtgtatgtgtcgaggaatttatccatttcttctagattttctagtttatttgcgaagaggtgtttatagtattctctgatggtagtttttatttctgtgggatcgttggtgatatcccctttatcattttttattgcatctatttgattcttctctcttttcttctttattagtcttgctagtggtctatcagtttagttgatcttttcaaaaaaccatctcctggattcattgattttttaagggttttttgtgtctcttatctccttcaattctgctctgatcctagttgtttcttgccttctgctagcttttgaatatgtttgctcttgcttctctagttcttttaattgtgatgttagggtgtcaattttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtctggtggtgacaaaatctctcagcatttgcttgtctgtaaagtattttatttctctttcacttatgaagcttagtttggctggacatgaaattctgggttgaaaattcttttctttaagaatgttgaatattggcccccactctcttctggcttgtagagtttctgctgagagatccgctgttagtctgatgggcttccctttgtgggtaacctgacctttctatgtggctgcccttaacattttttccttcatttcaacttcggtgaatctgacaattatgtgtcttggtgttgctgttctcgaggagtatctttgtgacgttgtctgtatttcctgaatttgaatgttggccttccttgctaggttggggaagttttcctggataatatcctgcagagtgttttccaacttggttccattctccctgtcattttcaggtacaccaatcagacgtaggtttgttcttttcacatagtcccatatttctcggaggctttgttcatttctttttactcttttttctctaaacttctcttctcacttcatttcatccatttgatcttcaatcactgataccctttcttccacttgattgaatcggccactgaagcctgtgcatgcggcatgtagttcttgtgccattgttttcagctcattcaggtcatttaaggtctcttctatgctgtttattctagttagccattcatctcatcttttttcaaggttattagcttcttttcaatggattcaaacatcctcctttagctcggagaagtttgttatgaccgatcatctgaagccttcttctctcaacttgtcagagtcattctctgtccagctttgttcctttgctgacgaggagctgcattcctttggaggagaggaggtgctctgatttttagaattttcagcttttctgctctggtttttccccatctttgtggttttatctaccttcggtctttggtaatggtgatgtacagatggggttttggtgtggatgtccttcctgtttgttatttcccttgtaatattcaggaccctcagctgtaggtctgttggagtttgctggaggtccactccggactctgtttgcctgggtatgaccatcggaggctgcagaatagcaaatattgcagaatggcaaatgctgctgcctgatgcttcttctggaagctttgtctcagaggggcacctggccatctgaggtgtcagtcggcccctactgggaggtgcctcccagttaggctactcgggcgtcagggacccacttgaggaggcagtctgtccattctcagatctccaagtctgtgctgggagaaccactactctcttcacagctgtcagacaggaacgtttaattgtgcagaagtttctgctgccttttgtttagctaggccctgcccccaaaggtggattctacagagccaggcaggcctccttgagctgcgttgggctccacccagttcgagctttctggccgctttgtttacctactcaagcctcagcaatggtggacgcccctaccctagccttgctgcccccttgcagtttgatctcagattgctgttctagcagtgagcgaggctccatgggcatgggactctccaagccaggcgtgggatataatctcccagtgtgctgtttgctaagaccattggaaaagcgcagtactagggtgggagtgtcctgattttccagttgagaggtgacaacatgcaagcagcccttgcttgctcttggtgcctccttggccttgtcgtctgctctggctgcacttgaggagcccttcaggccaccactgcatatgagggcccctctctggtgcttgccaaggctggagctggctccctctgctggcggggcagtgtgaagagagaggcgctggcgggagttggggctgtgcgtggtgctcgcgggctggtgtgggttccaggtgagcacgggctgggcaagcgccgcagtcttcacggccggctagctccttctgggcttgatcggaggctgaatcccatgcttggaccgctgttccctattcgtggaatcattgaccatgatagcaggtctccgtctctttctcgctttccctattttcctcttgattgtctggaacgagctccctctgggctgccggagtgtccggggtaggtgccgcaaagtcccgcggtgagtgccagtgagaggtgaagctggctgggcttctgggatgggtggggacttggagaacttttgtgtctagctaaaggattgtaaacacaccagtcagcactctgtgtctagctaaaggtttgtaaatgcaccattcagcactctgtgtctagctaattgggtggtgacttggagaacttttctgtctagctaaagggttgtaaatgcaccagtcagccctctgtttctagctaaaggtttgtacacgcatcaatcagcactctctcaaaacagaccaatcagctctctgtaaaacgtaccaatcagctctctgtaaaatggaccaatcagctctctgcaaaattgaccaatcagttctctgtaaaatggaccaatcagcaggatcagggtggggccagataagggaataaacgcaggcaacctgagccagcagcagcaactcactcgggtacccttgcgtgttgtggaagctttgttctttcattcttcgcaataaatcttgctgctgctcactctttgggttcgctctgcctttatgagctgtaacactcactgcgaagttctgcagcttcactcctgaagccaacaagaccatgaaccctctgggcagaaggaacaactctggacacgccaccttgaagagctgtgacactgaccgcgaaggtctgcagcttcactcctgaaatcagcattgaccacgaacccaccagaaggaagatactccggacacatctgaacagctgaaggaacaaactctggacacaccatctttaagaactgttaacactcaccgcgagggtccgcagcttcattcttgaagtccgcgagaccaagaacccactctaagtaatcaattctggacacacaggtaccgtctgtcatggcatcccttggctaggaaaggtaattgcctgaccccttgagcttccagggtgaggtgatgccccaccctgcttcggctcatgctctgtgggctgcacccactgtctcacaagtcccagtgagatgtacctggtacctccattggaaatgcagaaatcacccatcttctgtgtcgctcacactgggagctatagactggagctgttcctattcggccatcttggaaactcctcctaccttatctttcttatctaaggcagtatgccttttttttttttcctcagctgcttttaaggttttttcttttttatcactgcctttaagcaagttgattataatatgccatgatgtagttttctttgtttattgagctttgatctattcatttatagtttttctattttcttttctcgttttttggggattccatttatatgtatattatgtttctgaaatttatcacacagcccactgatcctgtattgccccctgccaccatttttttgcttcctgtgttttgttttggatagtttctattgctgtgtctttacattcgctaatcttttcttctgctgtgctttgtctaatgtgttgtttttttcatctcaggcatggtgatttttatctttctaagtcttttaaaatatatttcaagttttgtttacattcttgaacatagggaataaaattgtaataacctttaatgaccttgtgtatgaatatttcttaatctttgttatttttggttttgatagatttttctgctccatatgtgttctgtttttctttttctttgcatgcctgtttatctttgattgtatgctaaacattgtgaatctttttatttggtacagtatatttgtatattcctatacacttttgctttgttctgggacgtaggtaagttatttagaaacagttatactttttgctcatgcttttaagctttgttaaacaggaacaaacatttattttaggtttaattttaccccgctattgaggcaaaatacttctgagtccttttacctgatccctattgtttttatacaagagggtatagtgaataattttgtgattatatgtggtattttagctttgtgtgtcaaatacatcatcttgtctttagcaagctagatcaccaattctgacgacccacctattaatagatttgtgcttattttgctcatgcagaaactttgaaaatctgagatattttcttcctttcttgccctctgctctggcttagtcttctggataccattgcttcattccatgcacataagacattcagtgtcaggaaaagaattatccgggtacttgttgaaagttgtgttgctcctcattgtttagttactgttttggaatttgggttttcttttgactatcatcgttccccaactttaataaaaacttgctattaattattgtcattaagttataatcatttaaaattaattaaagataaaacacttaaggtgaacctcagccttttaaattctcacttcaaaatttcaaattttcagaatatttttggttacctacattctgaatgctgtttcaaattattgcatagaaaaaaaattttaagattgatttctgaagcaataaagacctgcagtactcttcattgatttaattgaattatattcagttattttcttaaataggcattttctttatttttaaaagcaaactgtttattatgaaattcagtcaaaaatcatattaatgggttctggagatctaatttataccatggtgactataggtaccaatattgtactgtatttgaaggttgctaagaggatggatcctgtgttctcttcacaaacacacacaaaagaggtaaccgtgtggtgatagatgttaattagcttgattgtggtgattatttcacattgtagacatagatcaagtcatcaagttgtgtaccttatatacaaaaaaatccagtttttatttatgattaccatccaaaagttataaacaagtaaccaattgaaaaaattaacagaatctaagatattttaggaacatcaaaaatcagatgatgatgttgatcatgatgatggcacgtaattatataaaataactgctaattaaattggtttaaaagggatattttatatatgaatgaagaacagaaatcttcactgatgataaatatcacaaattatataataattagacttaactgggatgtttcagtaggtgagtttggaggggatgcaatgtagtctagttgtgttcacaccctccaaaactactgaatttagcaagtttagtgaggcagctatagaaatattgttcaaattacatatggttattaaccatttttgaatagctatagtcttatatttcaaaatattactattaaaaccgtttatagccaggagaatcatattgtgcatctgtaacccgttcttggcatgttattgtccactgcctaggtagtgatgaaccctcctgactacctggatttgaatctcagcactgcacctttcaaggtgtgagattttggcagcttattcaactgtttgtcctcaattgttttgtttataatttagaaatagtactagtactggccttaggaggtggttgtaaggatttaattaattagtgtgtgtgtgtatgtgtgtttattctaggacagttctttcttgtaacagatcctttaaaagtctttgttgttagtatttacttgtctattctagtatatagtaaattccttgagggaagtggtcatgtttagctggatttcaaactgcagcaaatccgtatgttctggggatggtcttttattgagaggacatgtttgcatagtggacagaacatagtatctaggcctgactcttgaatttaattatttctaatcatatatttctcagcaaacatttatctactttataatggaagtacttgagttcagatagattaataatgctaactcacagggttttatgcttgtggactgtgcttgtaaactgaattggtgtactacatgatgccattggggtgatgtttctcatttagaagggcctcaaacatatgcttctgatgttatctctaaatgattttatacacatagtcagagcacacattatatgtacctatttaaaactgtttcccattacaagccatactgcttgaagtgcactataaataacatcattttaaatatgtcaatccagtttttataacctttataaccttttactatatctggagtctaataaattgggagtggcttgggtcttccttgaccttatgagaggccttgttagatatttgttattgcttgctatatactttatcaaatatgtttgctagtagacccagaactttcaatttctgtattgaattttctggtagggtaacataacatgcattgatggaagtatacttacaaagtatactataagcaaagtatattagcaaaacctagcacacaacaaaaactagcacactttgctagtatactttataagtatactttaattaatgcatattatgttactctgccagaaaattcaacaaaggattatccatttccatacttttttcattacatttccagtcttgtaataattaaaggcaagtttctttatttgtgcaactccttgtaagaatgtgatatttttagctacaaatgattcaacagcagttcagtagtggggaattgctcgtagtgactagaacaatgatggtggattatagtgatgttttctggcttgttatagttcttggtcatttatgtgttttgagaggtaatatatattttttattgcttaattttagacttatagagaagttgaaaaaataataaagagaatttctgtatacctttactcctgtgtcccctaatgttcacatattccattatataattatagtacaattattaaaactaagaaattaacattgacatagtaatctacagattttatttcagtttcaccagttgtcccactaaagatctttttcttgtctagcatacaatccagtatcccacattgcatttcattgtctctttagttttttacagtttgtggaagttcgttagtgtttgtttttcatgacattgactattttgaagactactggccattgagagtttgtaggacgtccttcactttggatttttcctcaagattagattgagtttatacatttttgacaagaataccatagaaatgatgttgtacctttctcagtgtaacatattagaggatacttgatattcttaagcattactgtgggtgatattaactttgaatacttgcttgaggttttgtttgctaggttttgctaatttctccttttgtaattaataagtatcttgtgaagagatattttaagagaatacaagtatcttttgtttcattatacttttaccaactaattttagcagagttagcaaatacagtcacatgttgtttaacagtggggatatgttctgagaaatcttcgttaggtgatttctttgatgatgtgcaaacatcatagagtatacttaatacaaacctagatgacatatcacacctaggatatatagtatgtatagcctgttgctccaaggctacaaacccatacagcatgttgctgtgctgagtactgtaggcagttgtaatacagtggtaaatctttgtgtatctacacacacctaaacacagaataggtacagtaaaaataaggtattataatcttatgggactacgcttttccttgttgactgaaatattgttatgtggtgcatgattttatggttggttgtatactcatacatatacattcacacatctgcatttgtccatctgtatttatgttaaaagccattagttcaatgtagagtttactctagcctttccttctttcttatttgtaactttctctgacagtgaaatctggctttcatttttcacaatatgttcacttattttctcagtcctagtatgcatgtgtattagggttctccagagggacagaactaataggatatatgtatatatgaaagggagtttgttaaggagaattgactcatatgatcacaaggtgaagtcccacgacagggcgtctgcaagctgaggatacaggaagccagtagtggctcagactcagtccaaaagcctcaagagcagggaagctgatagtctgtggccaaaggccagagatcccccgcaaaccaccgatgtaagtctaagagctcaagggccgaagaacctggagtctgatgtccaagggcaggaagcatccagcacaggagaaagatgaaagccagaagactcagcaagcagcttatcccacctttctcgcctgctttgttctagccgcactggcagcccattgagggtaggtcttcctctgccagtccactgactcagatgtcagtctctggcaacacccttaaagacacaccgagatacaatattttgccagctatctaggcattcttcaatcaagttgacacgtaatattaatcatcacagcatgtaaaacagtttaagaattgctaatgaatatccctgtgaaaaacaaatttttaaaatatagtacagtatttgatatagtcctttttgtctttatgcatatatttaaaatttcttaatttagttttattctttcccacccctttctgtttctcaatttcattttggattcatctcaattctagctggtattgattaattatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtcccgtatttcttttgtacaaatgagtatgcacattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattcctacatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacattttcatgtctctaaaggtcatttctgtgtctttttttgtgtattgtttgtttgtgtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaaaaaaaaaaaatgctgtttcaatctgtttgtgacagaaatgaataaacttaggaaatgtgattagaaaatagacctctgtgtggccattgttattctctctatatcttttacacctactgtcttctggaaagttcttattgcatgtgtggaaatatcttacctatcagttttcagttaccttcttttattcaaaactgttgtctcctttcttggtattcctatagattttctatatttcattattacatttacattgaattgtgggctggcgttttagctgcctgaggttcagggccttgttgtcatatttccctccttttctgtgcttaataatgaaagttactaataatgaggatggccactgtgtgctgtacgtgatactctgccctgtacatgaaactctgatgatattatccagtaggtcctgttaccatttcagtgttatggatgaggaaactaactctcagtggtgtttagatgaggaaactaactctcagtggtgtttaatttgtctacagccaaatagctagtgagtggcaaagctggaattgaacacaggtggtgtggcttcaaagcatatgggactaattacaatactatatatcatgtcttttacttttgtacttagttaatgtgcttaaatgttaatttagttgatttattaaagttctgtgacattcttgatattccaggtataaaattgggagggccttggccaagggagtggaagtgaaagtaaagtgtaacagcaagagaaattgaacatccacatggaattaagtttggttaagtttgtaaggatatttgaagttttgtgagagtgagtctcctgttttttttgtttgttattttttaattgtcattaattctgattacatcagcaaaaggaacccgttctgtagatggcaactatgtagatgacatctcagagtcaccagttcatttgtacattgttttaaaattattaagagatctcagctgtgatgttatttttatttgctaagtgctaaacattaaacattactaaaatttccatcggagaaattatttgtttaaataattttaacaaagccttgattagcataaatatttcttaatggggttgcttgccaagttgagatacaatgcttatgatacaattttgaatatataggtgttcctttacacttggtaacacttaaatgtagagattcaaatagttaccagtgacagtactttttgatgaaaaatgataaccttttccatactattttacaggtgcctcataactctatggaataagtgtgattatttgttagtattattttaagattaaatgacttacgaaagtcctgctccagtgctgttttgatattttgagaattagttttgttattattgtattttaatctacctttatactgaaaatacttaggtatagtaaggtctattacatttataagtgaagtgaaaataccaaaatgtgtagtaaaacagctacctgaccaattttaaaggaatgtactacttcatattgcaagttcacccactttgatcactatatgtgtatcaaaatatcacaggtatgccataaatatataaaattatgtaacaatctaaactaaaaaaataaaattataagaaaataactgttaaaagcaacattctaacattctgttgtggagttggtatttccatttcttttgcttcttattccttcctgctgatccatatttctgtctggtatcatttcattttatcctgaacaaattcctctagcatttcctgtagtacaggctggctggcaacaaattcccttagttttattttaattttgccttcaatcttgaaggaccttttctctgaacaaagattctagattgaaggtttttttctttcttttagaaatttcaatgtgttgttttgttttctcgtctccatttttttttctgataagttagcattcatttgaattattgttcttttgcatgtaattgtttttccttgactgcttttaatattttctctttaactttgatttttagcagctcgactatgatgtgcctaggagttttctttcttttttttaatttcaataggttttagggtacaggtggtttttggttatatggatgaattatatattggtgaagtctgagattttaatgtaccagttccctaattagtctacattctaccctatatgtagttttttatccctcattcccctctgccttccccccttctgagtctcagatgttcattatatcactctatatgtctttgtgtaactatagcttagctcccacttgtaagtgagaacatgaagtatttgattttccattcccaagttacttcacttagaataatgacctccagctccatccaagttcctgcaaaagacatcatttccttcttttttctggctgagtaatattcctctgtgtgtgtgtgtgtgtgtgtgtgtgtgtgtgtgtgtgtaaaattgaacatccacatgtagtcagtatatactgaactaatttgatcaagtttgtaaggatatttgaagttttgtcagggtgagtcttcccaatatccttacaaacttcacctaatgactatttctcagaacatatccccactgttaaatacccatgcatgcatataccatattttctttttccaaggagtggacttttaaaaatgttttcttttttgtttgtttgtttgttttgtgtctccccacccccccccccccacccccacggattggctgagcttcttgaatctatgaatgtatgtctttcaatcaaattgggaaattcttggctattatttttaaaatgcttttctacctccattctcttttttccttttcttctaagactttaaaaatccttctgctgtttgtcctgcagattggataatttatattgatctttcttcaagttcattgtctctattttcatctcaatctagtgatttaaaaaattttatagttttttatttgtaatatttccatttggttcttgtttatagcctttatttcccccatgaggttttctgtattttcatttgtcatgatcataaattattattattatttgagacggagtctcactctgttgcccaggctggagtgcagtggtgcaatcttggctcactgcaagctccgcctcccgagttcatgccattctcctgcctcagcctcccgagtagctgggactacaggcacccgccaccacgcctggctaattttttgtatttttagtagagacgtggtttcaccgtgttagccaggatggtctccatctcctgacctcatgatccgcctgcctcggcctcccacagtgctgggcttacaggcatgaaccaccacgctcggctcataaattatttttaatccttaattacagtgataatagctaattaaaaatccttgtctgctaatttaaacatctagataaacttatgtcagtttccattgactgtggcttttcttcagtgtgttatttctctacttgttgacaacttttagatttaatactgaacattgtgaatgatgtagagaggagattctcttagactcatctgaggagtattggttttttgaggtaaggaggagtctgttttctgagtcagttaacttggctgtatttcaacttcaaactttgtttcctatgtggtaggtgttagctgaaatttcaggtcagttcttttaaccttagcactgttacttggagtctgtctcaaatatacttcatttagagtttagcaagagatttgaacagtttatccataggatttagagcttctctcctctgcttcttcctttctaaaattgtcttcctcacttttcaagtgctgtgatttctctgaaagcctgtcttcaggatcttcaatttaatagaactggtttctgctaaattttagctgctctgcatggctgatatttgagccctcactcaggttatgggaatcttattcagtgttattcttttttttccccagaatcaatctgctttcattcactttcctgtgcagtcaggtcttttttttttttttcctaatattttgtgctgagtttataattgttatctatgatagggttgttcctatgggaatggcctgaccatgactaaaagcagagctctatacttagcttttgagctctccagtcccttatgtctcatgacttttctctatatttcaacaaaagtatgtttatattattgaactttccacttgttaggaaattggtactgtgacctaattccttagaatcagtctttctgctgtcctagtttatgccttgcctaattaaagtcatgcctgtatttgaaaagtggaaaacttccaaggaaagtgagcagctggtattgacactcaaaagagttttatgaaatgaaagtaagcaaagggccagttaggctgaacttcaggaaaaagtatctaatggtgagatttgtgagactaaacaatctggcaaggggactttctctgagctatttcaaactgaattggaaaagtcagggaaaaaacaagtaataagcccaggtcatgcattggcaaatggacagtttgtatgatctcatacttacctttcccagtggctatttggttgtggggtcattagcagaaaagcgctttaggttttacattattaatatgaatgtctgaattggacagagaaaatagatttctcaaaattgcttaaaattgatgataaaaatctttctggaaagtaagaaatcatatattattcatttttgtgtggtgaaattctgtgagagcagggacaggagctctctcatttgtcacggtattgcaagcaccaagcatagtgcctggcaaatagaagacgttcagcaaatattagcattacttctacttttactataccttactaaaaagtgacacacccacaaacaaatgtcaactatcagaagtgacaattaaagttaatgttttccattatttctcttatttttctgtatgttttctttttccccgagtccagaaagcctgaatttaaggcgattaggttttctttgtgattttgtccacaggaaaaatcaaaaggatttaatttagtccactgtgaaatgttactgtaagaaaacaaagtatcaaagatatttgctggaagagagaatattaagcaaagcagttaatcatactgaatctgaagtcagatggtcctgacttttaattctggccacaaattacactcgttctgtggcctttgacaaatacttgctctgtgatctttaacaacttctcaagcttatctgaaccttagtatcatcgtgttttaaaaatgtgggtagaatccatggggtgtggtgatggacacctgtagtcctagctatttgggaagctgaggtgggagggtctcttgaacccaggagttcaagtccagcctgggcaacatagcgaggctttgtctctaagaaacaaacaaaaactccatacacacaggaaagaatcaacccgggtatccatcagtagatgaatggagaaggaaaatgtgatagatctacaaaatagtatactattcagccttaaaacacaaggaaatactgtcacttgtggtaacatggataaacctggaggatattatgttaagtgaaataagccaggcactgaaagacaaatactatatgatttcacttatatgtggaatctaaaaaagttgaactcatggaagcagagagtagaatgatggttacctggggttgggggtggggtagaaggtgcttgaagaaattttggtcaaaggatacacaatttcaattaggagaaataaattcaagggatctgttgtataacacagggactatagaaataacatgtactgtattcttgaaaatcactaagagtagattttaaagtgttgtcaccacaaaaaatcataagtatgtgaagtaatgcatatgttaattagctcaatttagccattgcgcaatgtatatatatttcttttcttttttttttttttgacacacagtttaactctgttgcccaggctggggtgcagtggcacgatcttggctcactgcaatctctgcctcccaggttcaagtgattctcgtgtctcggcctccttagctgggattacagacacatgccactatgcccagctaatttttgtattattaatagagatggggtttcaccatgttgaccaggctgttctcgaactcccggtctcaggtgattcgccctcctcggcctcccaaagtgctggacgtcatcttatatgtgataaatctatcaactaacaaccgataaattcatcaactttaatcagttttaatttatcaattaaaaattaattgattaaaaagcatggatagctagcacctattaaatatggcagttgtgaatttaaaatgagattagtatataaaattgttttgcattgtatctgatacacagtaggtgcttgataaaatatagctgcagttttggtggttattgtattcatcttaatcttctttgtagttccttctttctgttttttagataatttgatactttaacatagggccaattagtggctttgtgaccttcaacatttttgacttaactgttactcttcagttaaattgtttatgaaatgaggggatgaatcaactcagttttgctcccctgtatcaactgtacttggtggacttttctgggagagttattctttgagtactctgagattacttccattgctcactagaatacatgatgtaattctgagtttgtgaaccagatatgacatcattcactatccatttatagcttccgtcttcaattttcaataggtgagaatataaaatacgtttttaaatcctcgtttatataactttacatttttaaaaacaatgattaagtgctcaatttatgttatgcattgtattaggtgcttcccttgagtttgtgaggggtgaaggtatcagtggttgaatcctggaatagatagcttacttaggacatcaataatgataataataataataataaagtaatactgttataatgaagatataataataacaatgaagaaataaaaaatagtaaagagattgtatcaaatgtactcaaaattaatacattttttgtaacagtgtttaacaaactgtaagaatttaaaactaccagcaaaaagaagagcttatgctatattatttttgcaacattgtacagtgaatagcactatccaaagcaagacctttgttattgaatcagaatactgaaacatagtgcattttgctttaattatcaaataaatcataattgacatggtaatatgactatattgatttatattttcatttcctaatggtatctgtagccacgcatagatttggatcaatccactgatgattctttttgttggatcttgaaatgtgagaaaagtctctctacatggtattctgctgttcgcagagcttactttggcctgtttttctatagagttactaagattcagcaggtattcttcaaatggctgaatgacattgaagtgtgttgcattatcttctggtctacaatatttaggttttttttttgagatacaggatatatatgtaatggatatttcattatgtgttatacttttgtaatatgctatactttaataggataataattaaaggcagctttaaagcaaaatgaataactcattcaatacaacaaaaactccaaattttctagtgttgttaattataattattgcttttctttttgtcttttgaagcagtgatcaaagaagttgcatttctgtgtgattcaatattttgaaatatttagttcaactcaatgtagtatttcatcaaaataagatggtggtgttaacactgatttataaatgtaccaatatgctaacctgctaagctgctatctggcaggttgtaaatattctatatgatagcaattttttagggttttgggtagtgatagcagaacatgttgtttctccctattaagataacaatttggttggtatactctgttacaacccagctgcaaaaccaaagtggaccacccacagagagtccagttagagattactgaggtttggctggctaaactactaccacctaaacaaatatcatcaccagttctgtgactcagtgcttgatctaagtaagtgattacttagaagagaatttttccaagtgcccaagcttctgagattctgtatttaaaaaataatagaataataaaagcaggaagaacatcctttgaaacaaattttaaaacctgataattaaatttaatcttctattcgtggctaaattataatactttcctaacttttggtatagcaagcctcttattattttaaatgtgactaaatagcttcatgtgtaataccagcactcttcataaaatattttttgtattgtctgtgttttgccattacaatgagatttttgagaatataagaaatgcacttgttactctgatatcattttattggatatccttgaattgcacacattcgtagcagtgtctcataatgaagtcagtgtattccttttttgggggaagcttcttaatgttaaaagcttcctaagcattatttgctagatcacagtttgaatggcagtgtaactgtgtagtctgatgatatattgtttgcataacagaggtcacatggagttctgagtatttcccagataacttaactaactgctcaattaagaaaaaaagcttgctgaaagatgaagtgatgctttcaatggtcacagagaatacaggtgcaatgaagatctctctaggtgttaactaatgactgagggtacaacataaatatacacacatgttcttatgttgatggaatatgaataatgagattattggacttgtgtgctgtgtgatttattccaaaaatgtatcctagcctttttgaaatttattctatgttctgtcatgacagccataaatcagcatgaggaattattggatttactatggcttgaattgttacctccatgataaagataaatgtaattattcaggaaattatttgcttgtataatttatagtttgctggtcaagaggattttttatattgtaattgatagatagataccttattagaaaaatagcctatgagggttttgttttgttttgttttggagtgaatggattgtttattctggtatgattcctttgctatctcaatttctttttctttctttcaggtgcaagtttaaaataagatttatttaaaataaagctgtgcattttaaaatagcaaggcttcatatatacattttagacacagaaaaagttacaaaaaatgccaaatgtctccataaaattgaaatagaataattagttgtattttggtgttaaaaaataaatgtagtatttcaaaactagattctgaactccatgaatcacataaatcataaatatgacagtattttcttcatagggtagtcttttatatgaatagtttatagtctctgacagtcacaactagaggaaataagatgaagaaccagaatgagttttattaggcaggtggctttcctcctagtaaaataggcttatgtactgctgaaaagtgccatataaaaaggaagaactgttgatgtattgaatcagaagaaattatgttttcctttgcaaaaaggttcatagaaaatcccattcataaagattttttgtcagtatattattttttatcaggccttaaaagctgaccaacagaaaaaacttgaattactataaacctgatggaagtggttttagtttagttgagcctatattaatgatttaaaatcttcattaagttcccataatataatagccatattggattggggataaaaataaataaataaatgaataaatatccataacacaatttttccattgccctcaccaatgttctgtgtgcactaatatattcaacaaatatatttctgccgaaaccttaccactaagagtttgaaactgactagaagcaaaaatcagataaaaggatatagtaacattaaccaaatgtgcagtttgatgtggaagaaggtttaacttttattatacaaattcagttcagtggagattattcaatactatgcttcattaaaatgttttctacatgcattgcctcccctactaaaacatcacatcactacagacttgggactttagccccaagaagtgctccaaagcggaaccatggttagccaagtgttggcataactagttattattttttaaacctacatattacaaaacataccaactaatgactaatgtgatagaaatgcaaaattgaagtaatagttctcagcaactaaagtattgaattaaatgttactaagcaataaaagattaacaaatgttaattccattgttgttaatgatagtttaatattgatgtctgattagtcaaattaaaaagatatagccaaacttttttaaattagtgtttaaggttttttaggcaactaaggttttcttcctaaattgaaacttcatgcctaagaatatttaatgatatatgtaggtataattgaaatagaacttcaggcctggcacggtggctcacgcctgtaatcccagcactttgggaggccgaggcgggtggatcacgaggtcagggattcgagactcagcctgaccaacatggtgaaaccctgtctcgactaaaaatacaaaaattagctgggcttggtggcgggtgcctgtaatcccagctactcaggaggctgaggcaggagaattgcttgaacccgggaggcagaggttgcagtgagccaagattgtgccactgcactccagcctggacgacaaagtgagatcctgtctcaaaaaaaaaaaaaaaaaaaaagaaatagaacttcaaatatatttcaaagacctttaaaagaaggtttttggaaagatctatgttctttttaaagtatttctctttaaattttgacataattgtagattcatatgcagctacagaagtaatatttacagagatcctgtgtgtactttacccagtttcccaaatggtcgtgcagtcgatctacagtacaatatcacaaccagaaaactgacattgataaagcctacccatcctatttcgtcagttttaaatgcattcatttttgtttgtgtatgtattaaattcgatgtgattttatctcatgtaggttcctgtgtctatcaccaaagtcacaaatacgtttctatgaccacaagaatacttcctgttgtcccattcctaacccctggcaaccactaatccattcaccatttctatgattttgtcatttcaagaattttgttctatcagtggaatcacagagcattcaatcttttaggactggctttttttcactcagcataattcccttgagagctgtccaagctgtttcatgtaacaatagttcattcaaacttttttttttttttgacagagtcttgctctgtcactcaggctggagtgcagtggcatgatcatggctcactgcaacctccgcctcccgagttcaagcaattctcatgccttagcctcccaagtagctgggattacaggtgcccaccacaatgcccggctaatttttgtattttagtagatagggtttcaccacgttggccagacttgttattatatattccagatactagagaatatataatcattctccaaatgtaacagtaaaaaatgatttagaaaatgtgcacaagacatgaacagccatttcaccaaggatgatatataggtggcagataagcacattggaaatatattcagcatcattagccatcagtgcgcaccttcctatcagaatgactaaaatgaaaaatagtgatgatgacaaaggctggcaaggatgccaaaaaacaatcacacatgcattgctggttagaatgtaaatttttaaatttccctccactcctcaatgtcaatgatttttttgtgagtaattttcatatgttgaatttctagtaacagatataatcatatttaaacttgtgatttatatactcatgtttttgtcaaactttaagtctggaagatgtttaatttcttatttctacctaattgtcaccatgttgttactggtagaagacactttttattcacataattgtgttattgtatatgtatttttacaacttttttattgggtgaagaaatatatggtacttcagcctcatttacctctcataatgtgctgtgcactctggagaaagctagttggatttttggaagcagatatatctttatcatacagttaaggaaagtgttggccaccaaggccatcattctaattttgaatacatatgaattggcctttttgctacttacagttttggaatctttggtggggatacaaatgcacgtcccttggaaattttttggttttattttttatcctagaaaataactgttgtgaagatgtcaatatggaattattttgtctcaggcatccaaagactcatcatgaattaacttagggaaaaaaaaggttgtattgccagttgagcatttcaaagaccaaaatccaatatttgaaatgctttaaaatcttacattttgagtaccaacatgaaattcaaaggagatgttcattagagcatttcagatttcatttttggattcctgatgctaaactggtataatgcaaatattcccaaatctgaaagaatctgtatctgaagcacttctggtcccaagcatttcagataagggatatgcaatttgtataagaggcatggaatatcttaaggaactcaagaaccaaaatgtagacaattattaactatttgttctttccctgagtctttctggtttttctttcttattccatttggctttctttgtctttagttatattatggcccaggcatcaagagcaatagtctttcttttattgaacttgagcatttcaaaattccaagagaaggatttttttttctctcgtgttttgatttgatatctacccttgacaaacctattggacaaattgaaaagtaaccacgaggtgcctttcagtcacctacaggatatggttcagcttcacacaaccttcaagtctccattatctggcctgcgccttcatcccactgtcatctcttatcattcgcagtcttattcttttatatccaactacactggtatggcttttagtttctctgcagaaatcacactatttttctattcagtgttcttgctgctgtttttaccttgtctggaaattctttactcctctacttattctttaatacaaaaattcttagtcctggggctggggcaggagaaagaggaaggatattgtttcaacaagcatatctaatattgtaataatcacatttggaaaattaagtttgtttcttggttttaaatttaaattactcaaagcaaagtttgttgtagtcttgcttactagaaatacactcatatcatgagtgtatatgattcttggtcagacttccttggaggactactcatcagattctttgaggaggaactttgatgtatttctaaaggggaaaagttgtcactgttaggaagaatgttcttagttcttacatttgagcaaatcatatacaaaactactaattgctacatacataccagtcaactgcatatagtatttactagcgtaaaaggtatgtgcaggcattgattttatgtggtattacatgatgtgaaattggaaacagttgtataataggtataaaataaatgtatattgattgaatcttgaacgctgtcctcagtggacttaattccagcacttgaagattcattgtagactagcctatactagtgtgacttattagttacttggatgatgtgtacacatttttccactgtattgaaaaatgcacctaaaatactgttaaaaattgtaagaacaattagaatataataaagaataatttcagcatttagaatattttaaaacatttacaccagtttaatgtcaatattcatttcagtaccaagacaaaacctaaaaaaactgtatttaaaagaatgatttctttcaaaaataatttaaaaaatagttatttctaggatattttgtctaaacctatcgttattttagatgtttttttctctagcgttaaatagacaatatgaactgagtcttaatgtctttttacatgttgatttgtcatataaatattactctcactctcaagcctggtaccagttctctgtcacagagcaaaaatcctcacctctcatcccctttttaatttaaatctttacattcaaagagttttctttgctgtatttttgaaaatgctattttcctgtgctttggctaccaccctgtttgaatattgagactactctaaatttacttaaagagttatgaatatgtgtttggtaactgtagtttgtttcgtagttaaggaaatgttgcttgtggttacaattcgtgtgcagttattttagttaattttgggaaccataagtgaaataaaattgtgactgtttgcctaagtatttttttttttttttgcttttttgttggtaccctgtttaaattctagaaggagaaatatgttatttagagagagagctgtaaaggaagttttgggaaaacatatcaagatatggatataatgagttttgaagcctataatgagggggagagagaaagtcaaataaaataaaattttcctgattgacaaagaaaaaaggacattttattgtgataatcgtatttcattcattttttaatatcagagattctggttatttagtcagtatgtctcaaattttttttcactgagctatcccttcttggccgaagagtacaaactgggtgtatggcctattagccagcataaatggagaatatctttgaagtggcttatattgccttaaatagttcacttgagactttctgttaatatggcagaaagcataaatttgcaaagccaagaatagtagagagggtctaataaatatccatacatttttggaagatgcagatgcataatttgtaactaactaagtggtatggagaaagggtataggtgcttttaggagaggttgctagagaggcaaatggattcctaagcagaaacccccatgaattgggagtaccagttacctctaaatgtggacgtataaaacagtgctgaaaccatgaggatttgtttaaggcttgtaagggacacttagaccacccaggcagctgtacacctagttctccctcctttcatttttagaaaaaaaaatcaggattcacaatactaaacactggtaaaggaagattgagggatggactgtacaaagaacgtgaggattaaatgaaagtctgcataattaaaaaagggaactggctcccttcctttgcttagttgcaagtcttctagcagcctatcttataactcccaagtaaagagtaagctgatccagaggaaagaccatcagatattgacagtcagggaggtcattcagtggaaggtctctgtgtgatcacactatcctctatccttcccactctatcctgaagcttccctactctgttctgcctattgtcggatgcctgaaaagttacttcatgtgtttgtttccagagtaactgttactctgtaaatagagtttataatcagttttttagttcctcagtcttaattgtgaatggataggcaaggcttgccaggcatttggggaaatcctgtaataaaaacgcagtgatcaaataaaataaaaaaaacatgaaacaggtttgagaaaaagagaccttgagagaacagaatagccttttagtaatttataattaatatttcagataaacaaaagaggcttgcatcagtaaagcaaagatagaatatatgctattaaaacagagctgtcagagaaagaaaagagttgttggaaattaaaataaagttttaaaaatatagaatggtaaaacataaacagaagcagtcttccaggaagtaaaattaaaataaaaagagatgaacaatgtaagaggaaagttaagaaaatttgatgatcaatccaggaagtttattctctaataagagttccaggaagaggaaaatgatagagaagttaatttaataaaattcaaaatattagtgtatgaatgaaaaattgtttaaaaaatactttggttattcagttattgaaaatgcctatccttattttgaggtttgttgttttccccacttgctttttattaagaatccaccttcagatgggtagtacattatatgggtaatatttactcaaatgcaatttggaagtgtttgttcattgttatgaggaagcactccttaaatcttaatgcttatatgagattttatctcttgaaaataatttgaaaaaagctagttacgttcaatacctttaactttgtgaggtgatggcgtttctaccaagtaaaggacgaataacgtcatcttctgtaatggtcttttatgtttctgtgttaggaggaagtgcagacaacaaatggattagatgatctaatagttatttttccatttaaaaggaattcttgttttctttttaataaattgagaaaacaactatcctacatataatagtttacaagagggattggatctctgtagatattgtgaaagaatcattgtctatattccaagaccaatataaaatcctttaattaatgtaagatcagtgtcaacctatgaaagatactttgagtatatttttaaaataaatcaatgtaacttagctgatatacactaaataaatagcagttattgaatgccaaatactgtaaaatcatcatggattttgaaaaacaaaagaggaaagtgaggaggaagtaattcatgaatagacaaagacaatttgaggttaggctttcaagattcataataaatactaaatttttttctcataagacagttgcacattatactaaagaattgcaaacaattttaattgtgggaggcagaaaggaatgttgcccagttttactgtaagaaactgcttttttctctttagttatgaaatagatagtatgatagtcctaaagaactaatcttatataaaaaacattgaaaaaaatacaaaatgtttattttttctaattggcatagttatattaattccttttataattctcctctttcacctcctgccagattgctttacttgttcaagtagtgtttgaactgtgctactatgagctgacgtcactaacagccccagctattctgttcctcagccatacaaattgagagaagaaatgtgttggaaattaaatacctatagtgtaagttttgtgggattcttgtaactacagaattctgagattaatgaacagaggactacctggaaaatataaaaacaatcattggtttgaggtagtaagatagtttggaacttcacaaaaatattaaaatttttccatcttgtcattattttaaaaaataataattattcatttcaattctgcttatatttccaaattatattttattatatttgcaaggcagtaattcctttctttagggaatttataatttattaagactgttagtcattgagatggggttgatggagaacataagaaagtttgggggcaatgggaatgtttgacccagagtgctagtgcatgcgattaaatgatatccatgaatgcccccagaacactgccatgtgagtgaaacagataggcatagtgaaaggagaaatgtttaggaaatttgatgaatatacaactataatacagttatgtatgaccaaggtatgtgtatatgtaaaagacaagactttttgttctgatgataggtgaaaaaccaaggggcctcacatgaccttgtttcacatgacctgtcttcttatacggaaaatatcggaattattctgtagtcgtgaaaatttgggactggggtaggatgggaaaagtagaaattctcataaataatcagaactaaaatacatgataatgaatcaaaatctcttagctcaatgcattgaaacattgttggtggcaaaatttacatttgtaaaaggctcaaacttagacactttggtgttatttccaaataagattttacctgtagtctatggacacctgacaggataaaagaatacattcttttaccactgtaaaatttgtcccattatcacctatattgcactgtgaatatttttagagcctctgaaattctgattataaaagcataggattttatgttagtgaatgttgtcaatgagtaaatgttaaatgtaaacatttaaaagagatcttagttttcaagaccctgctagatatttcttcatttttcaatatgccgtgagtttaaaatttaaaaagaaatagaaatagccctgaatcttatcttccaaattttgtcctttttcttaaattaaagaacaattaaatttatcaaataattacatttctgagagccatttaaaatgttaactttgaatgacaggataaaccatttgaattatatcaatcagggaatattaaattatttgagggaataaagaggaaaaaactgaagtcacctatgcatatgagtgtacaacaatcagctttcaaatttctgatccaatatattgatcatatttcacaactctttgatgcatctattattaattataattttgtatgtgcagtatctgtttggaaagcagtatcatcaattctgctttctttattagtatttttcttgaaatgttctagggattggtggtaacagcctctttgttccaaggtgtcaaatgttttatattccaaaatgagattatatatgtgtttctgcagatgctgcaagtgtaccacgtgggatgattgataaccttttattaatatcattctgtgaagctcttaatttattcttacttcggaaaatattctttcagaattataattaagtagcatgttcatgtaggaagttagttttagttgcctttgggtaaggtttcttcttttcttctctatgtatttctatgatgtatcttttggttgtttgtagacaagtaccacctcagtgccgcaagagatagtgcagacctctacccaccccgccacccccttcttttaagcttttcacacttaaggaagagaccaaatttaaatttggttacttggaaataatcattttttaagttggtcatataatattctaaatttgtcattttcaggcacttaatatggtgcttatgtgggccagttaattattccaagtgctttgcaaatacaagcttatttaataatagcaaccctatgaggtagatgttgtcattgccatttgacagatgaggaaactgatgcagtgaaaggcacatagctagtaagtggccacagtgatttcagttcttttaattttttttttttttttgagatggagttttgctcttgttgcctaggctggagtgcagtggtgtgatttcggctcactgcaacctctgcctcctgggttcaagcaattctcctgcctcagcctcccaagtagctgggattatgggcacccaccaccacacttggctaaatgctttttgttttgttttgattttcgtatttttagtagagacagagtttcaccttgttggccaggctgttcgtgaactcctgacctcaggtaatccacaggcctcggcctcccaaagtgctaggattacaggtgtgagccaccacgaccggccctttttattcttgtgagatgaataatctaaatataagtcatctttatcttttaatagagacactaccttttagtagataagtaaaataatacctgattgttgaagtctaggggatcctttaatatttgttaatatatccaatttctatgtgtttcatttcaattcaaattagttacatttggccatttgtttgtagatgtaacagaattagttgctaatagaggaatagattgctgcaagttactcatgaaatactgttctctccttcaatcaacatatttgttcgtcttgtttattaaaagcataaggaacttcaataagtaggctacatttttatcttgtccttgaacctgtattatgatttcatgtgaatttgctacagtgaacttttgatttgctgatagcagcaagtttttggaattgttatctcaaattctggtttggcatatgcctttaaaatgttattcaatcttcctgtaatcccagcattttgggaggccaaggcaggcaggtcacaaggtcaggagattgagaccatcctggctaacatggtgaaaccccgtctctactaaaaatacaaaaaaaattagccaggtgtggtggcgggtgcctgtagtcccagctactcgggaggctgaggcaggagtgtggcatgaacccgggaggcagagcttgcagtgagtggagataaagccactgcactccagcctgggcgacagagcgagacaacgtttcaaaaataaataaattaattagttttaaaaaataaaataaaatgttattcaatcttatttgagtagctattgaagtcaagtgcttatgtaaaatttaagatcgtttattttccacagtgaagatgctaatgccctcttaaagttggttaccctgcttgctgttgtcatttttaactgaataactaaacttattaaacttcagtgagttattcattagtgaattggggttggggggagtgataagtaaaagaaatgcattttatttcctcccttattgtcagattcctgtttgaattcaatgtgtaataatggcttatggagtttaccagttttagtggaatcctcactgcctcttcaactgctttgcttattgctgaaggatagaaaagtgtggaagcttttgattaactcttataaatctactgaaatgtatcacagagtttaccactgagtcattttataactttctcctttttgcttttaatatatttttttctatgtgaatacagttattgagtttctggaaacttaaagttcgtgggtttctagaaacataaataaagaacagatggcagttcacgcctaacaatgaatacgatgggaacagaggactttcatcttgtccctagtggtcaccatgtcagccatcatgtggtggacatctgtgactgttgagcatagtccctgctgctattttggagtctctcaggtctggtgttagtcatatttacattagctttatttttttttcctttttcttttttttttctttttctttctttctttcttttttttttttgagacagaagagtctggctctgtcccccaggctggagtgcagtggtgtgatctcggctcactgcaacctccacctcccaagttcaagcaattctgcctcagcctcatgaatagctgggatttcaagcatgtgccaccacatctggctaatttttgtatttttagtaaagacggggtttcaccattttggccaggttggtcttgaactcctgacctcaagtgagccgcctgcctgggcctcccaaagtgctgagattacaggtgtgagccactgcgcctggcctgcatcagcttattttcaagaactgtcattctcagtcatttatcagtctgcaaaaaatataattctgaataaatgagaattgagaagggtcccaaataagggttactttcttttaaattgacccatagttgtacaaactgattgattactgtcgattgatatgtctttattcatcagcattgggaaatttaggaattgagcttcattaatgaaaccattttattggacacatagctgtaaattgcatgtctgttgacagagcactgtaaacaaaataaagcattaaaatttagataaattcagggagaagaccacatgtaagcatttaaatcataacagattcctggtatttatggctttaatatccaaatgatgagcaactcctacaagtctatgacagggaattgtctggaattgtatatagctatgaattttaattttgcaccactgattcttaagtgggcgggttgtctattcatccacatataatatgaggctttgttttgtacttgtcattacaataaactttgaagtgtttaacacattgtgtctttgtggagaaatggtcatcaagtaagacaattttagggaatactgaaaatgctcttagcttgagatgtagcaaattgtatcagaaacatgtcccttgagagcagtgtggctttgaaaatgctaggagttgggagaaagatttgtttttattaatgtggagaattgcaaaagttttagaaaatccacccaccatgtcaaagatcttgtgtgtagaatttttaaagaactgctatagtagagggcattaagatttttaagtaaaataaaacaaaaacctattggatgttaacttgaaagataattttaaaaacttaccctaagttcttagaaagtcttctctaccctcatgacctctgctatctatataagaaattagtgaactgaataaatctttagcctctcactatcttaaattaccatagaattaaaaactctagaatataatgaatttattctatcagtacagcccatgagtgaatttcaaacgtttaagttgtgcctcagaggaatttttgttatgcatcttttaaataataatattttcaataaatcattccttataaaagtccccaaattgttgctctttagacattactaaaatcaaaaacaacaaatttaaacatttacagtttgggacctaatttaagcatgtatcacagtttattaaagttatcttctgttagaaatagctcccttagttctggagatctgttgtgcagcatggtgactataataatagtgtattgtgtacatgacatttcctaagagagatcttaaatgttctcactacacacaaatgagaatgtgaggtaattgatatgttagtagcttgattgtggtaattatttcacaatgtgtatatgtatctcaaacatgttgtacaagttaaatgtatacaatttttatttcccaattataccttaataaatctagaagaaaataaaaatggtaagttaaccaaatttttttctctcagtctctcatattttctcccagattaagtaagggtacatctgtgaatcacactgatttcattttgttaaaaagcttaagaaattaagagtaagctataagtagttgtagctgacaatataagaactgttagaaatatgaacttgctttatgaatgctatatttattctgattgtgttgcattaaacatgtttattttattttaaataaaatatttttctcttcaagcttctaataatgttaaatgttaaagaaacaattatctgtttaggtaggaatttgacttaatctcattataaatagcatcctaaaattttacagctttgaacaaacattaaaattagtaataatttttctattcaaaatgaaaagaaatgtgaaccttttctgacacaggtcataatgaaataattccccctttaaaaaaaaatctaaacacacataacctatgagaataaaattaacatagctgctgtaagaagttttaaaaaaattcttagcatgtcttgaagtaataaacatgtctctgattaggtgaatcaatagacattgatttatatattatagatacaattccaatattatgaaaaagatactgtggaactagagaattttatatctgactggaataccagaatagtggtaatattgcttgttgaaattactgaggagaatgataagtgatcttcaggccatttatttatttatttttaacttttattttaagttcagtgttacatgtgcagctttgttacataggtaaacttgtgttatggggttttgttgtacagattatttcaccacccatgtattaagcctagtacccatttttatttttcctgatcctctccctctcccaccgtctaccttccatcctccaacaggccccagtgtgtgttgttcccccaccacgtgtccatgtgttcttatcatttagcttccacttataagtgagaatgcacagtatttggttttctgtttctgtattagtttgccaaggattatggcctctgcttccatccatgtcctgcaaaggacatgatctcattcttgtggctgcgtagtatttcatggtgtgtatgtaccacatttttctttttcttttcttttttctttcttttttttttttttttgagatggagtcttactctgtttcccaggctggagtgcagtgacgcaatcttggctcactgcaacctccaccccctgggtccaaacaattctcctgccccagcctcccaagcagctgggattacaggcatgtgctaccacgcctggctaattttttgtatttttagtagagatggggtttcgccatgttggccaggctggtcttgaactcctgacctcaagtgatccacccaccttggcctcccaaagtgctgggattacaggtgtgagccaccacacccggccacatttttcttatccattatatcattgatgggcatttatgttgattccatgtctttgctattgtttcagttgtgaatagtgctgcaatgaacatacatgtgcatttgtctttataatagaaagattcatattcctttgggtatatacctagtaatggaattcctgggtcaaatggtatttctgtttttacgtctttgaggaatccccacactgtcttccaaagtggttgaactaatttaccctcccaccaacagtatataagtgttcctgtttgtttttttttttttctttttttgagatggagtcttgctctgttgcccaggctggagtgccgtggtatgatctcagctcactgcagcctccacctcctggattcaggtgattctcaggcctcagcctcccaagcagctgggttttcaaacatgtgccaccacgcctagctaattttttttttttttttttgtaatttgagtagagatagggtttcaccatgttggccaggctggtctcgaactcctggcctcaggtgatctgcctgcctcggcctgccaaagagttggcattacaggcgtgagccaccgtgcttggccaagcatttgtttttttgctcaactttgccagcatccgttattttttgacttttaaatgatagccattctgagtggtgcgagatagtatctcattgtgggttttgggttttttgttttttttttgagacggagtctcactctgtcacccagactggggtgcggtgacacagtcttggctcactgcagcatctgcctcccgggttcaaacaattctcctgcctcagcctccttaatagctgggattacaggcacacaccaccatgcctggctaatttttctatttttagtagagatggtatttcgccatgtttgccaggctggtctcaaactcctcacctcaagtgattcacgcgccttggcctcccaaagtgctcggattacaggcatgagctactgaacccagccctcattatggttttgatttgcatttctctaatgatcagtgatgttgagcttttttttttttcatatggttgttgtagacttataaattccaagtggacagagattgtgacgtttctttgtcattcacatgagcagaacactcaataagtatccagtgatattcatgaaagtaatgtgagtgatcagatttgtgttgcatgagattctgacagtacaaggaactgatctgtgttgtaatcttctatcccatttcaggtatgtaaaaatgctgaggaaagaaaaggggagaatatgcatgggtcagaaaggaaaagataattcaaagccagggcatgagttatgctgcactggccagggggtcatttggtctatacataaactctatggacttgggcttgggttttaatgcttgtgtggtgataggagataaggaaattagggatgggtttggtggaggaggaggagatgcacttctgcacatgtttgaatggagtcagaatttacactgtcctcatatcacagggatctcaagataagagatagtgacaactcctgatactcttgcaaagcaaatgctaaactattcagaagctaaggcaaagcctgcacagatgagaatcttatggaaagaataccccctctgaagataagttcataataaaaagctccagccacatgaattaacatgactaatatattcagcagccacaagacaaaggagatttattaccataaaacatgaagtaatgggacaaatttaaaggagtataaaatatatttgaagtaattaagcagatttttagggaatattaagcataattaaatgtaacaaaggaaaataaacgcagaaaataggaaaacaaaaaatgatggtagataaaaattattaaatcaattatgccaacataaactctacagttaaaagattctagattctataaaaagcaaaatccaactgtatgctgtttataagaaacatctaaaacctaaggattgtaaacattggaaagcaagagataaaaataacataccagacaaataccgatcaaaatataagtaagataattttattatcgtaccaataatacacttgaaggaaataagtgctaagaataggggagaccaaatgagtagaaatacaaaataatctggagaatgtgtattcaccttacaatgtaacctcaaaatacataaagcaacaatggactcaattacaaattgaaattcagaaatacaaaatcacgttgaaagttttaaaaacgcctctctcaaaaaccaatatattaagcatatgagaaaatagatttgtacagtgtattttaacaaggttactactataatggaaggaaggatggatggacagagatctcttctagcaattagagaatgtacatttttttcatgcatactaaaacatgacaaaatttaagtatgtactaggccataaaggaattctcaaccagagaccaacatacggtccaaatttctgtagtaacttaattacaaaaaaattgtcttcctcacaaatatcaagcacacaaaaacacaaacacaagaaaattaatgggccaaagaagacattaaaagaaagattatgaaacttttagaattgaacatcagccaaaatactgcttgtcagaacttgccgctaatgaattagcataactttaaatgcatattttagcaaagattgaagattgatgaaccaggttttcaactcatgacatatgatctaagaaagagggtgtataacaaagagaatccccggaatgatgctgatgggagctcctagatgaccaaaatacaattgactcttgcagcaggggttggtcagagggcctggagggatgaattcaagggagctgtgggtggggttaagtgggtgattatctgatgtgctcaatcattttcaattagagttaaaatttgccaaatctgaattgtttgtaatattttccccattcttattttccatctattttgtgcttccatttttaaagaaatatactttgtatttattttctaatttcttagaaaatagtcatttttccaaagtttaaatattatatttccttttgaaattatagattcttttatttcttactaaatttaaaggaagtactcttgttctatttaaaatatatgctgattggacaactcaatttcagatttgatttttctctatttctacatcatgggagtgaatttaattgattttcttttagtatttgatttagggtaaactgtcagttttaatctaaagcatttttttgttttctttgagagaagaaagttgacctgaaagattaaacaaaaagcaagtgctgtgcttactaacataaaatgaacaaaatggacacgttatgtcatgggctgcttgtccccctcaaaagacaaagagtaagccaacccaggccatccttttactaagctagaacagctcgagtctgacatttttcttctctaaatttaaagactggctaatgttcatagtgggtcttacttgtcttttacacatttggtctcctgtgttctttttggcttgagatccttgttagtgtgcagtatgactttgagagaaaaaaaaatccttttcattttaggatggaatatttaaaataaacaggctgtgtgtttattactgtggaaaccagacagtaagtgtgacggtaaacagaatgatttcaaaagagtaagcagttaaatgctaacagactgcaataatactatcattatttcataaattttatttctaccctaattattgaaatgctttctgaagtaattttatgatttacatgttaatcttttgccatatgtgattttttagttttagtagaaacttagccattttttctatagaatagagaaacttgaagatatacttggttatagcagttatgattgctagaataccttatgaaggcatttgattcaggaatgacatggcatttttcatgtttgttaactaccaataacatacttagtaacattgtgtcttgtgagcttgctacaactgtatgctttcttctgtagtctgttcaaaggtgcttactctaaaaaaacctagttgtaactgtccaactcctttactatgtaatttaaaattttatataacaccagtagttatttctctttgtactgaatcattttgtgccttatatgacatttggataaaactgagtgaaaccaaatttgctgttaaaaaggaaaaaaaaatcagcttgactcatttgtgacagttctaccaaccccatcaactgggttctctgctcaggatctcacaaggctgaaatcaaagtatcagttgggctgcattttcatgtggggctccggttctcttccaagctcacataattgttggcagcattcagttccttgctgcctcttagctaactctgctctcagctcctagaggccattttatggtaccctccatattcaaagccagcaacagacaagttccttcaagtctaattcccactcctcatgaagaacccagtcccctttaagggctcacttgatttgatcagacccaactggaatgatctccttttatttaagtcagttttgccatataagctaacctaatcatgggagtgaatatctctcaaatccacaattctcactcacacctgaaaggagggggattatacggggcagggcgtatataccagcgggcgggaatcttgagagccatcttagagttttggctactactaagataatagaagcttttaggtagatatttcttccactttcttttctatcttaaatgtgtctgtattcttttcctcctctagtttcagaaaaggaaaaatccctatcttgttctaagtccgaattctccagtgccggtctttcccatccttccttaaattcactctaatagacctgcactcattcccattcttacactccacttttctcttgtattttaatttccccactctgcttgcttccacttctcaacttacatgaatgcctagtcctcaattcttttcactcaagtgaacttctcagcacttgtccagatttaagtttacaatcttttcttgctgatacttttgcaaacaactgatcttcttatctctggtcctgcctactctaccaccagaggagcattttctaaaatgcagatctaattcaattattctcctgcttaaaaatcactggggaagtcctaccttgttgtccttatcagaggacaaaatatagtctatagatattttgtgtttgggccttacatgtagaaaacattttaaatgaacttccaacaattacaattgggaacttacacttaaaaaaaaaatctaagtttctggcttctcttggaaaattagaaatctgggtatactggcacacaattccaaaagataacaatctactaccactacctaatagctgccctgaagatgggaaatgctctctgtattttgccattccatcaacttgactcatttgccgtacctacctgtcctctgaagatacttgactttgtaagccctagcctggaaaataaaggccaaatgccttagcctagcattcatgatttttttctaactttatcccatcaactcttttcaaattgttgttttggttacatgattgcatttcagtttctcctgccagattataattttcacaaggacagaaagtatgctttatttatgcattcatgctaagcctctagcatgatttctaacacatactattgatttgaatagtactaattttactttcactgacgtattgattttatgtgtccatataattggtcaaaaggcaatatggacaaaatatgtttttactttctagcactattgaaaaatcttaaaatgttgttttctgtcaaatgaatcaatagaattattttgatttgcaaaggacaatacatagtagtactatgatggtacagtgggtggtggagaaccttcattattttcagtgtcttgatcctttcattctttcataggagtttgggaattgggacttccctgtcagtgtttatatgttcagtcttctgaactacactgagagaaaatagggcttccagttggctctggatccttcttttgcaagatattgaaaagctttctgttgacatccatcgatcagttaatatttataacttttccaaacaagccttctaaccattgcttgtccctaaagaccattttaaactgtgaatctttaaggtctttttgagaataataggtttggttattggaagatttaatgcagatgattaatagaatttccactgtagttctctctgtttataattgaattaacacataaaaatgtaaatgggattattaaactataaatctagaaggatgaagtttatagtgctctgtgtatttactttgttctgttagattttgagtatggtgtttcctctgcagactttaattctatttttcagacatgtcacattaaagtataagaaaatacatgtctttattcaatatgtcacaaaagtattttttcatgaaattagaagtagctactcatgttaaaaagaatcatagattgcttttggcaatgagaggaaatcatttaattcaagacagggtggttcctctaggttactcactgatgagacaacaacaatggaaaaatttgcatcattgctctctttcctctctgttaaattgtgaacaagttctttctgtgatcctgtttttgtgttgtgtctcacaaattcaaaacattctggactcttccttttttcagtggctgttcttagtgatgacatcagttgtctacaagaaaatatttgcacttgtgttctaacaacagtcactgtttgttatagtctctggttttattttcagatattgttccaggatttctttattttgttatttataatatgaaataccatgtttatgaaaaaaacatgaataaaagtcannnnnnnnnnnnnnnnnnnntgcccagggcactgtaggggaatttgggaaatgagctatccttaggatataaccacagtattcaataaagctgaaatactagccattgccagtcttgatgttgggagtctgattatgttcctatatgttgacattttgattaatgttttacgctgctactattatcccccaaatttgttcatctactctgagattgctatacttgtgaaaaaacacggtattaatgaatactcttttataacatttctcatactatataagttacttctttataaatctcttgcctgcttaactgagtgttactacacaggggaaagggtgttgctttaggaagttgcttttgagggaactgttccagatattcaacttcaagaagtctttctagattgtatagtcaagttagattttctaaaatcataaagaagagatcaccagtgaccattgaagatggaaatgtattagaaatattcatacatatcagagtatgttagtcaggggaaggtaaggacagaatggaatatagccacttttggcctccagtcacacctggcatctagttcctataggactaatatgtagtgaactagaatattagatctgtccagttgagaacaacctaactaggaactgccttctgtagtttccctaaaatcaccacttgattgttaattctaaggggacatggaatgtgacaattgctgttacttagtacttagaatccctttgggaagagtttagaacaagtctcttaagaagcagtcagctacctttatactcagtctttctgtgattttctttttcttgtgtgtttatccaatttagcaatacctgggtgtcaaatttatttatccaaaacctggacttctaaaaacttaccatgaacttgtacatgtttactcggtttaaaaattaaatgaacctgtgggagctaccgtgctaagaaggggctttgactgtgacaggcacaccaggcatcatggtgtcatcttcaacttatagccaaacactgatttataaaattatactaatttttaagaatgcatattctgtagttttgtgaactggtttattaaggggaatgccttttcctagttaatttatttttaaccatggctataagtgccaaagcatttctcataattgaacataaatctttgatctggccttttgagtgatacaatcaaagaaaaatctttaaaaattttttttgaagagtcgttttgtatctgatactgtttctctatggatatcacttctcatataactatgtatcttaatatagactatattgtcagagtaatcctttcccttccactgcttctttagttttaggaatttatactttagcactccattgaatgaaatgtggttactaaattgtcaaaatacagtaactgctgtactatttgaacattttttggccatggataagtgttctcatttgagattgctttttgaaaaacaattcgctgaagtggaactggagtaatgcacaacagttgatttcttttggacttaactgaaactatgtttctggttttaaaatttgctaacaccaaggcactgttctatgtaacatgacttatttacatagttaccacacaacagttggtatttcatacagtaacataatttcattgcaaacagtaattttagtactgcaatagttcaacagttttgtctggctacatatgtagttagagcttttaaaagttaaaaattcatggtgtggtattataatcatagtttgtattaatttttatgaaaatcaatatattagcattgtaggccttatactactactctcttttcatttatataaagcagatagtctgattaatcgttctataatgtagactgccttgttcacatacatggtaggaactaaagaaagaatgttcaattgaatttcaagttttcttgtagcattctacagaagcttattgagtacacctcatatattccttatattagtttagtcttagattcagagtttgaaaactgaacttactactattaactccctcctgaaacttctgtattaactgacataatgaatgaaacatagtaagtacttagtaaatgttatttagtagtaaatgttacctggtggtagtggtagtagaatacattatggtataatttttaaacttttcttgtatctcattccagttatagctccttatattcaatgctattgaaactaaaatgataaagacctttacatcccataataggaatatctggaaaaaatttttaaaaatatgtatttaaaaagtgacaacatgaatgaatgaataagagttattagtaaacttttgtaaataaactattagtaattcaagttattttgaccatagtaaatgctgctaattaaaattggagactggatgccgtggctcacacctgtaatcccagcactttgggaggccaaggtgggaggattacttgagggccaggagtttgattttttgtttttgtttttttttgagacattcttggtctgtcgcccacactgaagtgcagtggtgtcatctcggcttactgcaacctccacctcctgggttcaatcgattctcctgccttatcctcctaagtagctgggactacaggcatgcaccaccatgcctgattaatttttgtattttgagtagagacggtgttttgccgtgttggccaggctggtctcgaactcctgatctcaggtgatctgcctgccttggcctcccaaagtgctaggattataggcgtgagccaccattgcccggctgaggccaggagtttgaaaccagcttgggcaacataatgagaccaggagttcaagattacagtgagctatgattccaccactgcattccagcctgggtgacagagtgagaccctgtctatataaaataataataataataataatgatttaaaaaataagataaaatcacattaattatgtcagtaatagctacccgtatcttgattattgattagcgtaagttataatctatactaaacattagaaacctttggccaatgtttgttatggttgttacttagacataattcatttactcttttatcaaccttcaaatactttttgggtgctaaggatatgctgataaagaagttaaatatctttcatgggacttgctgattgtgggtagatggttagacagaaaatacataaagtaaaaaaatagtcaaagtaattttagtgaaaattgttgtgaatacttgatgacagatgaaggtgccacctcttatgtacccataaaaattaaaaataaaaataaaattttaaagattgagcaaggtgcagggtagaggccgtggaaggcttatctgtactttcttaagaaggaaggttaagtatgtggtagttactttctagggacatgttttgtgacacaatgcctccctttcctgggctaatttgcaaagatatatgtatttagaagtaattttaagatacaataggcatataaagtattggaattttttttttttttgacaaggtctcactctgtcacccagtgctggagtgcagtggcacgatcttggctcactgcagcctccactttcagcctcaagtgatactcccacctcagccttctgagtagctgggactacaggggcacgccagcacacctggctaattttcctgttttttaaagtgttggggtttcgccatgttggccaggctggtctcaaacttactgagctcaaaacatctgcccgcctcagccttccaaagtgctaggattacagacatcagccaccacacccagctgggaaatgattcttggtaccagttaatgaagttgcatcataatctatttttagataaaattattaaaatatttgtttcttaatattataaataaagcagtaatattagcatatatgatagacatgagacacgttttaaatcagcaaattacccccttatcaattttctatttgtaattgcctttaaatattatttctgtaaaaggacttaaatgctaaatatgctgttttttctacattacctataaattgatttttgttcctttattttgaaacagcctttaaggtaggtttcagtaaaagcagaccaaatgtgtgcaaatgcattgactttaaaacaagaatggggacaagaaataaggaagaggaaaccttctgactcagaaaagctttagttttagcataagccttaatttttagtacttaacggaaggagaattgattacgttgctcccaagctctgttaggtagtaaagcagtaacactatcagtttgttcatcagaatagctttaatacctttttttttttttttttggttttgattctttaaaaacatatcgagcttgggtcttattatatgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgatgtggttttcatgacctggtcttgggttacttctccagccatgtcatttcctacttgccttctcaatcgctatttctcagttgtaatttttcagtgactccaatgtgtaacattcactgtcacctctgaggctttgcatgtggtactcctgcccaaagtactccttctctattccttattccccttgcgtggctagctcttatttagccttcaagtctcaggttgataccggtttactccactagaatagattgacctgccatgtactactacagcacttggcatttctcatagtaacagccatcaagctttaatataatgactgatttaattatccatctctccttctggttaatgtgtcatgaagagaagaagcatttttagtgttttcacattatctgttatttctcttctcaaatgtctaacacctaacatattcttaggtatgtatcgaacaaagatgtgaaaaatgagtgggatccctaaagagtcagagcgaatgctatctagagcaatgttgaagaaattattcctgcaatgtaataagagcatgtctctcttttttaaatatgaggcaaagacatgaaggtgatggaaaaatacttggtttatctttgaaaaagctaggggcggggtttgccagggaagtatattatggaagtgcagggtttcacagaatccagtgggattaagtagagctgtgaatacctggggtcaacgttgtaaacagtcgttagttttccagcatctgctttaacttcttggctctgtttgcagactgactttgtctgcttcattgttctcatggccaaaaaaatgtcttctatgccccagctctgtgagaacccaccagcacccagcacttaccctctaccagtttgcattattcacagagaactggataggctcaacccatcataaattgtttcttctacagtcagattagtctaatcctgctccactcagctctggccaggggactcatgagatgacctctagggaggtcaacctggattataaggtgatgaattttctgagaaaaagatttagaaaggcaggccataattatctttaattaatagaatatagataagagtctaagtgtcaggaatctgaaagagttcatacttgatctggaatttttttactgaattagaaggcaaggtcatctgctaaatatagaaaaagtgtaagaatagtggtgaaggtttggaaaatctggtgcaagggaatagttaaagggccttaccagggaaaaaccaataagattgctcagagaagcagctgataatagtgaatttttatcatttcttccagtagctagtgttccctttgcccagttatagaaatgagaaggcagatgtttatattgatctaaattgaaagggattgtggttgaggatgttgttaagagtgtggttggagaaggatttcatggaatctggattatatggagaagctttgcaggcagaaatggacttcagaaaacagatgatcatagtataggagagagtattgtaatagaagtcagagataagagtgatatgagggtaaaaggttatagtcagagtggggaacactggaattaagatttggaggaaatccaaatatatgaaatgacaaggctgagctaggactatgctcattaaaacatttcagcggctcaaatttttaagtgctcgctcagaagtaggccccaaactctgtatctacagggagttatcaagtgtctttctccactttgagagaaccccaaaattgtttctgctaatttcagatgtgactttgactttatattcttggtaacaataagaaagaacctaccgaatagcatttttttattattgtacattaggttgctataatgtattggccaaaaataattttgcgtttggcataattaatgtttagaagttcttctagaaaatatttggctggacaccattagctttttcaagaggtcattcattctattcttgcctggagtattgatgagctatgttaccagactatgaaagaatacttttatattcatttttgatgttactctatcaacagtgaatgttctgtagccatagcaaataacctaaaagtagaactagtttaccttatctcaaacactatttgtttttgttttgttttaatttttatcttatcaaagttatgtatgcatgataatttaaaaagtcaaatagtttctacaaaccttataatgaaaaattggcagtcctgtacctgtccctccctgtccctgattgtactttaaactttctttttttttttttgcgaattctatttatcgcgaaggttctaaataactcccttgttccatttcctttttttttcaattttagatattatctattatctttttattatggaagatgagtaattttcttaatttattaccacctctaacaaaccttctcaatcttcccttaatttccagtatagttatggcttaattttttatattttaattgtactaatattgaggattttattatgactctttaaatattatcaacattagaggtatatagtgaacatttcctttcttgaaaaacattctagagtttttaaaaagtaaatatcagttttttgtgtatcaatctctaaattatatccaaattctctgacagatgtattagtcttctctcggtatttagacatggtataaaatgcatcagttcttttttatgcgttattcatttattgtgtaattctctgtccttgttactttggagtgatatgtctttaagcatctgcatgcctgttttctgagctctcctttcactctctatattaaacaaggttcaatcaggaaactaaaccagagtaggtacttcaacaaagatttaatatagggaattaccaggagaactgaaacagccaaaagggaacacaggtaagccagagattaatgattacaggaagaggctaccacaccaaagcagtgggaacaaaagtgaaaaaattggcattaccagaaccaatgagcttacaggagatgtctggtggagctcaaacttggacctctgaataagggagtgcttggctgttggtgcttagtcagaaatacagcaaatgtgcctgtagcgccagggtatggactgctgaagtggggttgctgcctatcgatatctttgaggtttgcaatatggcaattctgggagagccaaaacaagtaggaagttgaagcaaaatgcccttgttgaagcaatgctgatagatatatgttaaaataaaaacaactccctttccccaaacaggaagaaaacctctggttttctcatccttctttgtaatctcctctagtgtatcctgttaccagaatggaagggaaaaccaggtgatattaatgagcagagtatagaatagttgctgtggcctgaaagataaccagcacaatccacagctactcagcatatttaataccctcctctgcatatttgaacttccatacgaaacagcaataacaatttcctgcttctgcttaacaggatccaactgttttttcttcaaatgaaggtgctctcatgctcactcacataaataaatatatagtatccaactcttggtgtattaatttatcttctaattcaggaaaaacactcccaaaaaccaaacatctaaatgttgtgtaacttaaagcctaatttattaaactaactgtcaccaaaaatctttatataaaattaacacagggaaaaggaaggaggacagaagaaatgaggtaatctatacaaatcccttcaccattgttttgaagattgtttttctttcttttgtactgaattccaatattttttgacccaatgttgcagtgtttgaatgtttgtgtctctccaaattcatatgttgaagcttaagtcttcttatcttaatgggatggtattaagaggtgtggctcttgggaggtgattcggtactgagggccaggtcctaatgaatgggatcagtgctcttataaaagaggcctgagcgaggctattggccctttgtttctcctgtcatcctgtgtggatgcagcaagacggtgccctctgtgaggaacaagccctctccagatgccaaatgtgctagcaccttgatcttagacttcctagctcctagaactgtgagcagttaagttctgttgtttgtaaaaacccagtctaaggtatttggttatcagagcctgaatagactaagacacatctcttaccttttctttgtttattttgtcacactaatggaacatattctcaaatagcttcttatctgaatacgtatttatcattttaaaggcattaattcattgacttctggtatctagcactgttataaaaatccagcaccattctaattcatcatcatttatctgtaacctattttattgctctgaaagcttttagaatctcctttttttccccagtcttccaaaaattaatgatgctctctcttgatatgaatcttcttttaatctggtgtgctaggttcttagtggactcatgtctacacattttttaatttatacatttttttcttttatgtcttttaaaattctgtctcctctaactctacggtgtcaattttaagcttcctgtaatgaccccgtcttacattttgtctcctatttttcatttatttgtgtgtgtgtgtgtgtgtgtgtgtgtgtgtgtgtgtggcacatcaagcctgtaagtgtggtttctacctaagctctagcactcaatatgtggactagagtgtgtcctctcaggaaaagccatgtaaacatggatccagtcctatttgagtatccgccagtttctgtctgcttttgtgattttccagtcccttgaacatagtgtttttgctgttgatttttgtttgtttgttttgtttggtccagagtttataattgttatctttaaagggttagtgtaatacaacttactttgccattacctgaactggaactacctcattgttaacttttcattatttgtttttggcaagaaaattcaattaaacgcatggttaccgtctatcatactccctagcttctcccagtctcattaaaaatagatgttaaaaagatgctaatagatgttaactatcttatgggcaattttcttattaaaaacactttgaagattttaaaatgttttttagaccaataatttgtttttatcttgtctctaggtaaataagattatatagcaaagtaaatattacaagtttttcaggggaatattttgaattgaaatgtatttttagaagtttggcattaaatcgtaagtaaagtttaaaaaaatttttaataaatatttttgaatgaaaaaatttggcagaatttttaatccattgtttagaaagacaattaaggtttgaaaaatttcttagaaataagaaaccaaacataaaattaacatactaaaatttgatattttatttcaattaggaattttaaaatacttatttttatgattttcaaaagatcactagttttgagtttattcattaatgataaataataatggccttatagttaacacagtaagtttttatgaaaatttttttttcaaatttttattgtcagtgtaataatgccttttaaccaatcatgctatttcatcaaataaatttagttcagtgacttgcatgggggaggggtggtggagattggccttaatagctgacattttttaatgggaaggagctagaattttatagttaggaaaaaaaattactgttttaatttagtttttttggagaatgttatgagagacctaattgttcctaaacagggaaaactggtttaaattgagaaaaaaattactcacaatattttacactacgttctattaagttatagtttctgagtatcccatagcatgataattttatcatattataacttttggccagtatttgcttactcactgtttctatgagcaacagaatctacgcaacagcaaacagtgatcccagccccagttagatttttctctttcataggcactctggaatgctactgtgttaaagtaatcaaccattttaaaaagacaaatcaaatttaaactgactcgagagtgtagtttttttttacccatagatgttatttttgttgtggtttatttgcaaaacccttcaccagtcatctttagatattgttcacaagtctcctatgggataaatcattactttgaatacagaggttacagttgtttattcaggatcccactataaattgaggtcaatactgggattctaacgtagagatttctaaggttcccatatactataattgttttgatacgaccaagggataaaaaaagaataataaaagactgagtaggcacttacatttatatttctacttacagattatttaatagtgttatcagctatagtgtaggacgtctgaatgaagagtaaacgatggaaaacataaccaaaggacataactatgggcatcttgattagatgaaaaaacatgatggtcctaaatggggggaattcaatattactttgtaattcattttggaaagaaattaattcctttcacaataatttgaaaattagtgtagttccaaaccacatgcccagcattaaaaaaaaaaaacaacactttattaaggtatgattgatatacaaaaaaagtatgtattatatatatatatatataaaacttaatgagtttgttggtaagtatacatgtgtgaaaccagcatttttctttaagttgctgtattttgtttattttggtttggatttgtctgaaattcgtagtcaaaatttcatgggatgttcttggtaaaactagatgatgaatgtttgaaaaaagaattaagagatggagtttatagttcttaataataaaacatagtataaagctataataattaaaacagcatgttattggtaaatggatagaaactaatgagactgaatagcaagctcaaaagcatacttaaatatatataaatacttaatttctaatagtggtatttcatatgaataaggagagaatagattgctaaataactggtgaagaagcattggttaggtatttggagagagaaattaaaaaatgaaaatatagatgaataatcactttctttgataggcaaagaccttaaaacaaaactatttttagacttaacaactttaaaatgtaactgctccacaagtaatattgccaaaccagaaaaatacttgcagcatgtatgacaaagtattaattaacttcactgacaaacactttctgaactcttactatgagcatagagcttatgcttggggtggggaaagaaaacaataaacatttacaaattagataatttcagataatcacaacttttatgaagattataaaatattgtttctcaatacttgtactattggcatatctttataggactgttgggaagattctagaatgattatatcctagttaaagaagccaaggaaaaaatctctagaaaagtaatattgagcagagaattgaatatagtaaaggagaaaaccgtgaattttgaggagaacattcttggaaggatctgcaaagaccctctattagtgttttgttaaaggtgaaacaaagtagtacacacttagtggtttccttgtcccatccagctcctagaggctttcagcattcctaaacttgtgactacatcactcccaatttctgctttattcgcacatcaccttcttactgtgatctccttcctttctcttgtaaggaccattgtgattacattgggcccacctggctaattcatgattctctctccctgtctcaagatctttaagctaatcacatccctaaagtcctttttgtcacataaggtaatattcacaggttctggaaattacaacacagacatgggggaggagggctactattcagcttcccacagaccctgattcagtgtgttcattttcaattgctacagtagcaaattaccacagacttagtgcctcaaaacaacataaatttaccaaacttaacataaatatatattttacttctgtggcataaaagttcaatataggtctcacctagcaaacatcaaaatgtcagtagggctgtgttctggaggctctacaggagaacccattgtcttgtctttccccgtttctagaaaccacatacatttttggctcatggcctgcttcttccatttttaacggtagcagttttgtatctctctgtgtgtatcttcaccgcttgtccctctgactgcagccaggaacgtttctctaattttaagtatttatgtgaatacattgggctcacccagaaaataatgaagaataatctctcatctcaaagattataaccttaatctcatttataaagtcccactttactgtggaaggtaacatcccaagtttcaataattagcttgtagacatctttgggggaacatcattctgtctaccacattcaggaatattttgacctattcaagcatagaaagaaggcaagtggctggggcacagcaaagggagggagaatggtgagagatgagattggcacggtagtcacaggccagactgctgtccattggagagtatttcaagagagaataggatgtcataaattaaagaaatagatcaacattaatctacagaagtttctgggatgataaaaagaatgagatgatagattctgtatcttatctgtttttggtgtatccgtactgcccagtacagcaaccattagctatatgtggctgttgaacactaaaatgtgacttgtgtgactgaggaacttactttttaatttaattaaatttaaatttaaatagtcatgtgtgactagtgatgactgtattgaacaggacagacaatagatacattttgggagaagttttgcaatgacaggagcagaaaaatggacaatagcaactagagggatatgggattaagggtgttttttgttttgtttagattggtaaaattaaagcatatttgtattcattatgtattattgagtaacacattaccacaaatttagcagcttaaaaccatatacatttattaatctcactgtttctgtgggtgaggagtccaggtatggcattgctaggagtcctagcttttacatgagtttgtaaaagctgcaattaaggtgttgtccaggggctgtggtctcatctcaaggtgaaggatctgccttcaagctcagtggggtactggcacagttgagttccttgtagccttttggactgagggcctcagtttcttgctggctatgatggttaattttatatgtcagcttggcagggctgtggtgcccagatatgtggtcagacattctgggtgtttttgtgagggtgtttttggatgaaattaatattcaaatcaatggattttaagtaaagaggattgccctctgtgttagtccattcttatgtcactataaagaaattcatgagaatgggtgctttataaagaaaagaggtttaattggctcatgattctgcatgccatacaagaagcatggtgccagtgtctgttcctgctgagggcctcaggaagcttccaatcacggcagaagatgatggagaactggcatgtcacatggcaagagtgggggcaagatagagagaagcagttctcaagtgaactaagtgagaggaggccccacctagagatacagatttggcagttttcagcttatttttaataatggaagctgtgactgcgaataaccctttcaacctctgtagagttaaataagaagagggccaaggaattattccaggaaacaatactgttttacctctgagtagacaatagagaagcatactgaaaagatatgcctagagacctgtgatgagatctggaagagtgtcagggaatccaagattctgtatagaaggaatcaaatctgtatttcttcatcagcacctaataccaaaaataaagtagcaggcaaataataggcaacccctgccctctccctctgaccaatccggttattatagggaaagccttctagctggttgagtccatatacaatataatgtttcatttttaattgtaacacctaattaagccaggatatataccctaaatgtaactatattgtccatgaaccaaaagactcatcatctctgtttaagacaacaatagcatgaatatttatagcccttcaatgtaaagccaacttctgagatttctgtactatgtagacttttgtggagtttttttctttttttttgctctcaagaactctctgattcccactatgacttttgcaattattaagacctaaataagaattcttagatgacacacttgaaatattaaatcgtatagcgtagccttaaaatgcttataatttttgtagcacaataattacaattttgcttacttttcacccctagattattgcattttgattttaagaacctgtaagatccaaaatacatggagcttgattatatgatcagcttgagatatataagcattttttattagttctaagaaatttgggcaataatatgttgtagttgggaagatgagattagtagttttgcaaatatagttttcttatctttttagaaggagtccttatcagtatccttttctcagttccagttaccttttaagatcagtgtgagcagttgtcaactgagatatgttactgtcccttttaggaggtgcatttgtgatgttctttatttaaatctaaaacaaacatttcaggccagactcagtggcttacatctctaatctcagcactttgggaggccaaggcaggcatatcaatttaggtcaggagttcgagaccagcctggccaaagggtgaaactccgtctctactaaaaattcaaaaattagtcaggaatggtggcaggcacctgtaatcccagctacgtgggatgctgaggcaggagaatcacttgaacccaggaggcggagcttgcaatgagccagggtcatgccagtgcactccagcctgcgtgacagagcgagaatctgtctcaaaaaaataaaataaaataaaaagtaaacattttagaaagtcactaaactgaagagttcaggatataaagacttaggttgtagttgattcaaaactacaaccaaaagttgatcaacttgtagttgatgaggaacatagctaggtcaaggtaatacagttcagtcacctttttttaaacatatcttgatcaatttcctgtattactagaattttacaactatgtatcacaactatatatatgcaactgtgtatatatctacaatagacaatattctgcattataaactgtaatggatagactactgtttttagtatacatatatcttgatacagctaaatttttctctgatgtgaataaatttaaaagcactcactgcaacaaaatgagattctatctggccgttatgcacctagtaataacatcaagatacctttatttttcattttcctttagttccacatcttgtttcccaggatagtaatgaactttaattctgcaagtttatgtagtctactttgataatatattgaaactgaaaccctttagtggatatattttaagcaggatatcaaatcacaccttgataatctcctctcctcagaaacacttagaatggccacaaataactctctaggaattaagttattcatagtatttattttgtatgctttactgatacttttatttgtgtggccatttaaaagaacctgaaaactgagtatataactatacattctttaaaaaacatctgtttaattattttcaaatctatgtattatgatagcattaagtgctattaagcaatctttaactgtgccctttttgtttaaattgtactaatcaataaataaccctgtcatgtctttatttctttatttggacagaatcactgcccaaatcccttacctatcctattgtagttatagtttcttaatgaggattattacaataaataaataatcaaaattttatcaagcacatagtatgggccagagctttgaaagataatttggaggctatggaagaaatagaaaagagggtcccagatctcaaaaagcttgaaatctaaagggaaagactacatttctgaaacaaccaaagaaaaatataagcaggatataactgaataatacattgtatgagactgaaatattaagactagagaggccaatgtaggctgatatggtttggctgtgtctccatccatatctcatcttgaatggtaactccaacaattcccgtgtgtcatgggaggaacctggtgggaggtgattgaattacaggggcaggtctttcctgtgctgttctcatgatagtgaatgagtctcatgagatctgatggttttaaaaacaggagtgtccgggcacagtggcccacgcctgtaatctcagcactttgggaggccgaggtgggcagatcacgaggtcaggagttcgagaccagcctgaccaacatggtgaaaccctgtatctactaaaaatacaaaaattagggcatggtggcccacccctgtaatcccagctactcaggaggctgaggcaggagaatcacttgaacccaggaggcagaggttgcagtgagccgagatcatgccactgtactctagcctgggtgacagagtgagactgtctaaaaaaacccaaaaaacaaaaaacaggtttccctgcataagctctgtttttgcctgctgtcatccgtgtaagacgtgacttgctcctccttgccttctgccatgattgagaggcctccccagccatgtgaaactctaagtgcattaaaccctttttcttcccagtctcaggtatgtctttatcagctgtgtgaagaccaactaatacataggctaacttagttaaaaagaacttggcctgggctttgaggtgatggtaagggagtatggcatttaatcttggacttgaagggttgacaaaaagatatccggaatagacaaacccctggctaaagaaaatgtatgtgttttctgaaattgatgatttttaatgcggattaaatttaaaaagctaaaagtatttattctatcacttagaatgataactattaagagtcaactagtgaaacctactatgattctttatatatatatacacgtatacatacatatatatgtatgtatacgtatatattatatatgtatatgcatatatgtatgtatatgtacatattatatatacgtatacatatgtatacatatatgtatatacgtatgtatacgtatatataatatatatatatatttttttgagacggagtcttgctctgtcaccaggctggagtgcagtggtgtgatgttggcttactgcaacctctgcctcttgggttcaagcaattctcctgcctcaacctcctgagtagctgggactacaggcacacgccaccacgcccagctaattttgttttgtattttagtagagacagggtttcaccatgttgcccaggctggtctcaaactcttgagctcaggcaatctgcccacctcggcctcccaaagtgctaggattacaagctggagccaccgcacctggccgattatcaatattttagaatttaattgctcttaacttctttacatagagaaatgcagacatagcttaaactcttagaagattatagatagactgaggttcttaacaagatctgtgtactcttaattattaataaaattgagaactaactacaaaaaaactcttaattttatctgtttctaacagaagagacatgctctcaaaatgtcttttatatgtggtttctggctgtgctgtaccattcaaagtcatggttttatactgtagattattttgaagtgacagaactgataaataaagaacagctgtgacagtaaccttatatgtcaaactagaaactggagtaaaaatttaaaaattgacacaacagtacgatatagcttttgtgctaattttctggcgttaaaatgatacttaaattgctgcttttgttgtgagacagaataaagatggactgggtgtagaggtagaacacagaaatattttatacttctcaactcattaagcctgatgaggccctttttgaagtccagtgcatctaggcacgtggccccttgcatctgtagtaatgtgcacagcctagaacagcagcagtgaaggtgaaagagtgcctcctgctcctggctatgcaccgtgtgtatacgggccaaatacttttgagaattaaaaaaaaaaattaatctgagtatttcaagtaaaatccttttctttgattaaatttatagatacttttagtttatttttattctgtagaataacagatgtccttatctattgaaggactagaaactggtgacaataattagaaaatagatataaaaaaagttgtatacttttaagaagaaatgacatttcatgtttattttacactgattagctgcaaaaagatctaagagggttttggaatttttcatcagtgtgtttgagtgatattttgaaagaagttgttattagtgatttaaaattagtcctttctttgtcatctgagatagaagtgtagagggctggacttgtttatctcttcatttgtattttactgattattttatttcaggatcaaagtgtgggatgaattctttatccttttggcattttgaaacttttcaaatgttaaaaaaaactttttatttctaaaaatgtccacttctctcaaagctacctgacaattgttaaaataaaagaatacaaaaccactttgtgggtttatgttttgctattgtaacctattgtctaaaataaagtaagcttatttttttctcctgctttgtatcaactcaaaacaataatattctgtaggtgactttttttttcctttttttgtttttgttgttgttgttgttttcgagactgagtctcgctgtatcgcccaggctggagtgcagtggcacaatctaggctcactgcaacctgtgtctcgcggttcaagcgatccttgtgcctcagcctcctgagtagctgggcttataagcgtgcaccaccatgtctggctcatttttgtatttttagtaaagactaaacactgtctttacaacactgtgttggccaggcaggtttcgaactcctgacctcagatgaactccacctgccttggcctcccaaagtgttgggattacaggagtgagccactgtgctcggccaggtgacatttttctttaactttgtgtgtatatttacactcagagaggtttcaaaaggtaactgttcaaatttactttcaatttatttattctttatataggtaaaactttcttatttaagcttatatgcctgttaagtggactcatatttcattgcatgagaaaactgcaattgctttttcaaactgtacgaatgcagtttcacagtggatgtctaagtgaagtctgcttttatttgtaaattgtgtaataaagatttgtctcaaaattatcaaccatattaaatatttcttaatctgtatgtaatatatttatagaaatattcttttaaaagcaataccttttggaaatattcttatcagataaatggcataatagaaattcacaatctaggaggcaaaaaacaaaaacccaaaacaaaaacaaaatcaattctcattttactcttctacggactcagtgctaccagcatctttctttggaattatgtgtaggttctgaacctaattcttcccctactttttgtctagttgggatactctcttaccaagaaacagcacaacagcatagcatagcagaatcttgactttaccccttcaataacttggataactactctgaacctgagtttactgatctataatgtggatatgataatagttctcttacggtgaagatttatcctagtttatatttttgctacacttgagttacacttcaaccaaaagatgtggtaactgaataataatcatcataatttgttatctgttataataattttaaggataaatataatcattattactaatcattgtgtttcggcatccttatcagccaaatggggaatacctgtgttctcttcagaattccataagtgtactaaaactatttgagtattttattttaaactgtaccctagtagaggaattaaggtatttttaagattcttacctttatgcaaaagtactaaagcttgacacttaactttattattggcaatttatggtaataaattattgtctttagataaaagagtaattactgtgtagctactagtttcctaaaactctacctttctcttagctataacaaaattttgagctttcttcaacaaaaggtcagttattccattttagcatttacatgaacagaaattagagttaaaattatcatatataattccttttcttattctgagcagagagacttaaaattaggctttagcaaacagatggtagtaagcttatacagtatttatgttgctttcttttctgctaggagatggaagagtgacttaccacttacaaaaattattcttgggctatatgttgatttatatgatcaagtaagaaactttaggtagaagcccagtttttttgctcactgtttgtatatcttgtaaatgcattgtatttaaatccttcttacacttttttattctcagaagaaattgtgtatgcttaaaaccaggcttctcaatcttgatattttccccaaattaaccatgtttttctttcattttagttcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacggtgtgtacacagtttgcttgtggtataaaaatacggagccctctttatgttgttatagctttaagttaatgattggtaaatttccaatatatgtggattagcacatatatatttaccttaactgaatatgattaaacgaaattattcatcactattgtatattataggaatacattaatacattatgtcattagtatgtggtggcaccagcaaatttataaacaataaggattaattgggcattgaagatcaaaacccattaatactaataaaagatttaggtagtaaatatttattaagattaattcagctcaaattataggattaataatgaatgaaaaagagacatgaaataaaataagcataattgatttctcatttgggctcagtgagtggcatctatttcaaattacagtgttttggctcctaatagacttatttctctggatttattgaaaattcatactataccatttttaaaggatgagctaattgtggctactggataagacatttggaagccttttatttttatggctttgcctctttttaaatgaggaagaaaaaaataatttttttttaaattatgaactttctcaactaaatcctaatctaggctggcccaatgtgtaacctttattattctattagtataagatatttgaaggaaataaaatgcatgttgtgaacacttgtatcctcacttataatatatatatgtgtgtgtgtatgcacacacatatatatacagtgagaaagaaaatgatgtctgaaaaattatgtggaatatatatataataatgataataattattagtacatccagtagattttttaaatcttttgcttaaataactctaaagcatgggaacagtttatccaacatatttagggtctttttagcgcaaccattgtgattgctctgtatagacgttagtgagtatatgtgaaagtatatgaaaaatggtgacgattttaccactatcaacatatgtatgtgaaaatgaggctgactaaaagattatttttctgtacattcaattatatttattaactaatgcaaaacatgtaaaattaagttcctaacatctagtgttatttggctttcatgtattatattaagaaagtggttattttgttctatcttagatctacatttttatctccaattatttatatatgttatatataaataatataaaaatgagaccaaatccaaactgtgtatcaggaaaccatgcagaaaaagttaatttttctctttaactgctgtttattcataaagatgatttcaatgtgatagtatgaatcagtatcagatatctgtactacaaagcatttcttggacctgtatctgtagcttgggtgtattttctatttaatatgtgaaataaatcaaattaaaggagatgtgctatggtcgtgataagccattatatttaaaactcagaataccctcaggatgataggaaatttgatccacaaattgcctacaaaaatgcagactgggtacttggtacttgaacaaattgctttaaaatgtctgccagaggttgaaagaggtattatctcatcagtattcaacaccactcccatagaattgaaagcagcagggaacgaagatggggaattagagacaaatgcaccctgtgctgtaacagtgtgtgtgaggggcacatattatatgtggctcacagatgcttgatttgctatttctggactatccagcaagtgcttttgtcttgttgtgaagagatttcctgtttgatcaaaagcacagccatgtaccctgtcacctgctttattatgatccagctatttttttgatagtactgtgtcagatgtcttcttcagggtctatagatgtgtgccagtgggtggccctatgtcctgagaggaaagagagtccactccagagaattctagtctctttattgtattccagatcttagattagtagctttaaatatttcccaaatttgattnnnnnnnnnnnnnnnnnnnntcctttcagaggacagaggccactttaaggagctgtaaatacatcttgatcatggccaagcagcagtttcttagtgttccctcactagagcctttgcatgctggaaaggatttacagctttagcttccataaggcagtagttctgattaagtgtctttagggagattagaaataggacatgagcatatggagttaggtaactggggacatagaaagtagagaatcattagagttggggccatgatgttaagcctggcaatagttaattttgggggaagcctccgattatttttgggtcagtgtccattcatgatccaaacatttcttctatactacatatgaagggatgggagggtggtgttaaaatagtggggaaggacacaatgtaagggatgggaattcccatagaagcgatggtagatgggtctgagatacatttactaccccataggatattatatgagaataaaatagttgtgtacacatgtgtttattagcatggaaaatgttgatcatatattaaggtgagatgtgcatcaccacaaatataaacaatatcccattgtttgcaaaaaaatatatttatatagagagtatctggaagaagaaaattaaatgttaatagtgtatatctggaattgtagactacattttcctttaattttggggagtattttttgtatatgttttagtatttaaatatgtatcaccattataatcaaacaattataaagctattttcatttgggatgatggtggagaataaacacttgagtgaggaatgagaaattacagcataagtaaaaagtgtgagctttaatgcatagaattttaacatatatatttgctgttatttttaattaccacttaataattgtgttcttggctccattttgaacaagtggcatcagtggattaattttgtatagtgtagataaaggaggaaacatttaagatgtgtacgtgaatccttaggttactggctatatttatttcatgggttttctacttaattacaaataaaaactctcaagttccatgttactgaataggtgttttgtttgcactcagacctctacttagaaattacctgcctttattctgagttatagttattaaacccataattggaggcagttttcagggaattgggttgacactcacagaatcatcaaaataaaagaccttgaaagctcttctacttcatctctctgccttcaagatacaatcacattatatccagatgaattcagtccgatttttaaagacctcaagagatatcttcatctcctcttgatagcccgttacagtgtttaagaactgtcgcagtcagaaaattctttcttccatctatgggtaatctgaatccttcacggtatagttgaaggccatttcctcttgttctcttgtcagaaaggatgaggaacagctgttcaccatctttttccgtacttaaagccttattaaatctctttaccactgcttgcttttccagttctttttagctttctttgtcttcccaactctattcagactttcttttgacatacaaccctgacctgggccagatataattttggccagaactgattattaatttaaggattactgcactgtgtctaaataccatatgttcacatttatatatctattattttattttgagctatcatttaatctgttgtttcatttttggtgttatttctgcatgaaattgttgtgtttttcctcctagtttgttattgttttgacatgttattcttagattgttttcccacccagagacattttattttgaatattcagtatttttttgtatttttttatccttttaattttttaaaaaaaattactattttttttgtccaaggttttagatacctcagtgctaggttgctaattaaatttagcattattgttctgttttcctagttattgtagaaaggatgaagtatcattagacctttcttgtttgatgttatttgtgatttcgtcccaatttgagatttgcctggatttgatccttggactagtgtggtctgatctagttgtacatgggctttttgttagtgtcaccagacttagcagtgaatcccatgtctcttctccactaaatgttctcacctaacagttcctgtccaatttcttgaggcataagcttgacaggaagcacgtaatggaatgcatagtaacatcataatgctctaggagaggattggcattaaaaattaggtgggaatgatacgacatacctcttagttactgattattggataaaaggatagcattctctgagtcttgaaaaattaaaagttaagagtaaattcatgtcatgcaactgttcacactaatactttttctccagtcagctcccgctcccccacttttctaggaagtgttgtccagtttgatgatcagaagtttggttgcaaaaaaatcctaaagctttgctgaaaccaagcaaggttaactcacatgataccattcattctattgactgtgttttcctgtcacagaaatgtttcctttgacaacatagatctgatactggttacttaagattaacaatattctttaggaatattatatgatatttcattttcatatttattttcactttgaatgtgtcataccaaatgttaattttaataaaggtttgggaattagcttgttgttaagtacacatcatcattcaatcaagaattattgaagtgacttatatggaaattaaatatggacttaaaccagataaattactaattggttaccattcctaaaatttaatataagaaattgtaatatatttgtttatatgttttcacatattggtttttactttgcatatgtttgaagtatgttattatatactcaggtatttcagtaatatgtatgttttaaagttttttgttgtgtttttttgaaaatattataggaagataagaatatcatgcttacgtaacactgaatctgaaatataaatgtagtgacatgtctttgcttaaaataaactatcaatattgctagctccttttcaatattcagtttttttctaacatctttcgtgtacttctttctcagagaactttgcttaatgaagggaatactgttagattgatattatttgccacagtttttttaaaagctgaagatgaaaaacattacttttacaatggtgaatagctattaaatgagggaaaaaatacaatattcggaatcactgtttttctgtttccttataagatgtcaatattagccattctccttggctcttcttctttgctggagggctatagtcagccatggtgcccagcaggaatggcataatcctgaagccccacttttgtaagtactggcagtggcctatagcaatatggttcacccagcctgcaaggaagagccacagacatgggactgggcaagcccactgcattgcccggtgccttgtatctggacccactggcccctagtaaaatgccccacatgaggtttcacaccaagtacaagctggtaggggcttcagcttggaagaattaagggtggccagcatccacaagaagatggcctggaccattgatttctctattgatccaaggaggtgagacaagtctactgagtccctgcaggccaatgtataacagctgtaggagtactgctggaagcttatcctccttctctagaaacctcagcctccgagaagagagacagctacactgaagaactcaaattggccatcacactgacaggaccggtaatgttcatatgaaatacctatacgaaggagaaagccagagtcatcaccaaggaggaagagaacttcaagactgccacgtcaggccaggtgcggtggctcacgcctgtaatcccagaactttgggaggctgaggcagatggatcacgagctcaggagttcgagaccagtctgaccaacatggtgaaaccctgtctctactaaaagtacaaaaattagccaggcatggtggcaggtgcctgtaatctcagctactcgggaggctgaggcaggcgaatcgcttgaaaccagaaggcagaggttgtagtgagtggagatcgtgccactgccctccagcctgggcaacaacagcgaaagtctgtctcaaaaaaaaaaaaaacaaaaaacctgccatatcaatgcctggctctttggcctctgggcaaaaaggaccaaggaagctgcagaacaggatattgaaaagaaaaactaaagcactgttgaggccttgtaataactctgcagaaaagctgggaaaacgaataaaccactgggaaaataaataaaccaaaaagatgtccatattaatttattcactttattcgtttgtctaataagaacctaccaaacatctgtcgaatgctaaacactatgctgggcactgaggatacagtggccaataaaacacacatgctgtctgctttcgtggagttcacatctttggcaaagactgtgctgtaagaatttgctgaaattggtcccagagaatatattgccatattttcctttttatcctatgatacgttctaattctttgcatctctagataggtagattgttgaaagtttaagggcatgtatataaaagctatctaatttggacatttgtgtttctaatttcactgaaatatatatgtgtgtgtctatatatgtacacacacatatatattactactggtatatatgtgtgtgtgtgtttatgtacagtataaaaatactaggatacctgtaaaacaacaacaatgtaaataagcagtatgaaacaacattgaaaagaatacataaaataatttgtatttgaatcaataaaataggaatgtattcatcatgtatgtgtatgcatatattaagtatatacaacctcagctattttgctttctttatatatctcttgggagcttaaaataaatacaatcccttgttagctcatttgagcagtatgggatgaattaaaaacaatagagaattttgtatgttttgtcttacgtatctaaatttgaagatatgtagtgttttacatttgctgttttattaatctctccttgaatatatcaagtagaatactttcattgggtatgtgtattgcatttctatatgtatttgtgtgtgtgtgtgtgtggtgctcgcttataagaatataactggataagtcgtgttcttgttgtggagcagtttgttgtctagtagataaatcagacaaattagctatgttgccttatcacaaaataagattgtagttgcttttatagtaatattaacatagtactgaggaaacaggctacatttactcttgtttgaaatttatcccataaaaacattcttttgtaaataaaccatatgtatcaataaattatctttaggcattttgattttctaaaggcttatttgtatcagttttcaattttgatccttatctcagtaaataaattacattaataaccaataatttctaattgtgtatttaaccatctttataaaacttccaagtcagtgaaagcatatgtgaaaataatctttaattgtattttccttgaaatcttcttgattattagactgaattatgttaatgctaagcagaactgcatgactaatttgtttacttatttacttttttagatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaagggtattttcgctatcttgtttttggatgacagatgaatacatttaagtggaatttcttcccaaagttaatgaacattagatgccaactttttgatcatatgagataatttggtagtctggatgtggatgttcaggctgttagataggggtaccatgggctagagagttctcagcatggtctctctatgtctgctcaactgtgtcacctacacttaaattaaaaaactgacatgaggcttattaaagtattatttaattcttagacattagtaagacatactaatttaaaaaaaaactttcatctgcagaactacaaaagttggatgcatatttgtaatcttgatgtctaggcaatgattaactttagaatcaagtggttaatattaaattccagggagcacttattttatctgattagagtgtgattatcagttttattcttctttcacatattctctgaaagtacatatgtacttgatttttatggaagaatcctaagtgacaaatggctgatacggctttcgacgattataacttttttacgcattagcaaatacaagttagggtctgttgctttgaatcttagtagaagtacagaattaccagtgacgtagtataaaaaaatttgatatcagctagtcctagcacaggtactggtcttgcagtcatacctattagtttatagctttggacaagtcactttatcttcataataaaggtaaagatacccatcttagggttttgcagagatcaaatgaaatgcgaactgttctgagattagtaaaatgttaaatactctgtgactcacagagataatttgttagaaaaagtattttgatggaagaatagtacctgataagaaactgatttaatattaattataataagtactaaattcagattaaaattaggtaaaagagaaacttgttcttaagagagttaatatataggttttaagatgctttcatctaaatcatatatattttcaatatgtttgtctaattagaatctttttctaggaatattttctataattgcttactgataaatctgctgcctagcagggggtgagccagttatttataattctacctttctctgtttctagggaaactgcaatctgttctgaaatgactgctgaccgagatccagtctatgatgagagtactgatgaggaaagtgaaaaccaaactgatctctctgggttggcttcaggtaagagatacatacatttatctcctctgttgaatatcttatttgggcttcttattctaatgacaagaaaccataatggaaaaatgttgtgaaagaccttattctatgaaaattctttagcatttttattttaaaaactcaaatttttaatgttaaaacttaatattatttgtaaaatgcagcaactcattagcacagcagtgtgagcaagcattcatacacatatactccaaggtatactattcctggttaaatataaccaggaaaagcataagcaatgaggaagaaacacctttatgctaaatatcatcagcttaaagctggttgcctttaacatttgagatcttatttagctaaagccatgaataggccactggagcagagtaatcaagaatgctctaaattatactgaagttgaggccttctttcactcttcagaaaaaagattgcaacaagtgagatgtaatagaggaaaagagaaggggaaaaatggcagtttagtacaaagtacctatgacttactcagtcctttggatcaagttcccagcaagtgtttaaacccatgagttattttttaaaatgttttatagatttcctagtgacggtggaaacaggagcctctgaactcattttatacttagatggttttgacctaaaaccaatactattaaaataaatgcttgatttatttatttagaaaatatttttgagttcctattatgtactagaaactttgctatgcattagacagcaaaacacaaaaatctgtgccattgtggagtttaaattgtagtcagggaaacatataagatgaataaatataaaatatgttaggttgataagtgctaaagagaaaaataaaccagagaaggcgttagaaaggtcagggtgagaataaggatgagggttatgattttagccagactatcagaaaaggcctcagtgagaaggtgaaggtgacatgctgtcttggggaagaccatgccaaacagaaaacaaaaacaaaaacaaaaacaaaaaaacactaagtacaaagttcctgacgcgtttaagcaatactatagagtgtaatctggataaagtagaaagatgaagactgggagaattaggaaatgagatgagagagatgatgggacctcatcacgtgtagggcgatataggctaccattagaacttctcctgttactttgaattaacttggaaactactgaaggattttaaacagtcaggtgacataatctgactcaaatttcaagaggattagtctgtgtattgtgttaagaatagactataggatgacaaatgcagaagaagatataacagatgggaagctagtacaacaattcggtgaaggatgaggctggcttagaccagagtgatggagaggcgatgagcaaggagcagattctaggtgtgcttagaggcagcaggatttgctgatgaaggggttatgactgagcaaataagactgagaaggagcagccaggaggtaagaggcaaaaatataaatgtggtatcctgctgattgatggatttagcaatacaaacgttattaaggatcttaatagaacatattcactggattggtgaaggaaggggataggagagaataggagtttcaaagggaatgggaggagagaactggagatgagacaggcaatactttcaacaaatttcactgtaaaaaatgggaaagacatggggcggcagctggaggaggaagtaggataaagaaaagtatttttgtttgttgtttttaaataaaagaaagaatatgtttgtatactgatgagagtaactaaagagagcaggtaaaaccatcaaggcagtagacagaggaaaaactactggaaatctgtctctaaaaatataagtggatgggatccaagggacaagtagtagattagtttagccaggagcatagtcactccccataatgacaggagaaaaggtagaataaacagatgaaggcacaggaaagtatctaactgcagtcacagaaacttattaacattgattaaactggttgattcatctgattctaatcagatttgaattggattacacaatacacacacaatcatacttttgcacttgggaatgaaatttcttttcacttggcagttatgcttgttttaccctagtgtcccatttaaaatgaaattattatttaataatcaaatagagaaaaacttacaaagataatttgtactctttccagtttaaactttcagaatttttattaaatacaatgacctttggtcttgtttcttagtcagagtatcttaccaatatttgaagtaggtgaaaattattgatgagaaaatacgtggttaaatatggctatatgagaaagaggacttttatgtgttcagtctattttaagtaaaactttaagctacaattgtactattttcaatttggcaaaattctcctttctcttcagaaatgtttagtttatttcatgttctttctctattttacgtgtctttatttctttagcccacatctagttcattacacatatgatctataggtctctgtttttattttttatttttgcatttaacttgcttttagtaagttttcgatgtcaagaattaatagcataatagaactttaccctttttcttctgctgcaaaaagaaatgtttaggaaacagatgctgactgaaatagaaaaataaatctcatctcaaatgcttgacactgaatcaagaactagatttcatagatctgagaaagaaaattgtagatgttaaacaacaaaatgggccaccctataatttaccagtttccacaattaattcttctacagagacaaaatatgtttttagtccatgagagataattctgttgaacacagctttctctttttggtactctatgtagtattactatgttttttgaggcagagcagtgagaatttcttcctgatcttattctgccatcttgataataaattacttgctctttgaatacaaataaatttgtgaatttattttagatattgcaatttcctgtgtgcttttcctacaataaaaacaagaaaaagagaatctgatggggattaatacatttattcagactttcagaaagctgtctttaagtggctgaatatataatttggtagttattttgttatagtaaatggatttttatcattaattattaaaatgcccaaatttcatctggagttgttcacattattacccaatttcttgatgataaaatagaggtttagtgagatcaggatcatttagtaatacgaagatgaatatgttaatctgaatctgagtatggtaaatttgaattggattacacaataggcatacaatcatacttttgtaaatgggaatgaaatttcttttcatttggtagttatgcttgtttttaccttactgtcccatttaaatgaaattattctttaataatcaaatgtagaaatattcacaaagatggtatggtaattcattcacaaatatgaaatggcaaattcatatttaccgtattcactctagggaaaagtctggttacttttatgcatatatccagaagtagagtaggggtattacaatttgaaggaaattgttaagttacatttttatgaatacgcaatcaatttatggctttttttcctctaaattttcatattttcccactgccactaggattactgaggaaataactaatgataatgtagatcagtctaataaaccacatcatgctcatatgtactgtatgatatagcatgaaaaacctcaaaaaatactcattttcttggctaaaaggaaatccccaaagtattctgaaacttgaatatcacagtcaatatcaccgcatactacattttatatttttccatagcaagatttacttttactatgtcttggattttagaatttccagatagatagtgattgtattactgactttatttcttaagctatggctgcatactaaggccctggattttataggtatttcactttgttttatattaagattatgataaatataatagttgctgtagtctctatttgtagctcaagctttggactagaaaagtagggatcactttcacccctatctagttggtattaagtacttgtggccttaaagatttcctgcttagtctggactcctcctgcctccaaagtgagtgtgtgtgtgtgtgtgtgtgtgtgtgtgtgtgtgtgtgaatttaatagaaatctgttgggttattatagatactgtgaaacagtcttccctataagaaactctttttctttccaaatcaaggtaaaacacgatgtccctatctaaggagaaacattgttaaactatgtccactaaataacagaacctcaacaaaatatgtagtgatagaagcaccattatgtatagcattagagccaaaatctgcaacaacaccacatgcaattggccttttatttgccccaaccatatcagatataatctaagaacagtttcgcattgtgcagttttaaaatattgcttcagaaccattttcatgctgtgataacagaattgtatgtgaaaacaattttaaaatatatatgaatattctaagaattttagccattatgaaacatttcttagtcttaacataattcaaaaagcatgcaaatatttagtggaaaatttgaatttatatgatagagttaggatttttcttgtgaaacattttgaaaagctatgcttaattggctcctaattagttagctatcataaggctaatgattttaattcctcactaattattttaatatataatcagtatttgaaaattatagttatttctatgaatagagttgacaatatttattacaattataggataattaagagcattactaaaatacaaataagaaatcttttctagaatgtttcactctttttagctgcatattaaaggtgcacaaccactaaaaacaaatataataagctttcctaccacttttctacataattactagcccaagatttagcacattagtttaattaatcctgcttcttaaccaacaggaaggtccctgtataactgctatcagtaatttaggctttcacttagttggtaggcttcctgaaaggaagtgtgattatagaatagcctttttgaaaataaatgaatggctatgtccaacagttgatgaatactgatatagtagcttttaaaaatagaacagaatccaatatttttaagtatcaaagggcttgttgcttcaaacagtgaatgtctactcacagaggggataacaacatgtactgccaaagagattactcagaaactcagctttagaataacagattatgctcttagtcttgcccagcttgtttatcatagacacatttatttataagttttaaattaaaagcttgatttagttaaacctaccaccaaactggaaaagaaatttaagtgtatttcctagcaatagtgggcttttatacataaccattgttgctaggaataacgttatatgctttggaaatctagactgtatagttctagatcctgttatttaagctcattgtttttccagtgagggaacagaggcctagaaagattaagtacgttacttttggttacacaggggaaaataatgaaaagtatttgccttgtaatataataattaaccacattagcacgtctactcttgaaatattataaaaacccttgcaaattttctaacaatgaggaaattgccactgatacaagagaataatgggaacacttttttctcctatatagaaaaaagatcctatttgtacatacattctcaagaaagatagtcaacgtcatcagattgaacaagtaagacttcatggtaggtagcttgtggagaaactaatagaatgcacatatttctgttgaagtcatccctgtgtatattaatttcttcagattttgacttagtatttattcacctgagaactctcaaatgtcccaaaggttgttagcaaatctatgatggtttcttatttcctagtactaaaatataactttgatatgacctcctaggcaagtatctctacatctttatatgtttggggggagacaaaaattattttaatgttatttgtctctgactatggatgagtgagaaaacaggcaaatcctttacccccaaatcaactatgaatctaaaattgacccaaaaataagcaaataagtacttccaaacatggccaaaggcaaacagcaatatgagaactgtttattcttgaaaaactgctgaagtttgggtaagaactgggagtctgtggatttcttgcttgcctaagactgcctctatcactgcctgcccacattcatgagtttggtcagtatgaaagttatgccagcatctggctggccatgaggactggcaactgctgtacctgagctaaagagggctcactcaatttgcagcagagggtgatactcacaaccagcagcattgtcagtagaagtaatgatcttggtgtcagtgggtaggtgtgttaggccaatggatctactaacctggttgtgctcatggttggggtaaacatattcctagctgaaagtgtgcatgcacttttgcagtagagactgaagagagggcccaagctatttttacagttctggcctaacctagagataatacatatcttcataggagaatagaaaaagagaggctagactttcaacatactcctgttcctgccaccgcccctcccccaacaaaagaaaagaaacctattagcttgaggtgtttgtgcattatttctatcaattactggctgacgtcaaaactgtctagacacagagtaacccatttggagctaggctttaaaatttaaaaatcaagaataaaataaactgtgcagaaacatcaattgtcacacatcacaagagaaacagatttcatacatttaccacaggtaagttaataaacaaacaaaaagcaacagtagcaaacttcagaaggaaaatagtcaaaacccaaagttgttacaatatattatttaaaatgtttagttttcaacaaattggacatacagagaaacaggaaagtgtggtccatacttgggggaaaaaagtagtcaatagaaaatgtttcagatgttgaatttggtagacagacttcaaagcacagtttatatctatatctgtatctatatatatatacacacatacacacatatgtatgtttatgtgtatatgtatatatacacatatgtatgtgtgtatatatacacacacacacatttatatactaaactaaacaaaaacatgtttaaagccctaaaggagagtacgatataaatgtatcaacaagtaaagattctcaataaggagatagaaattatttgaaatgaacaatatgaaaattctgaatttgaagagtgtaataactgaaatgagaaagttactatagcagttgaacaacagattcaaattgtcagaataaaaaaaaatcagtgaacctgaatatagatcaatagagtgaataatttcctaggaatgaagagcaaaaaagatggaagagaaatgaacagatcttcagagacttttgggacatcacatgtgccaacatatgtgtaatgtatattctgggacaaaagagagagaaaggtagaaaaaaaatacttgaaaaaatgaaagccaaagctttccaaaattttatgaaaaccattaatctaaacatccaagcaactcagtaaactttaagtgagataaataccaaaagataggctgggcatggtggctcacacctgtaatcctagcgctttgggaggctgaggcaggcagaacacccgaggtcaggagttcgagactgacctggccaacatggtgaaaccccatctctataaaaattcaaaaattagctgggcatggtggcacgtgcctgtaatcccagttagttggaaggctgaggcaggagaatctcttgaaccagagaggtggaggttgcagtgagtcaagatcatgccactgcactccagcctgggagacagaatgagattccatctaaaaaaaaaaaaaaaacaccaaaataaaaaaaaaaaacaaaaagatacattgagacacatatacgtagaaaacatttgaaatccatagagggagacacatataggacagcatcaatataacaacagacattatctgaagcaatgaaggacagaaggcagcggtatagcatttacaaaattctgaaagaacaaaaaaagaaatcataaccaatagttttatatccagcaaagtatctttcaaaataaagacgaaataaagacatttattaattaacagattcattggtaacagacctgttttgtgacgcatattaagaaatcttcagggtgaaaggaaacaacatgaaatgataacatgaatctacaggaagaaataaaaataataaaaaatgtaaaatagtggattaatagaaaatataaatacatattttcttttttattattgtcttttatgccagattgaacaaaggaataattacaacactgtgacattgggtttataatatagatagatacaatatacatgacaataataggacaaattggataatatagctatatgagagcaaaatttctatatttgccacatataaagatattattaatatgaaatagattattaagtaaatgtattgaattagtaatttaagatatttccacaaagaaaaccctgggcccagatgacttcactggtgttttctattgaaaatttaatgaaattataccaattccttataaactctttcagaaaatagaggaggagcgaacacttcccaactcattttgtgaggccgatattatcataatatcaaagccagacaagacattgcaagaaaataaaactatagacaaatatccatcatgaacatagatataaacatttgaaacaaaacactagcaaaaagcaaccagctccatacagaaagaattatacactatgaccaactgagattcattcctcttatgtaaagatacttttgcatctgaaaatcagttaaagtatttcacaatgataaaataaagcacaaaaccacctgatcatctcaatagatgctgaaaaggtacgtgacaaaatccaacacacattaataacaaacactctcaacaaaccaggaatatgaggtaacttccttaccctaataaaggcatctaggcaaaagaccacagctgtcacatacttaatggtgaaatactgaatgtttacccctcaatataggaaaaaaacaaggttgtctgctcccatcacttctattcagtgttgcactagaaattctaggcagggcaattaggcaagaaaataagataaaaggtattcagattggaaaagaagtaaaacttcctttttgcagatgatatgatctagtgtataggaacactacggaattcactaaaaaactcttagagctaataaattgactccagtaaggttacagtgtacaagatcaatatacagtaatcagttgtatttctatatgcttgcaatgaataagcaaaaaatgaaataagaaaattgctcctggccatggtggtgtattcctgtaatcccagaaactcatgatgccaaggagtttgaggccagcctgggcaacatagttgagacacccatctttaaaaaataaggaattggccaggcacggtggctcacccctgtaatcccagcactttgggaggccgaggtgggcagatcacaaggtcaggagattgagaccatcctggctaacacggtgaaaccccatctctactaaacaaaaaatacaaaaaattagccgggcatcgtgtgggcgcctgtagtcccagctacttgggaggctgaggcagggagaatggcgtgaacttgggaggcagagcttgcaatgagccgagatcgcgccactgcaatccagcctgggcgacagagcaagactccttctcaaaaaaaaaaaaaaaaataataaaaataaagaataaagaaattaaggaaaagaattgccttcacaatagcatcaaaaaatacctagaaataagtctaacaaaagaaattcaagactcctacactgagaactatgcaacattgttgagagaaattaaagaagacttaagtaaatgggaaaacatcttatatttatagattagaaatttagtattgttggccgggtgtaatggcctacacctgtaatcctagcactttgggaagctgatgcgggcagatcatttgagctcagcagtttgagaccaacctgggcaatatggcaaaactccatctctacaaaaaatacaaaaaaacttagccaggcatagtggagcatgcctatagtcccagctagttgggaggctgagacaggaggattgcttgagcctgggaggcagaggttacggtgagccaagatcacaccactgcagtccagcctgggtgacagagcgagaccctgtctcaaaaaaaacaaaaaaattaatattgttaagataaatactttcaaattggtacatagattcagtgagatgcctatcaaaatcccagctggttttttagcaaaaattgacagaatgatcctaaaacttatatagaatttcaagcaagcaagagtagacaaaacaatcttggaaaacaagaaataattggagaactctttctgatttcaaaagttactacaaagatataataaccaagatgatgtaatattattattataaagatagtcattatatcagacatagtctcactgataaaatgagaatctagaattgagactgtagaagtaagccttcatgtttacggtcaattggtcctcagcacagctgcgaagacaatttagtggggaaaggatagtcttttagacaaacagtgcttggacaattgggtatcgacttgaaaaacagttacacaggtgtttacctcatatgaaacacaaaaattaactcaaaatggatcataggcctatatataatagctaaacctattaaagaaaacagaaaatctctgtgaacttagttttaggcaaagagttctcaactataatatcaaaagcacaatacataaatgaaaaaattgataaattggatttcgtcaaaataaaaaaaattctgcacttcaaaaaggtatcattaagaacatgaaaacacatgccatgaattgggagaaaatatttgcaaatcacatatctgataagggatttgtttctagcatatataaagaatatttacaactcaataataagaaaataaacaactgggtcaaaaaatttgcaaaagacttgaataggcatttcattgaagaagatataagaattgttaataatcacatgaacagatgcttaacatcatttaatcattagataatacaaattacagttaaaatcagataccactacacacctacctgaatggatataatctaaaagttagaaaataatgtgtaggaaaggatgtggcaaaacttgaatcctcatacatttctggtgggaatgtaaaatgttacaaccactttagaaaactgtttggcagttcctcaaaaagtaaaatacatacttaccctataacctagctattctacttctaagtctttactgaagagaaataagaacatacgtcctcataaagacatatacttgactgttcatcagagcattagtaataataactccaaactggaaaattctgaatgttcatcttctggtgaaacgttaaataaaatgtggtctatccatacaataaagtattatttggcaatataaaggagtaaactactgatagatacttattgtggatgagcctcaaaaaaattatgctaaagcaaagggaaccagatgcaaaggttgtttattgtatgatcctatttatatctaatatcaagaaaaagggaatatatataggtactgaaaaccgattaaatgtttgctaaagcttggagtggaaatgatgattaattcaaatgagcccaagagaatttttggacatgatggaactgtcctaaaactgattgaggtgatcgttgtacaagtataaattgctaaaatcattgaattgtacacttatactgggtgaatgttatggtgtatcaattgttcattaataaaaactttctaagagtttctttctaaaaaaaaaaataagcatttgatcatcttgagatatttcaaaacacacacacacacaccccaaaaaccaattgtgaggtcgggtagctcacacctgtaattccagtgcattgggaggacaaggcgggcagatcacctgaggccaggagttcaagaccagcctggccaacatggtgaaaccccgtctctactaaaaacacacaaaaaattagccaggcatggtggcgtatgcctgtagtcccagctacttgggaagctgagtcaggagaattgctcaaacctgggaggcagaggttgcagtgagccaagatcactccactgcactctagccggggcagcgcagagcaagactccgtctcaaaaaaaaaaaaaaaaaaaaccattgcgataatttgagctgttcagaaaaattcttgtacatcctaggtcaagaaagccagagttcaaaagtgcaagtttcattcaagagtaaattaatccggagggtaatgaaatacaagtatacttcttgtttttctattcttattagtattattttctgttcttattgctttgataaatccctaatattttcataaatcactggagctattgaagaatgaagtagagctgaacctcagcacaaggatgcagatgtcagcagaattctgtagcctgtgtaactcttacctgaagtttttactatactcaacttcaatgaatgccttctctctcagtgtatttttgttggtgtctgccttccctcctgccctttctctctaattcttacattcaaatcccaagggaagtggcttaagggtgtcttcaatgagaatagaacatcttgtaggtataacacttgttctgccacccataagactgctagccagcctgctacttggttgcatttttgctgttttgctccaagtatctgtgaccaggattgcataaagtatagcaatttgacattaacttgtgtcatctataagctgtttcagtgggcaaaatatatatgagaaaaagtatgtggtcgcttatttaacttaaacatttagtttcttgaacttctcagtctttaccttttttatatatatatatatatttattagattttaagttctagggtacatgtgcacaacgtgcaggtttgttacatatgtatacatgtgccatgttggtgtgctgcacccattaactcatcatttacattaggtagatctactaatgctatccctcccccctccccccaccccacaacttctcagtctttaatatgctaattaatatgcatggtgataaagatggtacatactctgcaacatttctcaaactcataaaactttatgaacttttttcagtggatattagtgttccctgcaacctatgtgagaaatcctgtgttagatggtttcgactttcatatgaatgaggtgagaaaagggaaggtatctaaagaaaacaggtatttcctaggacagtgtttgtatgtctgttttaagaggacatgtactaaatatgaggagaggatcatatatttgaggatacagttttaaaatgtagcataaaatcataagaataatattaaacctcaaacatgcaaaaacttggaggaattctgaaaatggttaaaaaacgatgttttgttttgtttttttaccattgttgtaaatggtaaaaacattctcagatctcagactactctgagaatttacttatcttagcacaaatgtctgttggcataactaatgttaatagatgacagaaacaatacacaaatgctacttaatttggtttattttgcctcaagttgagttcttaacttgtggtttttaagaagtgtttagtgaaaggatatctgaactctttggatttatgtgtaaaattttctatgtttatctgtctatatatctatttgtatatctatatgaatatgttagtttgccagggctgctgctgtaacaaagtacataactgagtgacttgaacaacagaaatatatttactcacattctggaggctaggatcctgaaattgagatgttggcagggttaatttcttctgagggctttgagggaatgatttattaaccaggcctctctccttggcttataggcaaccagcttctccctgttacatcaaattttcttccttctatacctatctctgttcaaattaccctttttataagggtaccagtcatattggattagggctcaccctaatgacctcattttaactttattacctctgtaaataccctacatccaaataaggttgcattcttaggtcctgggagttcagactgcaaaatatctttttttgggtgtgttggggggtgagggggatttccacccataacaatgccaataggtctatatctttctgaagcaaggatccaaatcaagatgttggctgggttgctgttttcaaaagggaccatattccaaaaatgattccaaaccattgatctaagagactgatatttaaactagaaagaatggagtaagacttgttaaaagggaactgaagtctacaatagatgagatgatgagataagaagagaaagtaacagcattcaaacagatagctaaatcactgtctgtctgtgcattagattggaggtttgtttagagctgcagtgttcagtaaggttgccactagctacatgaggccattgaagatagaaatgtggctagtccaaattgagatgtgctgtaaatgtatactacacactggatttcgaaaacctgctatgactaagtatgaaaaaaggaatgtagtatgtctcattaataaatgtttatattatacgttgaaattgtattttgagtatatttagttaaacacgtattaatatcaacatattctttttctttttcctttttaaatgtggctaaataggaaatttaaaattttatatgaaatatatatattcaacatagtcatcttgaggttctcaagttttatctcatgctgattttgtggttctagaatagatttatattactttgaagaggaaatcaaattgtactaacaagtctttatggagcacttaatatgagggtctttaggtcatgagatctaacgacccatgtatgactaggattgtgggtataattgagtatttttacctaagaaaggcaaaaggtattgtactttactacaattaatcaatttttttgattaattatagtaaaactgacttaagaatgcgtggatcatttatttgtttgtcccaggaacgtgaagctagacgtgttcattgtccctgttaaacagcaaaccatgactgagttcagacaaaaggtgatgtgaatgcagcaacaatttctaaatcagttaaatgtctataatataatatgtaggattcttgtctttctgggattgtgactggaatctctaccacaaacagcacatctggtcccctgagccaattcatcagcatcgcctgtaagccatatttaagatcaaaaggatagacaaggttaccaatgatgaggttctggaatgttgccagcgcatcagcactaacatgatacttgccacgacttaactctgagggcctggggatgtgtgaaggatggatatcagcaggctctctaagcagattctgaatgcatggtgtggtgaaacagaacagttacaagtatggtggccagaagaaaagctcaatgtgagacccttagtggcaaattcaagccttgtggtaaaactcaggaatgctgagaaatagtaaacctagttaacacccaggattttttgaggagagagagaaaggatataatttggggagtgacaaaataaaaaagatcttaggtactgatggtcacattgcttttcgagctatattatcttttaatttaaatgaataatttggacaaaatcagaagttgtaaattgttgatcctttctgcgaactaagctacatattttctttctttttcggtgacatcagtgttttaaataattgatacaaatgcatttaaacagggcattggtttcctgattttctgtaatctgcaaccctccttattgtcttagatctggctcacattgtttattcttatcacttgcataacttctagaagtatttgtgacccttggaggaagataatgatactgatgataatgagtactgctgctgtactagtattctaattctcctactaacaattattgttactactattcactactacttctactttttgaattactgttattttttattatggcatcactaccacaactgctacagactcattaatttagacacctaaattatttaagcactatttcatttaacttaacaattctatgaggtatatactattattatcacccattacaactgaaagaactgatgcacataaaggttagagaacttcctaagggtaagctgtctagtaatttgtagagttagagttctaacccaagcagtctgattacagagctcatctgtgagagccctcctatcctaaagttctttatgttttttgaaatagaacactctaatttattaaaatcctgtagttgagtgtggctttgtattttaaattcaattatattccatgccttcattttaataaaataatttagagctccttaaaagaggtgaaatatattatttctttctcatcttaatggaagaagagaaggtgcttttttggtggttctgttacaatttgatggcagagcaaataaagcaggagaacagtgatttatgctcagtcctagattaaagggcttgtgttaaaaggttattaagtatttatttaataaatactacatttaatattaataatattaaatgtccatttagacattaaaataatagatttagttttaaatgtagccttatatactattaatgttttatttagtggatataaatttagaattgttatagcttattggtgaattgactgtttttatagttatgaaatatctctcgttatctttcgtaatgcttctttccttaacatcttctttatctgatagtagtataactaccccaactttcttttctttggtgtttacatggtttatcttttaattttttttaccattattctttcaatcttttatatatctgagatcggtctttgtgtcaacatcatatagttgttttttaaatctgataatctttgtattttgattggagtatttattccatttacagttcatgaagttaattatataatttatatattttaggttagatctactaagattctatttgttctttattttaactattccaactttcttcattatttcttgtagattgttatgattttgttctagtggtcactctacagatggcaacatatccgtgatttattacagtctaatataaattttcactttcacactttttaaaacaacacttcagtgcattattgcattgttagcttgtatttaaatttgccttatatttttagacctcataaaacattgttattgtagtttggatagtcagcattatgtatatctgtccacatctttatcttttaccttgtgcattatccctttttgttcatatgtgtttttatgtggaattctttttcatcagcctggagaaccctcattttcttcttaatttctttattggccaaattcaggaacatgttgtttaattttcatgcatttgtacagttcacagagtttttcctgttattaatttctaattttatttcatcgtggtcagaaaatatatttgatacaattttagatgtttgtgtttttttgtttttgtttttgcttttttgtactttttgttttgttttgagacagggtctcactttaccacccaggcttgagtggagtggtgcgatcacggctcaccacagcctcgacttccctggctcaagtgatcctcccatctcagccttccaagtagctgggactataggtgtgtgccacaacacctggctaatttttgtagtttttgtagagatgagattttgccatgttgcttaggctggtcttgagttcctgagttcaagcaatgtacctgccttggcctcccaaaatgctgggattacaggtgtgagccttcgtgcctggcagatgattttacttttgaaaaatttgttgagacttgttttgtggtctaacgtgtcatctatcctggaagatattccatgttctgatgagaagaatgtgtattctgcagctgttgggtgaaatgttctgtaaatgtcaagtctatttggtctaaaatgtagtttaactcagatgttactgtgtttggtttttggcctatttttgaatgtggggttttgaagttccctattattatcatattgtcatctatccttttcaggatacagttctatttctttctattcaaaggagtctattcaatctccttttcagtctattaatatttgctctatatatttgggtgctgtggtgttgggtgcagatataacaattgttatatcctcttgctgaattgacttcttaatcattatataattacctccattgttgctttttgcagtttttttgttttgttttgttttacctaaagtttattgtatctgatataagtatagctactttgctcctggttttggtcaccatttgaatggaattttttttttttcatcaaccctctttcagtctgtatgaccttacagatgaagtgagtctattgtaggtagacttgggtcttgttttttgctttgttttgttttttgttttttgttttattatactttaagttctagggtacatgtgtacaacgtacaggtttgttacatatgtatacatgtgccatgctggtgtgctgcacccattaactcgtcatttacattagttgtatctcctaatgctatccctcccccctccccccaccccatgacaggccccagtgtgtgatgttccccttcctgtggtccttgtgatagtttgctgagaatgatggtttccagcttcatccatgtccctacaaaggacatgaactcatccttttttatggctgcatagtattctatggtgtatatgtgccacattttcttcatccagtctatcattgatggacatttgggttggttccaagtctttgcttattgtgaatagcgttttttaaaatccatttagccattcttttaactggagaatttagtctatttacattgtagattattattgataggtatggagttatttctgcaattttgtttattattttctagtgttttttttgtggataattcgttcccttcttcctttgtgctttgatagctttctatagtagagtgctttttattcttttctgtttctcttttgtatatttattatagtcttttgttttgtggttaccctaaggtttgcataaaacatcttatacttctaacagtttactttaagctggtagcagcttaattttgattacatacacaaacgacactgttgctctccctctttatatgttttatgtttttgatgtcacactttatatgtttttataatatgcatcccttagcaaatcattgtagttttagttgttcttagtagttttggcttttgacctttatactggagatataattgatttatccagcggcactatagcattagagtgttttgaatttgacagtgtacttaattttaccaatgaattttgtacttttaaatgtttttaagttactaattagtgtcctctttcttatgcttgaagaacttctttagccttttttgtaatgcgtggtgataaactctctcagctttggtttctctgagaaagttttcatcacctcttcattgttgaattcctctgcggaattattcaattcagatatagcactcttcagatgtatgatttccatgtggcactttaaaaaaaactttctgtctcttcattgaaattctcagcttgttcttgcattactattgccacttctatgagcatctttcaaccattattttgaattccctgtcagataaatcacaaaacactactttatttaggttagtttctggagatttatcttgtttatttgtttggaatatattcccttgtttcttcattctccttgaatatctgtgttgatttatgcacacttgataagacaactacctctctccttcttgttagactggtcttatatatgagaatgttttcatgaacccatttggacagagattttaaggttcctctcaaatctttgtgtttgtccaaactgttatcgctgtttttggtgagcccctgaagcttattatgtgccttgtctggtcagtacctggagaccaatgtaataggagccagactcttaagttgtagctgttatggttggggtgttgaatgtgtgttctagttccttctatcttcatgatgcggctgggtgtgggcatttactttttactttttctgtactgggacagggagaggaactatggaaaatgcccattctcatgttcatgctgtaccttttgatccaaaagggatagctgctggaagtgggcttattatatgtccacctgcttgttttctgtgttctccggttatttaggatcacaaagcccccttgactttcatggctaagttgttaaggagacagtcccttaggtaggagctatggaggttgtggagcttggtgcatcgccaaatttattccagaaaaaaaaaaaaaaaaaaaaaggataggcctggatttatctctggggtgagctggaggaatgttgcatgaagtgaactctggtttcagcttccaaaaggctattattgtttgccctgttaattccccactgtaagttcattggaaaccaggctatcaattagccactggagatgtgtgcctaagcctctgctacgagatagtgagagctgcatgttcctgccccatttctgcactgctctgagtgggtctaggccctggaaatgtttgaatgcctgttaaaaatcacctcttttttctttggtcaagggagactcttatatgcctctgctctcagagctagtaggtttagggtggagtccttctgcagatagctctaaaaactggggcttttaatgtgtgtccgaaacctcttcgggggataaacagggatctgcatttttttaaagcctcttctttgtaccactccaggggatgaagtccctggaggtgctcgtgtgcccacttaaaagtgcttctttttactatggtctagagagatatatgtgctagttccctctgcttttggagctaggagatttaggatgcagttccttaggtagatgttgtaagagctgcggtgcttggtgtgagtacagacactttctaggctggcagcagtttattaattgactttcccattaattccttgatactaagttagtcagaaaccaggttagtaggtagaccctcgagttgtgtttcataaacccctctggggctggagggagggtggaaagagagcatcatacgtttctttttaagtcctttttctatactggcccaaggggtttgaagttcctggaagtgcttgtgtgcccaaataaaactacagccttttccattacatataggtgtctttctagatacacaggtctactcccctctgctcccatagttggtgaatttaaagccaaactatggggaaatttaggattagggccctctatgtgggatccagaccctcctctctaaaaggagaagctggatgttggggatttctttcccagttttatggtacactgcctgggataggatctgtgcccgaatttatctcagctttttctattcattaaatgtagatgttttctcagttgctcagtaggctgaaagtctttcagttggtctctgacttcctctcagaggtaactgatctgtagacagatgtttattcggtgcatttgaatcaggagtttcctattccaccatgtttctgacattactctggcttggtgtcttttgtcagctttagaaaagtattggtcattgttttttcaaatattgattctatcctgctctttgtcttttcattttctgggaatttcattacatgtatattagacttttccctgtattagagtttttcacttttccctgtgttagagtttttctcatgttcttttgcataatttcaattcacttttagttctctgtgctttaggctaaatattttctggtgatatactttatttattaaaattcttagtttttgttctttacccatttcccttttatattgtaaatcagttagggatgtatttttatctactgtgtaaatatgtttctctccactccgttgtcagatacttaaacgtagtattccctcattgcacctagttcattcagtgtcttgaaagtaacaggaatgctgtaattttttaaactacttaaattaatgaatacaatttatatctatgcctcatattgtttgctgatggacgattatgtaatataccttgaaagtacattactgcattggttatacattttgacatatacaaaaatgcccaaactagtgttgaacatgttgtagttatatactaaacaggactataataaactattgatataattaggaaatagttgtctgaaattatctacgtgatttttactggttaacactctgcttcatgaaacccattttcaagatcgttatctaaaggtagttgttagcttgttctccggttggtattatttcagctgcaagtaactaacactcaattataggtaataataaagattttattatctcacataacaagtttgaacatgaaggattttcatagttggataattcattatctctataatgtcatcatgcactcaagttctttttctattctgttctactcaggctttttctctcatgagaaaaaaatgtaacattgcagacattcttgaagctcatattcatcataggtttatacagatttcttctcagggattcgtaaagaattatcccacttgtgataatcctgaaaccatcacttgtagggaggatagcgtaccttcagtgacttccttagacaaatgaaggtgtcctctctgagaatgaacaaaaatggttttctttaaggggaggaggaatgtcctctggctagacttggaaaaaagtaaaaccaagggtaattccctgaaaaacttctattttctgtaccagtgtcatgcttggaaaattgttgattaaccaagtaatgtcttaggaaagaaactaggtatctatattttaaaactatgcatttcctttatttattaaaatgttatttatttagttttcatcctgtgacaatataaataacatataacaatctttacaataaagtaaattcattttttcaaaattttgaatgtatgtggtagactaaactttgatttcaaatcgaattttcacattgtgatactacttttacataaggcatctagattatgaattacttgcaggaaaaaccatgtgtccttgtgcctccagagtttctttctagggtcccacttgtgtaaaggttttaatgaggtagatttagatctctaagccaacacttgaaaaagaatgaatattttcaagaattactattataagttcagtactgctcagttcatgaaaaatttgagttcacacctaggattttaaaagttggccattaattaatgattattcatttacaatggtcacccaggtctctaaacattattttgaagattgttgtgtttctttatttgcacttaaacaaaaataccatctgatagttacatgcaacatgtaaaccttggtggtaaattttattcactaaaaaaacaattattccattatgttctaaacttaggtagagtgtaccggatactgatttcaagtagaaactcactttaccagttttggcaacattttcttccataaggcccttagtgatatcccgctttcctttttattttaaacattgtactgtctcctttttcgattaagaagtaatcagaggtgatgctccttacgatccctgtatctgcaatatagaatctctgtgtgtcaataatggccaaatattggcactatcatgtgtttcaacctaatatttatagttcctgtggtgcagagaaacaggacccagttccatttggagacttgttgaatgcgggttagcatcataactaactcctaccaaaagacgaataaaatgaacagaaacaactctagaatttaaacgctatagactttccacttctcttgatataaagttccactacttattactggaggtagtttttgtggtattggcaaggaactggaaatggtttgtgatatgaacaacaaaaaattgtgtgagctggacttgagttttggggcactgatgtatgccatgatcctctcaggcattgtgctggcaggtattatgatgactgcaaggtacattaactaacatgatgccagtcagcctgaactctttctttaatatatcgccttggcaatcctaagatgattaaaatttctgcagccagtaacagtgacagtggtgatggaggatcagggatggtatctagtattgttaactcaaagaccaatgacgggttgtgaagaagatgctatccaccctgctctgaatgcatttccagtggttcttattttggggggaaaaaaaggttaaaattgagtagaaataggaagataaatttgaactagagaaatatcttcagagaaattatgctcattccattaaaactttattccaggagacaaaatgtttaaacttttttttttttttttttttttgctaaagatgacttttatgaccaaatacatttggaaaacaccgagttaataaaaactaaacaggtttattctaaactgtttggtctttaatatggtagttgatatgcagtttcagtctcattaaatactgcatgcaccattttgcacagttgaatgtttgcattattagaaagttaatttattttcaacagatcatgagattattgaaaattaaataaagtgtgaaacaatatttgatatattttactttttaatttgtgcttctatactagaattaattttgttgatattaaattatgtctccaataaacagtgtctactgaaatagaggcccccttccattgctctgtgcatttatcttttctgtctattttatcttttctttttattggttattctcttccatagtaacatttgcagcatgtttgatttggaagtgcagcattctgaagttaggtaatatattttaccataacaattttaatggtttcaagttacaagagatttaaaagataataagcaattttacctctcctaataaacttttgcccctttcttattaagaaacaaatttcaaagactaattaatgtgatcttccttttgaaaaatctgaaggttgtttttcaagatttttcaactacatagcaaacctacacaggcgttctatctctgatatattatcacatagctttccaaagtgaaagaaaattaggctttgccaccactggaatccacactcacgtaaataatttctttatggcatgatatgtgtgaagtattatgtagttatcatttctgttacaaaggagattgtaaataatgaattatttctttttaaaatttaatttttttaactgacagtctttcttttatgcttttttacaacttaaacaaaaatagcatctgatagttacatggagagcttcctatagacatgctgtcagttggaaagcatttatattcaaaaacaagtttttatagcatatgttacaaggagtgtgattggcacctaggtcccttggcaactcagaataagaaatgaattgatttataaacataaatgaagatggtgcactttattaacatctctctattcatttcatgtttatgtaggggccaaaaattaaaaactttaactaaatctatgttctcttgtagaagaaaaatgtgacatctcttgaactactagttctttgtaattctaaacaggaaaaattaccctcttataagaattcattttttttttgcatagggttgctcgtgtcttatgctgcctgcttgtttaaaactcacgtaaatgattacagcccactgaaggtagaagtcatacttctgatttcagtgtcaggattatgaaagtaaaatacgtaaaatacatgtctgtaaggagaggcagcatagcctattttagtggaaaagatttagactgtgagctgagagctcatgtctaatcttctgtttattattatgaataatgatactcatctttttcctatatgtcaggcagggattctggaagctgtatatatgtgaaagtatttgcatcctatggagcacacagactagtattattcttaccaatgttgctcattacagtaggaatttaaagatcccagagaacttttagattccattttctgggtttcccatatttcatatttttgttttctgtgttctaaaaggcagttgagtttatttagcgttaattctgcatcaccaagcccagtgctgtgcacacagtaggatttttaatgtttgtttatcaagtggtgaatgaatgctttgcagtacaactgaataattgagacaaatacagtaaatggagtttaagttgaatgattctttttaaatcattttatctgccatgtttaaataccattagtaaaatgttgacacatttggactcttatcgttattatctggcataacatcaggactacctaagagtttattttagcactgtcacattgctaaacaaagctcatcagttattactttaatttggcacaatttcctacctatttcagaaggataaagtatggtttatgctagttgtttgtctccaaccttcataacacttatttaaacattgcgttatatccaaattagcctaaaaagactccattcattcactgttctttggctggtgtgccccttactcactgattcattgactgtggttgattataaactgccagtgagatccatttctatggatttgtcatttgttacagtttaaatgcatcacaattccctctgctattggactttataatgtgtaatacggtgtttttaatgaccttccctgcaaaatacactcccttgatctcaggtcagcctagtttaaatctgttttgttggacattacccccaagaaaatttgtgtccctcgttattcttctctttccatgaaaccatatcctgcaatattttgaaagccagagtgcaaaataattgtgtctctataaaatattttcagaaagataaacagccacaatattttacattagcctcttcaccaaaatcaccttttacaaaaattttcttcattcctaataaatcgtgtaaagttccacaaagccacccttttagttagttgtgtactggcctgtttgtgaaccccttaagaaaaaggataaaaccacttttgcttcccaccatcatcacagttctttatacttaacaactttaaagagcagccaacaattttcatcaaatcaaattgccctaatacttccataaaagatttataaaaaattatttctgggactgctccacaaaggtctttaggaagactgttgcttaaagccaaaaaactacaagagcaggagcatagctgtcttgcagttttcagaccaagtaaaagagtaggcattagagcattgagactttcacctgaaactgcttgtttagtttgtgatgaagaactaaatactgtgaaattttgtccaaattcttctagatatcctcctatctctcttccaaaaaaatatctaaattaggatgactggatcattgtcattaaatcttgttcaagagcaaagctattaaatcttgtaaatttctggtcaaaaaaaataatgggaaagtgaactaacattgactttatgctgttattttgagattctgtgcagctagttgctttatataatttatctcatttcatcttgaccacaattaatattaggccttcatggctctcatttcaagaaaggttaagtaattcgtgcaaggttacacaactagcaagaggaacagccatacttcgaacccatttatgactgacaaaaaagcccatgctatttaattacccactctgttatttgtgctcttttaccttcaattaataactagacttggttgttaaatgaatcttaaccattttttatgggtgaactgacaagagttaatgtaaagaatattgaagccaaaaactaagttgtcaattatcatactggaaaataaatagtaatgcggtcatcatttaaaagtcagctggatgcacagaaaggatcaatctgtaaagaaactttcatagtttaatatgtctgatgtcaatataaatcctacttatttctccagctttgacttggataaccacatcttctgtggctggctgtgcagtaggcaaatggaagtacccttgattctgacttttctctggaagtgaatccagagagaaaataagcagcttttctattcttcctcatctttaggcaccctagaggaggttgctgatgttaataatcaactatatcacttttgaagacttagtttaatatatgttgatcgtttccttactgtttgccttattgggggaacccattcttctccagaaaaggacagatcctctcttggatttatatatatatatattatgcagaaacgtttcttctagaacttctatatataaaagaattataggccaggcacggtggctcatgcctgtaatcccaacactttgggaggccaaggcaggtggatcatttgaaatcaggagttcaagaccagcctggccaacatagtgaaaccctgtctctactaaaaatgcaaaaaaaaaaaaaaagcaattagccaggcatggtggtgcacacctgtagtcctagctactcaggaggctgaggcagaagaatcgcttgaacctgggaggtggaggttgcaataagcttgagatcgcactactgcactccagcctgggtgacacagcaagacttcatctcaaaaaaaaaaaaaaaaaagaattctagctatcaacaacaatcaccgagtgatagacagcacagttatttacagcactatggagatctagggtttagttttagttctaccaatacctttgctcacgaatacaggcgttttatacgaacatctctaaatctcacttttttaatctgtgaaatttaaggagaaaattaggtaatctgcaaaattctatcagctctacatttacagttttccagcacatttaaggcctaccttttgctttataatgaggtcagggaaagtctacaatgtgccaggaggtgaatgtgtaatgctgtctgatggaagtatattcctaagttttcctccacctattgccatccgaataattttgaaaggaattatataagtggcttactgctgaaatcacaagctttatctttttccatctgatttttcataatatgcattcttatttatttacttatttattcattcatttattcactcactcatttatttaattttagacatgaggtctcactatgttgcccaggctggagtgcagtggctggtcacagtaaaatcataccacagtacagcctcgaactcctgggttcaacaatcctcccatttaacctccctaccacagatgtactctattgtgcccagcttcttctatctgatttttgagaggtcctatagtattcgataattctgcttatcagggaggataatctagaaatgtaatcagaaggaaacttatgctggttatgaagtcatccagcttgagatagaacatttctcctatgtcacaggataatgtatgatttaccttgtttatattgctaagggattgaggggactatactatattaatctcaagctttggagtctgacttcactaaaggtatgtaatttgacatttaaaaaaaaattttaagccttagttgtctcaattataaaatagactataggtttaaagaggtttaagttaatcctctttaaatagatatatttgtatatgatgtagaatatatattattaaatatacatataatttaatatggtatctatcacatacttaaacattagcttttatcgcattaatattattattatttttattgatagtggcattggtaatggtaaaaagtaacactgttggctgggcatggttggttcacacctataatccgatcattttggaagtccaaggcaggtgaatgatttgagcccaggagtttgagaccagcctaggcaacatgatgaaaacccatctctacaaaaaatacaaaaattagctgggcatggtggcatatacctgtagtcccagctacttgggagtctaaggagggaggatcacttgaacccaggaggcagaagttgcagtgagccaagatggcaccactatactccagcctgggtgacagatcaagaccctatctcaaaaaaaaaaaaaaaaaaagaaagaaaggaaaaaaaaaagtaccactgttctcagggatgcaaggatgtttcaacatatgcaaatcaataaatgtggtatgttgtatcaacaaaaatggccaaaaatcatataatcacttccacagatgccaaaaaagcatttaataaaattcattatattttcataataaaaaatatctcaacaaactaggtatagaaggaatataccttaacgtgacaaaggtcatgtatgacaaacccacagctggtatcatactgaacgggaaaaaaacaaaagtcttttctttaagatctggaacaaaaaaggatgcccacttttatgacttttactcacaatgtttattcctggcaagggagtcctaggcagagcaattaggcaagggaaagaaattaagggcattaaatttggaaaggaagaagttaaattagccttgtttgcatgagatatgattttatatttagaaaaacttgtagattccaccaaaaaactattagaactgataaattcaggaaagttgcaagatatataatcaatatgcaaaaatcagtaatatatttatatgttaacagtgaaagatctaaaaaagaaaccatgaaaagaattacatttaaggtagctacaaatgaaataaaatgctaggaatagacctaaccaaagaagtgaaagatctctacaatgagaattataaaacattgatgaaagaaattaaagggtccacaaaaaaatggaaagataatccatgttcatggcttgcgagaatcaatattgttaaaatggccatagacccaaagcaatctacagattcaatgcaatccctatcaaaataccaatgacatattcacagaaatagaaaaaataatcctaaaatgtatgtagaaccacaaaagactatcatagccaaaggaatcctgagcaaaaagaacaaaattgaaggcaacacataaccttacttcaaattatactacaaaattgtagtaaccaaaagagcatggtactgtctcataaaaacagacacataagccactggaacagaatagagaaccctcagaaataaatccatgcatttacagtgaactcatgtttgaaaaggtcaccaagaacatacatggggaaaagaacagtctctttggtgctgggaaaattggatatctatatgcagaaaaatgaaactagaaccctatatctcaccatatacaaaaatcaaatcaaaatggattaaagacttaaatgtgagatctcaaactatgaaactagtagaagaaaacattgaaggggtgattcaggacatttgtctgggcaaagattatttgcataagacctcaaaagcacaggcaaccacagtaaaaatggacaaatgggatcacatcaaactaaaaagcttctgcacagcaaaggaaaaaaaatcaacaaagtgaagagaacaacccacaaaatgagatcaaatatttacaaatcacccagcaagggacaaataaccagaatatataaggagctcaaacaactcaataggtgaaaaaaaaaaaaatccattttaaaaacaggtaaaagatctgaatagcaatttctcaaaataagacatacaaatggccaaaggtatatggaatgatgcttatcatcactaatcattagagaaatgcaaatcaaaactgcaatgagatatcatctcaccccagttaaaatgccttttttcaaaaaggcaataactgatgctggtgaggatgtgaagaaaggagaacccttgtgtaatcttggtgggaatgtaaattagtacagcctctatgagagaacaatacagatgttcctcaaaaaactaaaatagaactaccttggaatccagcaagcccactgctgggtatatacctaaaagaaaataaatcagtatatcaaagtgatacctttattctcatgcttattgcaacactgttcacaatagccaacacatatatccaacctaagtgtccatcaatgaatgaatggataaagaaaatgtggtacatgtacacaataggatattatgcagccataaacaagaatgaaatcctgtcatttgcaacagcatgaatggaactagaggatgttatattaagtgaaataagccaggcacagaaagacaaatactgcatgttctcattcatatgtgggagctaaaaaaaatgcaaatcaaagagcttatagaaatagagagtagaatgatggctaccagaggctggtaattataatgtagagggggtgataaagaggggaatagggtagggttaaggggttcaaaaatacaattaaataggagaaataaaatctaatgttcagtagtacaacagataaactgtagttaggaatgtactgtatatttcaaaataaaagggtggaattggaatgtttctcacacaaagaagtgataaatgtttgaaatcatggatatccttattaccctgatttgatcattatacattgtgtgctcttttttttacaataaatatcacatgtaccccataaatatgtacaactcttatgtatccataataaaataatttttaaactacctatattactattttatctaaattttcaaaaaaatttaaataaaatatggtgatagtattcattccagtaattaaatatgtttaaaatattcttggaattaatcttagtagaaattggtaatagtattatgaagataacataaattagcccagtactgcctcaaacttctgggttcagtgatcctccaacctaaacctccctgctacaaatgcactctatcatgcccagcttcttctatctgatttttgagaggccttatggtattcaataattctgcccatcaggaaggataatctagaaatgtaatcaaagggaaacttatgatggtttcgaagtcctctggtctgagctagaacatttctcctatgtcacaagataatgtatgtatgatttaccttattacctactagtggcagtcctcagaaaatgagatcttgcctccttaatgaatgcttttgattttgggaaaagatctgtcaggcttcagagaaatgttgttgggagaaacaataagccttcacacccctgggtgtttccaaaatttggatgacgctgctgtattctaattattttaatgtttatctcggtcagtagatgttattaaatgcacacaaagctctatcctgagcgaattctctagcttgcagcctaattttaaataagacaaaaataaatattaaagaataagataaaaatatatagtaataaacactaataattactaagacacacaaagtaataatttgtatatgtaagtaaatggagaactgtatttatatgagatttttctgatgatgatgtttggtctgtctctgaatcgttttatttttcataaaagaagtaaggttgggtccttttagctaaatggccttcgggtttatcagtaacaaaaaaaaattaaataattgtcaccaaaaatataaaagtttttaagaagagattttttgaagtgtgaagaactaggctaaataatgtcaacttttcctttaagaaatagttagctgctagaagaccacaaatgagtgataagtttcaggcagctctgaagtaggctggtatctctttagaaaagatgtttaattcctgttcacactagactgtgcaattaataattaaatgtctaatgattctgttctcacagaattttaaattttgctggggagaatagatgtaattgcagtgtagaagaaaatagtgtactagaaagtatcaaattaatgtttttactctaacatttgttaaatgcctgttaggtgttgggcctgatgtctggctccaggaatgccacattgaataagatattgtctctgccttttagtagttcactctctagttaaggaaaagaaaaaatctaaacaattagttggagtgcaaagtagcaagtgttaacatggtactttgtcatagatggtactcaatatatgttaaatgtataagtgattaatgaatgaatgtttaactgcttcatagaaagtgcagtgaagaaaaagaggaagaaatgactctccgtctgtgatttacagagaagattatgctacaactatatattaaggagtgagcaagagagctacagtgagcaggtcaagagggcagcacaggacattccaggtagagagaataacatatgcaaaggcatgaagatatttttctggctgggcgcagtggctcacgcctgtaatcccagcactttgggaggccgaggcgggtggatcacgagatcaggagatcgagaccatcctggctaacacggtgaaaccccgtctctactaaaaatacaaaaaattagccgggcatggtggcgggcacctgtagtcccagctactcgggaggctgagccaggggaatggtgtgaacccaggaggcggagcttgcagtgagccgagattgggccactgtactccaacctgggtgacagagcaagactctgtctcaaaaaaaaaaaaaatatttttccttttgttttaaagtaaaagaatagtgttgggtgtggtgacgcatacctataatcccagcactttgggaggctgaggaaggaggattgattgaggccaggagttcaagaccagcctggacaacatagtgagaccctggctctacagaggaaaaaaaaacaaaaacaaaaacactttacctgaatgtggtagcatgcacctgtagtaccagctactcaggaggctaaggcaggaggatcacttgagcccaggagttcaaggctgcagtgagccatgatcttgccactccacttcgggctgtgtgacagagtgagaccccgactcaataaataaatgaatgaatgaatgtaaaaatataggacatattcaaggaagggggagaggctgtgtgactgactcagagtttatgtggcagagtggtgagaaatgagctggatagaaagcctcagagtattaaattgacattttagaaagataactctgactggagtgtggaggatgtctagagaaagaagacacaaggggtattggatcaaaacaagagagaagcgatgacctgaactaaaacagtatcctcagaaatagagagaggggagagctgagaactatgtggagatagaattgacagaacttaattatttgctaattattacaattggaggcattctgacttttaggtttctagcttaaactaataggtagatagtaaagatagtaatcaaaactaatgatgtaaaatgcttacatattgaactcttactttggggccacacaaaaaaatgtccaggaaacacttggaactctgtatccagagttacaaaacacacaaaggtaggttctgtattcttgtgtgtacaagatagctgaaatggtgaaagtgagtgagatcaccaggaaaaaccagtaccacggtatattgggagttctaaaacttacccactaagaccagtgtgaggaagaagaaagattgtatttgaggggtttctaaggtaacccaagtattttcacaagtatgtaaaaaccagtgattatatttaattgacatcttgcgaatgtcccactgcactttgtaaaagtgattcattcactgacttaaaaattcagggccaggcgcggtggctcatgcctgaaatcccagcactttgtgaggccgagacgggcggatcagttgaggtcaggagtttgagaccagcctggcgaacatggcaaaactctgtttctactaaaaatacaaaaattggcaaggcgtggtggcacacacctgtaatgccagctacttgaagtaggaggctgaggcatgagaattgcttgaacctccaggtggtggaggttgcagtgagcccagatcatgccaatgcactccagccagggcaacaaagtaagactctgtcaaaaaaaaaaaaaaaaaattcagtaatatgaagtaaataaaataagaaaataaagattttagttgtaagatttttaagttaatgcatttattaactaattgcagccatattaatgatttatattgaaattcaagaagcacgacataattttacacaaatctatctttttgtgtaatgaatataatatacaagtgaattaattctgttaaataaaatagtacttccctactctcagttcactgatcttttttttcttctcatttgaggaaaaaagtccacctttcaaaagtgtcatatactctagataagaaggttcaaaactttttactgagacccacagtaagaatatatttcatctttcaaccaagtacagttgatccttgtacaatgcagagtttagaggtgctcacttcccatacaatcagaataccacatagaatttttgacttgtccaaatctttactaatagcctactgttgaccacagcctcaccgataacataaacagtcatttaacacatattttatgttttatgtactatatactattatatattcttacaataaagtaagctagagaaaaggaaatgttattaagaaaatcataaggaagagaaaatatatttactattcattaagtggaagtggattctcaaaaaggtctttaccctggcattcccattgagttggctgaggaagagtgggaggaggaggaagaggaggaggaggaggaggaggaggaggcggaagggttggtcttgctgtctcagggtggcagagtcggaagaagtggaagagaaggaaggggaagcaggagaggcaggcaaattcagtgtaacttttatttaaaaaaaaaaaaattcacgtataaatggatcctcacagttcaaatccatgttgcccaagggtcactcgtatacacattgtgtgtgtgtgtgtgtgtgtgtgtgtgtgtgtgtaagctgacacaaaccttgcatgaaactacttacccttgtttgttcctgtactcaacacttttaatctccttaatttctttctgtgttttgcttcatggatatttattctgtttctcacttttgctaaatgtatgagattgtaaatatgaagttctgagattataagcatgcacaactctcctttattttaaaacaaataaacaagaaatatttatctcttgctctacttacttcattttccttttattttattattatttttttgccacagggtctcactttgttgcccaggctggaaagtcgtggtgtgatcatagttcactgcagccttgaactcctgggctcaagtgatcctcctgcctcagcctcccaagtagctgtttggtctacaggtgtgcgccactatgcccagtttcttcttattttaaaaattattattgaatgtaaccttcatttaactccaaatttctaatgtatatataatcaacacttgctactttaacctcccatcaccgaggccctttttcctgcacttacttccttagcaatcccatccaaaatcaatttcctttgtaatagctagcacttgtataacaactaatgtgccaagctaactgctttacaattgttgatatagtttactcacaacaaaaatatgaggtaggttccatttttatccacagtgagattaagtagtttgctcaagattacacagatggtaagcagggcaactaggattcaaaaccaggtatcatatataaccaaatcttaaactaatttctataacaccacattgctatttagattttcaattatgatatctttcatcttgtttttttctctctctcgacatatcatttatgttcaaaattaaacttttctataaagactggaataatagtctagaagtagcggtagttggtaaatgttctgactacatgcttgtattacttcaagggatgaggataatgttttaatggaagtgatgacatcaagttagtttcataatgataaagaaggtgagtgaacacttcaggaaagatgaaaatatattcaggagtgtatgagtttgctagggctgccataacaaaatactacaaattggggacttaccaacagaaatttattttctcacatttctggagactggaagtggaagatgaagatgttggcagatttggtttctcctgagacctctctccttgactggcacatggctaccttcttctctgtacatacacttccctggtgtttcttgctcttataataaagacatcagactcactgggctagggcccacctccttgacctcgcttaacattatctacctattttaaggacttttttccaaagacagtcatattcttaggtgtgctggagatttaggacttaagaatcttgggggaacacaattcagtcttttaaaagaaatttcttaccaacagaagaggcactctacagcatgcggttaccttggaaaggattgtggatcagtttagtgagaatgagagctaggaaaaagataccagaagggaggctattgatcctgaaaccagtgtcagctggataaaggaagcaagagattggaaaattggaagcacattttaatgttgtggagaagggaaggacaaaacaggaaggtgtgtgttaggtttgttgacctacccggcattcctaattacaagcagaaagttgatgttcagggttctgcaaaacttagaatccctgctgcatgcctgtccctgagaaagtttaaattaatagagaatggaggaagtaatattggagatgtggcagatgaaggcaggctcttagagcatatctttcaaatataatgtgcaaagttaaaaatggttttggaattgaagtggtgtaactaatttaaaagatatttttatattatttcaaggattgtactgttatgtaatggtatatatagtagaaaaggaaatataactctcctcattatgtacttgaagtattaatgatttcttctttatgggtcacattttcctgttctttcacgtcagtaattttttattatatgccagacgttctgatttctatgttgtaggattttgttgtctttctttaaagatcattgagttttgttctgggagacaaataatttactggaaagtcagcttgctgttttcttcttttttgtaagctcaattagggtgggtctagaccttttaggggtgtcacttgagtgcttagcattttcagtgaagttctacatctcttactatatgtgacatctggatttctgttcaaatcacagctaatggctcttgagttagctgttttctgccaggtcttcagccttgctttgtgcatgtgcagcttaatatgcatccaatgacttatgataactccttttggggctcgttttttgtgtagttaatgctttcccacagctttgccttataaattccagctatttcaacagcaccaaactctactttgtgcctctttagttgaatgaggtcattgtggtctgcctgggctccacctacatccctgtgctgaggtctggaaagtacagcaggtagaaagagagagtggtcctagggctcacctcttgtatttctcttctttcaggaagcacaggcctgcacaaactgttgtccaatgtggaaaaccagtaatttcttcttgagaaattgaaaacatcttaaacataagtttggcatagaattaaattcaacttcttagaaattggtttttgctgaaatcagttttatatatttcatactaataatactgctgttttgaagtaaaatatgcatatatattacaacatataaaagataaatcacaccagcttggaacaataatgtaaaccactttgtaaaaaccccatcctgagaaggagcagcatgttaaaatcacttgtgttgagaaaagtgttctgagaatggttctattaaggaaagtttgttttcttagcttttgatgtcctcgggtaacaaaatcaacatttttctgtatttaatgaaaataagttgtaaaaaagcaacaggtgttttggttaaaaaaaaaaaactattcagcgcttaaatcattagagtaccctgttttctttattacaattaccgaaacaagagattttgaaattaatctgttgctgtgtagacttggagaaaggagtctaggaagtgagttatatgaccttattgacctttggacctatcatgtttaacataattacccacaattagtagatttttaaataatttattgtctgaaaatataaacaaaagagaaatatgtagctactagaaacctaggaatataattgttattgtcatataaatgcatgataaatataaaataaaggaaaaattagagaaagattactttttgaataattgcataagattttttggctgaaaattaatagatgttaaaatgtgccagtttatttagatttccaataaaaatgttcatttgatatccgtatttaaaagttattatttacctaaaaagcaactatgtatagtgtaaataattgtttggaagacatttgaaaatatcttatttgatcagggaagataatacagattaactttagaaaagtttcagtaaaaatctatttctcgatctgttctctttcccccacttttctcactccccccctccatctgtacttttaatacctctctcttaatctcctctacttccctctgcaacaatcacattacctacaagaaatagattattgtctattgagtactcattcttgaaagtaactgtttctttcatccttgtttttctatagattaaaatctctcaaattatttatcgaagtttcttgcaagttaatttttttctatcattgtcctttttcctattaagtttggcataatatttctcacttttacttacagcatttatattttttattttccaactgatataccagtatggatatagatttctatatctatctatgtatctattcatctgtctgaacagtaacaaaaatacactttttctttcttcttttctacttttccagctgtgttatgttaacctcccttgtgtaactgtattccttggctaagatatctggtaaccattatttacaaataatatactcctttgtacaagactagaatattctccacagggacattttaaatgccgactccagttaaatgtgttaggctttgaattcagtgttggccttataatgaaaattacagactttttttaagaagttatgtttatagattaacaaatctggcaacattttagtctgttactttgtccacatttaattagaaaaagtttgtgtcttttatattctacttatataatcttcagtattttctttggtgctatttttattaaacaataatttttggggcatctaatacgtaccaagcaacatgatgaatcatttttctaaatgtcagtttattatggaagaattataaatttaaaaatgtgagcatacatgaaacatttacctcattggaaagatgtttcttatttaggtagtcttttctcatttttttccattttatacaaagtggtaatactacaaaattatcaatcctttaaagtaacagtttgtgcattttaacttataagataaatgcattttgcacaaaagcacattttatgaatttcagagatagtaagatagataactttatgaggcgtactatgatctgatgtccccacttccagtttcaagagtaaaatatcttatgaggttgaaatgtggacttcctagctgtttatgaatcatagtggagtgacatacatacattaacctttttaaactgtatttgccttctttgattgtgtttgctaggtaaatacagattttagaaagggaagagaaaatattttaaaatagttctgctgattgcctgcaattctgcttaaccaatttagttccacaaacagtggatttaatcaaacctgatagaagttaataccagttggaaaaaacttatgaacaagtatgcataattctaaggatttggggctattgacaaggaaatcataaacactatttaggtagccaaccaagtaagatgatgatgccttcatccatatcttacagcaggggtcctcaatcccctagcagcagaccagttctggttcgtggcctgttaggaactgggccgcacagcagtcagtgaggagtcagccagcatgaattaccacctgagctccacctcctgtcagatcagtggcaaaatcatccccccaacctcacccggtccatggaaaaattgtctttcatgaaaccctgttcctggtgccaaaaaggttggggactgttgtcttagaggaaggaaaacaatgaaaaattaattgggaactatcaagaaatctgaccaaggaagcatcagaggaactgatatgtcatccacagaagatcaagatgatgccatcgtactagcaagttgaagctttctgtattcatgatatgttttagataattgaaaaccttgagtgattttctctctgaatacagttttttaatgaaactgtatactgtggtatttattaaatatttatgcatgtagaccatactgagttatatgcatagcactaggtattactctacataatggtaatttcagaaactttcaaaggtagttttgattaattatgattgctttgtgtactgactttacaataatattcaactccagtaagagaactcaaaacatttttcatttttcttgattaattattcttcctagtcagtgacctttaccacttctttatactgcagtaataacagtagagaaaggtgctaagctgtgtgggcacagaggagactttggaatagcgaagccctcctgacagaagtgatatcttcattgagacaagggttggtgagagttactactctcaccaactcaactctcagttgagcaactcaagagttgagcagaatactctttctggcataagattgatcatatgtgcaaacccaggagtagagtgagagaatggtacatctaacaaaattcagtataattgtagaagtaagctgaccaggaaaagaatgacattttaaaaaatactttagggagttttatttttgtcttgaaggcaatagaaaaggatctgacttgatcagacttgcatttttagaaaaattctcctagatgttttaatgagaattaattttatctgcttggccatgtataaactatagcagtaatctaagtaagaaactgtggaagtattggagatgcggataattattagacagatctaagaactgtttatgtggtactgattagattttcaagatgaagttttgaaaggcatcaagactgattccatctttggggcgtgacaagttttgtggacggtaacattaagaaagctttgacctgaacacattactgagacagcatgctcataataaggagttcacacattgctaataatcattgctaactgtaatttgaagatagctaaacagtcttcataaatacaagatttcattaaaaaatacatttataataaaccatgataaattgaccagttactattcttgtcaaattgatgctcaaagtaactttagcttttaattgtctgattttgagtataaataaccaaaggatatacaaattagtcatttaaaaaataaaaaccttacgagatttttgttgaaaattttgaaaaatcataagtaacatgaagtggtacaacataaagaaaacatgtggatgtttggaaatgaaaattcttaagtaaaactttctaatttgggcaatactttttgacccaatactaacttaaaagtgcttcaaaatggtctgaaagtgcattagtctatcttaccaaatctggataatataatcatttttaaaaagcataataaggtaagttacagaatcagggatttttttataccagaagtaaccatgtagtctaatttttccccacctaattttatggatttaaaaataaacctttacagaattgttatgtgacctgcccatagttatcgagacaatgactaacagactcaagtttggaattcttctaaagtattttattaattcagtataaacattttcttagttatttgaccatttggtatagattttttcttattccttctaaatgaaagtgttgcctaatcccattcggttttaaagctagttaggacatgtctagtgttgcaaatccggaaatctcttttttgaaaatcatttcacagttttcaaggaatgcctccgaaatttagccttctagtttccttttcatagaacaactacaaactggccaaattatatcacagaggcaccaaccttgttgtaaaggagtttaaagaagtgcaaatagaatgttttttcctaatgtatcaaaattattccagagttttctgagattaagcatgcattggcaaaatgaagtggaaaggtttatcattgtcaaattctgttaagttcttcttcctacccctgttagtgatcagagagagagagtttgtggtatatattactgttccttatccaccaaattcaccagataatcatgccaataatttagtctgccaattttatcagattttgattttgacttactagtcaagctagtgatcttgtcctagttctaaccaggtaatgtagagtcactgcaggtaatatgctggtaatatattattttcaaaaaataacctgaaagattccctctaccatttcttttacaaaggttttatattttatttattttgtctaatttttaaatttatcctagttcaatgaaagcctctctaagctttgtaaaaagtctagatttgattaacagttgagtaaaataaaaagcaatgaaaatttcaaaaatccttagacatctctgtgaagaaatcactagcaaatgtcttaggttgacagaagtgaacctatgaaaacaatgaagctttgtgttggctccaaacatttcatgacataggtagctgttgaaagctgagaaattgtagttttgttttctgagaacttattaaccatttaaagtgctctcagaggtttgttatttttaactgcaaaatgatataaattgaaggcttaatgttgttctttcacaaattgcttttccccactaatgtttttcttttcttaatgttaactggaactggcaccagcaggcataaataatcaataatatggtatttcacacagatgcaaaataacttgtaagttatttattattaggttccattagtatttaagaatttatagcaatcattgaatatttattgagaaattacttagtgttacacaccattctagtctgtcttgatctatcagtggataagacaaactaagtccctgccttcatggagcttataaatattagataaattattgcaagtttgatgaaatctaaggatgcttgagggctacccaaaagttctacccaaaaaggtggttgtatagtttcaattcagatttgctgtttgagttcgttctgaaacatcctgaaaacctaattttaaagccaaggcttttcttaaatcagtttgctcagcgtgagctagccctttaattttctcttttggaaaatgtacttcagggccacctgattgtaaggattatgctttcaaaaaaagcatctatataagaagaaaagcaatgtaagaaataaaattataatagatatttgacaatggaaaagaaaaatcgaagcttcacagattaatttgggaaatgtagtaaacagctggaaatctatgcctacctttggactattaaattagttcctttttaattgcttgtgtggcttatggcttccttacaaatagttgtgtctttctgtcctacttaattataaactttttgaatgcatgcttgtagtgtcttctggatagtgccagagttccagagttttcaaggaatgcctctgaaatttaccttaatatttgcctctgcatagaatagttcataaaacactcaataaatattggttgaatgagtggaggaataaatgaattcttaaggtctgaagaactgaattcctttggtagtaaagttttaagaaacaattttaacaaattaaacattgaggccaggtgcagtggctcactccagcactttgggaggctgaggcgggtggatcacgacgtcagcagatcaagaccatcctggctaacatggtgaaaccccgtctctactaaaaatacaaaaattagctgggtgtggtggcgagtgcctgtaatcccaactactcaggaggctgaggcaggagaatggcttgaacccgggaggtggaggttgcagtgagctgagatcgtgccactgcactccagcctgggcgacagaacgagactccgtctcaaaaaaaaaaaaaaaaaaaaaaaattaaacattgaaatgttttgtaggcgtagaacaataaatatctaatataatcaacttactcttttttatgctgcagatacttctggggtctgtggtttatccttaatagcccactctgcctctgacattgagagtattagatttccaaagatgacctcctgagttaccccagtgtcagcaggtatttgtcattaagtctgacttatagctgtactggctaagagaggaggctgacgtttgggaaagttatgtaaacagatgcagacacatacattcttaagtgtttggtgctatgttaataatcagtttatttggtgattggtaattaatagattacaccattgacctgtcttgtaagatggtcatcagttattcaggttaggttgtgaaaactgagtagcaactgatttacagaattgaaaatgggcatttgataaatggcatggaaaaataatgtttgcttgtttggtcagattagaaatttactacctcaagataggtaactttgagatactgcctattgaagtatggtgtgctagaccttatctcagcctcttttcttgattatctttatacttgtcagtaagacatactacagaggcacaaggtagcctgaggcattggttggttgttttctcttgggaaagaaggaatatgtgttttgaagtttcagactcatttagggttgtattttaaggtttgcgttttgtgcttttttctcttaatattttatatcttttgaaatgaaacaaggacttatttattctaaatattttataaacacttgtgaaatgaataaataaataaaacagccaaaagcagtcatagtagactgagtactctgtgttcataatagatggtggttctgtgacaattggaatattttgaataggaaaactagtatttatcttactttttttttttgtctgtgagaagatatagaagatagcctaaatgaatattaatttggtctttcgttgacaacatactgttttaaaaataataccttaatgatgatattggatatttctgatacttttttatttaaaaatatttgtaaatatgtacattgatttataatcaatttacattattatttactctattttgtcatctcagaaattgtggtttatatacattttctcagctgagaaacttagagattctgtaatatacccaaggtaaatgcagaactggagatccaaacccaggcattctcactccactttaccctacatctcatctggaggtttataagtaagtttttgattaaaaaataagatacacatttgaaaataagagatccagtctttatatttatcttgtataaaattaccgagtaatatgttagggtttagcacaaggcatgggttccagctatagggtattcataatttaattggagaaacaagagataaacataaaaagaaagtaacaatataagattgtatgtataagatgagtgattcaaactgtaagtcctacagagacaggaaagatttctgtggattgggactactaaactaggatgactgaaatgagttgagctgtgctagaaggaggcacatagatgagccagtaaaggagtagagggcattcaaaacaggggaagtacagaacaaaagtaaaggtattgttgccctgcagcccttggtatagcttacatatatggtagaagatttgtgggagatgtggttacaaaggcaggtgaaggtcacattgtagaaggatttgaacgcagggctaagatcttaggactttattttgtaggcaatgggaaaccactcatggttggttggttggttggtttgtctgtacatggcatttgcaaacagtacacatttttttttttcatggtcaagacacctgaagattagagcttccttccttctataagctacattgccacaactgtgaataacatgcttcactacattggggtgtatgtttgtgtgtgtgtgtgtgtgtatatgtatttgagggggctagagatgagcatatctgtatggcggggcaaggggaagagaggtggcaatcttcattcaagtattatagactctttctgtgtgccaagctatatatcatatgaaaagaaaaacatctataaatacaagataataatgaaggccttataaaaacaaattataaacctgaaaaatgatttataaaaataatgagatttaaagatttcttggtcagaggctgaagtttaccaggtaatttaacttaggagattcagccaaattcctggcagcttagccaacagtgtcatttcattcccacattgagagtacccagggaagctaactccctgcctttctcatgtctgaactactgttgccaagatcctgcagttcttctgtcagatgagaagaagtgtggctttttgtggagccacctttcacaataacagggcttgtgaaaagattccccattttcaagatgcagtgaacctaacaagaacttgaaattcatcccacggccataccaatcagtattccagctgtagtaagttaattggcaatcgttttttgtttttttttttttcttttgtcttctatttaaaaaaaaaaatcctggaaatggtaaaagacatgttgtcgtgacaaaaaaaaatgattgcaatattaaacactgagaattctggaggtggaatcttaagaaaaaaacctccccagtcaatatcgaatccatacttttctgcctgcatttgaaaacttgcaagctgatttaacatatcgctctgccttcttactccttccatttcttttctgctgcccatatttatcctgtctcatttcctgcacctttcatgcatgccattacaacaaggccaccctcctcctcattaccctttgaacatttgccatttttttccgactctattcaagttctctctcatatctaaaatgaatacatataacctaatacacttaatacgaattgatttttttaacaatgagatgccagacttgaaagtgaaaacttgaattattgcactcaaatatatatataaggtaatgaatattatagacatttttgaactcctatctgtgacctcctattgatatagttgggatcccttctgttgtgtgtgaaatagcattgctcatttggagaccgacagtcattgttcaagggagctaatttcagagcagaattgtagtatttagcatcaagaccaaagacaatgaaaagaccaaacattatcacaattggaggaaagaggcaggatgggttgaaatttgaaaaatgtagaccaggcgcggtggctcacgcctgtaatcccagcgctttgggaggccgaggtgggtagatcacctgagctcagtagttcaagaccagtctggccaacatggtgaaaccgtgtctctactaaaaatacaaaaattagccgggcatggtggcaggcttctgtaatcccagctactcaggagcccgaggcaggagagttgtttgaacccaggaggcagaggttgcagtgagccgagatcacgccattgcgctccagcctgggcaacaagagcaaaattccgtctcaaaaaagaaaaaaaaaaagaaaagaaatttgaaaaatgttcgagatgagcaatttaatacttaggtaccaagtattggagtagtacctttttatcctggtttcagggtggagagagaaggatagaatggattgtttttgccttttattgaaggctagatagataatgaaacttcattttaaagaaatatttgaagtaagagaatctattacaatatggtttgctattacatttatgtgaaaaactgaggggaacactgtttcccatggtgcaaacacaaaccaaaaaagatgtattccatttaaactgtaactaagcttatacagctagccctttttcttcatgccaattttatagaaaggttaaactgtaattatcaagaggaatgaatcataatgtggtgaactggccagaagtacttggtcacacacaacttcagtttatttgtggtataataatgatagtcaccaagaagtttgaagtatgagaacattagacacttctcctacaattttgtttcagggcaattaataaaattctcaaattaaattttgccacacatacgattattaactaaatatttacttgtaagtaagcacaaaataattcatgaacctgtcctataggtttgaaaaaaaattgcaagctctcggtccttttaggtgtcccagtcactacctcatagaaaatgttcatttttgacaaatgtaaagattcctgagcaggaatgatgattcttcctgacttcaaacaaccacagttgttcagggttcatagctggacacagaaccatttaaaaatttagcaggttatctctaggtgtaaataggcctcatgggatttttacaccttgtccataaaatgatgggcagtatttctaaaatattttagccagtctgtataacactagtacttttaatttactcatgaaaacccatatgtaatattcatcaagttagtttacatgctttgtttttatcaataggcatgcattttgtcattcagtatactgattagtaagtcatcagttattgattgaaatatgaataacaaaagtacctggagtggcctccttaggagtacagatttctgatcccatcagcctgcttctggccggtgcattcctgattagatgctagaaacatcttggttatagtccaccctcactaacatacctttagtaacattgtattttaaagtaagttgcagacattataatacatgaggtaatcacttcccaaatacagtatcctttttggttgccaatttgtaagacatcatttggaattctgaaatgaatggcagaaattttcactaattttatttttaaaaattttgccttgtattttaatttaaacttaatattcttttttcctagatatccgctgtgacattaaatataatctttctccagtttacaaatctataactgaaatgtcctctacctctaacagttttgctagttttgttcatagacaagcatatacttgtactttcattagtcatctcttagcttaacagcattgggaaatctttcagcttgaatgtgtttaaaaaaaaaaaaaaacttcctttttaatttacccttatctattccccatacatttttagaggctaataaaaaaagtcctaaaatttaaacagctttggaaagtaaactatgctttgatgggctttcacttagtatttgatcaaagaataatttaccaactaggaaaaaatattttttaattgtcataatgacaaaatataagaataaaggctttgtgatttgggaaagtcacttaacctctctgaagccttgttttccttataaataaaatgaagatagtaataataagtactttatgaagtaattttaaggattaacaaggtaatacatggaaaacccatagcaaagtgcccaaaacataagatctggaaattgatagttattaagaaaaaaaaatcaagagaggaatttcagtagagtgttcaacagtgtccaagttgtctcgtagagatcaagtaaagcatgaactacacagagtgagaactcaacatgcaagcttttctgccagaatgtaatatatgtgtacctgaaaaaccactcattctgcaaaattacacagtaaaaataacaggcttaagggagaaaaaattaagctttgggcaatatattcaaaatcgactcagtttctcccattctgtagcaatttacccatctgacaaagggctgatatccagaatctacacagaacttaaacaaaatttacaagaaaaaaaaaaacccattaaaaagtggccgaaggatatgaacagacacttctcaaaagaagacatttatgcggtcaacagacatatgaaaaaaagcttatcatcactggccattacagaaatacaaatcaaaaccacaatgagatactatctcatgccagttagaatggtgatcattaaaaagtcaggaaacaacagatgctggagtggatgtggagaaataggaacgcttttacactgttggtgggagtgtaaattagttcaatcattgtggaagacagtgtggtgattcctcaaggatctagaaccagaaataccatttgacccagcaatcccattactgggtatatacccaaagtattctaaatcattctactataaagacatatgcacatgtatgtttattgcagctctatttacaatagcaaagacttggaaccaaccgaaatgcccatcaatgatagactggataaagaaaatgtggcacatatacaccatggaatactatgcagccataaaaaaaggatgagttcatatcctttgcagggatatggatgaagctgaaaaccatcattctcagcaagctaacacaagaacagaaaaccaaacattgcatgttctcactcataagtgggagctgaacaatgagaacacatggacacagggatggaaacatcacacaccggggcctgtcagtgggtgaggagcaagaggagggataccattaggagaaatacctaatatagatgacaagttgatgggtgcagcacaccaccgtggcacttgtatacatatgtaacaaacctgcacgttctgtacatgtatctcagaacttaaaagataataaaaaaaaactatgcagttttgtttttgttgctatgatttctagttacaatcctaataaaaatactatctccattaaatctccaagaacacgttcacccagcatcaaagatcattttgatcaaattattccgtgtgtacaatatacataatgttttttgttggtagtaaagtatcatatggcatctaactgacttgattcaacaaatctgcataaagatttgaaagaatagttttgctatattttaattgtcaccttatgtcaatgctaaaacagcaagttaatacttacaaatgatgtgcataattttgttgggtcacattctcatctcattttatttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaagtaagtcattttattctttgccaagaagtgagatgacatttttgaaaatctagcatatgatcttaaaaattatgttttcattttgaacgtttttaaagttatttttaagaaaatgtcattttggaattgtaaaatgtttgaatcaatgtattgtttcagtatttggttaatttctattaatatttaaagctgaaatgctgagaacgtaagcaaaaatttttttctcatggtttttatagattaattagaaatggcatgtaggatacaaaaaatattggaatccaactagtgttcagtaaagtgtttcaatctaatttactgcttgaaagagacccgtatggcattcaaattagccatttaatttggttatgcttggcattttttttcaagtaaaatgtctccttctcatcatctgtttatttctatcaagttttggcattgtgtactttattttcactgttttcactctttggttctgattaccctgcatcagtctgtatttcaatttaggtgtgatgagttgcgaagttgaaacacttaatatttcgttacagcaaaacaatgagcatttataaagaatattatcagtttaatccaaaatgaatgttcaaatcatttgtatctttgggtatgtgtatgtatgctctgaaaatttattttttctaaagtttttgttaattcagtaaatagttattgaatgatgatgctgtggcagatgattttatagttcagtgattttcacaggatggaatgagggtacctggggttttccaatggccctttgtaggggtccataaggtcgtcccttcttaaattccatacctgtgtgaggctggattttcttatatccttcaattaaaataacatttcactgctgattgaatgcagaagctggtgaaaatccaactgttttcaatcaaaccagctatcaaacaggtttgaaaagtataaaacaatgccctcataacatttttttctggaaaatacgtttcataaagaatatatcattcatattatcatatactggatttgtgttatttttaaatgaattaatgaatctgtttaaattttctcaggtttaattttcaatatggcaaatagtctacataaactaaaatgtggagtcaaaactcttgagaccctcaaaaattttttaaagtataaagtattcctgagagcaaaaagctttaaaattctgttatagacaataaggatgcaaagaagcacaattcatgccatcaggaaactggcagcctagtgggaacatgttttagtttctagcgtataaacattgtatagtgggattattttgtctatcattgtgtttttgttctctccacgattggcctgatctacatatacttaaaaatgctatctccatactatgctgtatccctaatgtcttcagacaatatatgcaaaaacccattgtgcactaaattctttccggtttgtgtttatcatttgaatttattcgtagcttataaccccttgatagagctcatagagttcaaggcatagtgtgatctcttttatacggtgaaccaaaaatattttcaatttacagacattgaaatagccaaactatgggaaagaataaaattataagcagtttaaaacgttccagaaactaagtacttcattcagtcaattagtagacaagtgagtaatgagttgaaattgaattatgtgccaggcataatgttgatcatgctgaggatcccagaaagtagaaaatagacacagctcctgtcctcatggaactttcagtccaattgttttgtctgataatgacttaatggtttgcgggaagaaggaaatattggttttatgttggagagctgcatcttaggtcttttcactctatgtgtgaaccaaaggtaaggttttaggttgctaacattttctgagtacactgtgttgcttaagcaggtttctgatatgcatgatacagagatgaaagaagtttagctctgaatcaagactaaatatttttatttagctt

SEQ ID NO: 16180 - DNA, 157644 bp, Human; identical to SEQ ID NO: 16179
  misc_feature (1)...(157644): n = A,T,C or G

SEQ ID NO: 16181 - DNA, 9316 bp, Human
ccatatgggggactggaggtctttgcgggcagctgaatcttcttgcaaccgggaggggcaactccgagggtggcagggcccagggggcactggaggagctctcttgctccgcgcatctctctgcccccaccccggtgacccagttccttggaccttgaggagggcagtgcgggacatgccccagcccttctcatttccttagccctttcccactcacttgtccggtgggtccttagcctgggccataagaggctggtctagaaaggaggggcaccaacttacagaaacatgcatgtgacacaccgccgaggacacacacgggtcctccaaatggccacacgggctcattccctcacgctgtgacgggtgcatacctgatcacatgcacatctgaggcacatgcagggacatagatggaaagacacggcaggcaaatgcaatgcaaaaaccagcggcacacatcatgcatgagcacatgcactcacaacacacccattcacatgtgtgcagagcttcatgcacatgtatgcacaaggaggcccctccttgccctaagtgggtgggggtcacctgcacacacgcctacatccttgtgcagaactggctggctgtttcctcttcattgccttctactcagcctccacaatctaacctgcactcaggggacctttcaggactagatgaagggtaagtgttggggaggcttggatgggcttggtggggggtctccttggaaaaggggccccgagcaggtctgggaaggtttgcagctccctctcctgggacctggcagcacccctgggaaaacagaaggaaaacaaagaaaaatggcaagggtgcctgaaggtcccacgtgcagctggccatgtgagaggtgtcggcatgcgagttggcgtgtgatggcatgtgtgagacatgtggggtcgtgggctggtgtgtcttgatgcacagggtatgggagttgtgcgtggtgccatgtgtcgattcgtgtgagttgtggagcagagggaatgtcgtcatgtgtggaggcatgctgacccatgggtgggcgtgggctggtacgtgagtggcatgggatccagggtgtggatctggtgagctatgaagcatacagttatcggtatacattcatttgcacagtttttgcatgagttttgtggcacctgggtatatgtaagtcatttttatttatttaacatttatgtagcacttatctatgcagccatggttctaagtgcttcacacatattaactaatttaatccccaaaacaatcctcttaggtaagtactgttattaccccactttaaagataaggcagagagagtttaaggaacttgcccaaggtcacatagctggtaagaggaggagctgggattcaaacctaggtgatctgactctggagcccacagtaacacctccctctgctgcctcttgttgggcacacctgtcagagggagaacagggcagtgtctgggctgcgggtatattcagtgctgagcaggcacatgtgaggcaatgagaaggcagtgggtaggacggaggaggatcagaaggtttttctgcacctctgtgggcaactctaggagtcagcctcataatgccatggctgtgtgacctgaagcagccacctcacgtctgtaagcctgccttctcatctgtaaaatggggcaaatccccatacaacctgttgcgaaagtgaattggtgtgcatttgtgaaggcttagtggctggcacctagaagggcctcagtaaatgtgaaccacccttcccttcctccctctcccaggaaagcgtatggtccagggagatggtgtggagcatggcatagatacaggatgcctgggtctaggctgtgtgaccttgggccagttcctctctttcactgggccaaacaagaggcagggatggctgttggcaggggggcccatctggagcagtgtctagtagccaggagggcctgatcactcctctctgcccttgacccccttggggacccaggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggtgggcccctgggcccctcagaatgccaggcacagggcccggcagcttgcacccaccaccccttttgatcctctcagcagacctcgtaggcatgtggtggcaggggatattcttgcaatcccattttaaaaattgtttttaggaaatatttcccatttaaagaaaagttgagaaaactcccctataccctctacccagattcaccaattaacattttcccacagttgcttcatcattatcagtgtgtgtgtgcgtgtgtgcacactagtgtgtaacattttcttgctgttctgaacattggccctttacccctggatacattaggatatatttcctaaaaataaggacattctcttacataacccataatatgattaccaaagccaggatatttaacatagaaacaatgctattatctaatctaccaaccatattccaattttgccaactgtctccataatgttctttatagcatttttggccctgacctggggtcatgcattgcatctagttctcatgtctctttagccccctttaatctggaatagctcctcatcctttctttatcttttatgaattgacatttctgcagagcacagtccagctatgtctagttgatcctcatttacaccagaggaaacggatgctcagagagataaaggcacttgcttgaggccacacagcctgtgtgagtgggccatctggcaccactgtctacattccatctggatacccagccatcttctaactaattgattgagggcccactatgagcctagcattgagtgaggtgctcatgagctcagtgcgtgcttacaacaaccccatgaggctcagagaggtgaggtgatgtgcccaaaatcacacagcacataagtggagaaaagctctggctggccactacttagagctgtctactgagagggctctggactcatagccaggaggtctggcttccagttctggaagtggccttcaatcttaggttgctcatctgtacgctcatactgacttcacaaggagatttaaggaccggatataaatgccttttgttagtacaagtttaagtgtgctgcatgttagctttatttcagaaaccacccatcccctcagcccagccttgaagatggccagggctctggctctattttatctgcctttttcctaaggctttacacattttttcacctgtaaagtgggggtgttaatcccctgcctcacaaggctattgcagggatagagtgagataaggacttgagcggaaggcttggcatataattggtacttggtagacattagcaattgtctgttattattttctcctctgcacatcctctgctctagccagaagggccttttcagcatctttgaaatgtgccctgactaatcctgtcacgcagctttgcacaagctcttgccccctttccttctgcatctctgaatcctttcccttctggtccctcagctccacagactgctgccccagccactgctggactcttgactttggcttctcctcttgctaaggtctgggtcttctctccaggtggagatgtgatgccctccccatacctatggctagagaggggaaagccctaatgtttgccatggactcctgtgagccaggcatttgactctttagttgcttgatggtagggggatctgggggtcctgatggtagggccaggtggccagaatggtggaggatcacccggacatggacagcagctgggtactgactatctgaaggaatgttggcattttaccacttagtgtgttgcactggtgtgtactggtaaaccccagtcctgctggagccaccacgcccgggtgtcagtcaagctagacccattccctgggcatcctcaggacccctttctggtggcctctgctatccagaccctggcttcttttagggcggcccgggggccccagacagctggtgcacacagagctctgcaagccccagtgcctgattaatgacaagttggctcccatgaaaccatgagtaagcagcaattccagacaattagttaggaggcccaggagaaggctatcacagggttactggtcactggcccagttcttctcaagacccagccctctgccaggtaatggacacactggagaggaagagactgcgcctcttggggctcccactctggtgggggagacagatgtgtaggtcacactgacaagctcagtgacaggggtgtaaaggtgtcatctgggaaccaggggactactgagtggcagggaagacttgaggatgtggaggatgaataatgactataatatgagctgctgtttactgaccacccactctagccagccacggttcctcacacataatctcatttaatctgaggaaactgaggctcacagatacatatatgtccaaggctacacagttagtgagtagttcaaccaggacaccactccaggtccatctaactttagaaacttgagactaccagacccctctattcatgtgctggtcagacaggtagtgatatccagtcacaactgtggctaccattcattgagcagttactacagaccgggtctaatgctaaaggccctgctgattatcaccaccccacactgcccaagcatccctccagcagctaagagggaacaggtacaaatcgagtctctgccatcaatttccttctgagcctcagtttcttatctggaaaatggggatcatgatacctgtttttcagggcttgcgtgaggtttagaaatagtgcatgtgaagtacctggcacagagcgggcccctgataagtggtacttagtatcgttattccaggcaaagactgtaaatgctggagaatctgaagggccaggggtgtttggctgttggcagaatcacccagccaggggagacctgatggaggagggtcagcagtggacagattgtaaagcgtcttaaatcccaagggctgaatggtttgaacttggtacagagggcagtgggaagtgccaatggcttttaaatagggaagtccctgcctggtcccaggttctggggatatgggcattagctagacgtccatgtttgcaggaacaaccctgcaaagacataattacttctggagagatgtctgcaaaggaaaagtccgccaggctctgggcccatatgcaccctgacccagcctgggttggagaagacctcgctaagaaaacagcttgtaaactgagccccaaggagaagtgggaagcagcagcaggagctgggtgcaaggcgggcctaagaggaggcctgtgtgtgacgggagtgagggggtggtgtgcaggctggggacgtaacagtggagatctgtgttcggaaagagctttcagaggcagcatgggggacagacccgagggacagaggctggaagagaccagtgtggaggctgaagctggatctgaggcagcagaagtttatgggatgggagaagggaggcttcttggaggaagtgtcggtcgggtaaagctggaagattgaggagacaggttcggtccttgagctccaaggcactgcgacccaggctacaggccaagccctacgtgctctgtacatttagcgcaagaactctctttcacgtcgcctcgggagctactgcacgtggcggctgccgccctctgcccagcccagcctagccaagcctggcggtccctgcccgctgcagatgctcatttgcattcatttgcatactgttccccgcccctctgggcccagctgcctctggccctccagcccgcgccgcgccccctgccggcagcagacggccccgcagcgcagtgccgcccccttggcccggcgccccctttcgaccaccgagcgcgggccgccctgggcccgggtgccagcccggtacttacccccgacccgcgtcccggggcacgcgctcctgagcccgccgctccaggccctccactgtcgggccccggtgtcctccaacatctctcctgacccctgcgcccgctcggagctttcacctgcggcgcctttgctcctttcccacccagccctccaagggagcgcggcagggcccgcccgatagccctctcttctgggaggccttcccggacacgccttcccgaagccctcggctccccacgcctccgtgattccccactccaccttgcccaggcgggggcagcaaacgtcagagagcccgggggcgcctctgaatcttgcgggtgggggctcgggcaggctcctctcactccccgcctcccctcccgcccccaggccatttacaagatggtttcgtccgtgatgaagatgccggaggacgagtcgaccccggaaaagaggactgagaaaatcttccgccaaatggacacaaacaacgacggtgaggggcaggggcgggacggggtggacggggcgggcgcctttccctccctccctccctgcctccctttcccgctccgcctcccctcgctaggctgccgcctcctcccccatcaccgctcccctcgccctgcaggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcagtgggctgggtggtgggggagagggttgaaagccccacttgggtccccgagggtccattgagccctctcaggccagctccaggaatcctggcctggtcacagagcagagttgcttgcagggtcctagtggccatcgggcctgggcaggacatcatctctcagagggtcagaggctcagagctggtgcagctcagcaggtcacggccctccaccagctctgggttctcccgcatctgcagagacacaggaggctgccagacccactggttctcagcctgggtctcctcctccaggacatccgggaaatggaaggaggtgagggctggaaggctctctgggggcaaaggggcatcactacccactccactgcaagagccaggcctgacctttgcaatgccctcagtgcgagcccagacacccctgcccctccctcaagactcatcctgggccctaggagagccaggtgtcagctgtgtgactctgctgggagatctcacctctcccagcctccaggcctctccctttgctcctggggagaaaacttctgccccatttctcaaggtgggggcccatacataggggtggggcagagcagcttgggcaccctggcaggggctcccaggaaattcggggagtcagggctgtggagggaacttaccatgtggtggctgcttttcccccaccagggcctcagctccagcagctggtgggtgagctgagcacagcgtacagcaaacacgttctccgccacgcagagcactagggcgatgccccagaggcacaggctggagctctgcggggcatggggcagagatggctggctggagttgggggtggagggtggattccaagagcccttcccacccgtgcgagggcctggtgcccctactccaggcctaggtactcacataaatgcgtgtggggtcgaagggacagtcaggtgcgagggccagtagttcagagctcccaaaagtgcaggcagccagcagtgccttgccctgggtggcaaaggtcatggcgatggaggccaagaggccgagggcacaggtcagagaaaggagagcacaggccacgctcgagctaaacactgtccagcgctggacgggggaggccactggtcaatgggcgtcgtgcttggcccccatgggcagctctggcctccctgagggtcagccttaccctctccaaggaggccaggcccttggcgggtggctgctgcccctacccttccctcacagccccatcccaggaggcaccacgtaccaggggggtgctagggaggtagcgtgacaacacgatggctgcgatgcctgaagtgatgacctgtagggaaggctcaagtcagccctgactccttggctggaggaacaggggcagggggatcagggccactctgggataatgatctcaccggcgccaaccattgccctccagactcccccacccctcacctgctgcttagcctgggcctcacatctccatctgcctcctcatagtccagcctgacatgatgtttctaaaacagtcactccctctctacaaccttcc

SEQ ID NO: 16182 - DNA, 14863 bp, Human
aaaagcttccttttcctttcttcatgttctcacgcctgttcataaaatactatattgggaggaaaagttttctttttcttttctcttcttctttcactcaattttccacatggaatggggaaaatatatttctgaatcatgaagcctgtgtttgctaatgggtttgtctgccctcaagccacacaaagtcttttcttttccaagggtaaactctgttgtgcacatctagctcctgaagaatggaggtaaatgcataaagccttagatcccagtggcagtctaatgtagttcatcaacagtaaagatgatattttgaaccttttctgaattctgtacctattactgtgtcacttcagaatctagagagggaaggatgtgaatagttagcatttacaaactcattcatgatataccctccattatctggctcttgttgctacttgcatatcatctagtgtctttacctttcaacatcaagaagccctggcccctgatcactaagcaggctgtaatccagtcattccaaactacctgtggttccttgaataagtaatgctgtttcacttgtctgcatatgcatagcaaaatcttttcctattctgattctccacttaactcatcctaaacccctgctcaagtatcatcattgctgtgaagtcttctctgattagctccaaacatagtaaccatttcctccaaggtttcatttctttttcttattttagagatgtgatctcactctgtcactcaggctgaggttcagtggcctgatcatagttcactgcagcctcaaactcctgggctcaagctatcctcccagttcggcctcccaaagtgctgggattacagatatgagccacctcgcctggcctccaaagtttgttatacttttctctcttaacagtggtttccacatgttattgcaattactagaccatatatttttacagtgcaaaactatcccttgttccttcatgtactgcctccacccatcacattgcctggcattcatgagtgctaaaaacttttcattgaatacaatactaagtaaatgaagaaatgtgggattaaaaatgaatgcctacaatgaaccaagctttctgctgagttacctgaatattacaaagaagcaaaaattattactgtagaggaacaattaccctgcttggaatgcagagattatgtcagcatacaaaattgattgcttgatcaatctggagtagaatagctcatgaagcatagctatacttaataatatagcaaagcagaggggcctgagagggtcttactgcttaatctctgtccatcatgtcttagacctacagacaacttgagttcaatgattatgatgcccctcacctcagggatctgtttccatccagcttccaaagatgggcatacaccagcacaagcatagaaaaataacaaatctgtatattggaccctctgcttagcagtgagaaagcaggtttgaagacaataaagccaggcctgtatgtggagattggcaccatgaccctggattatgttttatgggatatgcctccaagggcaactctgcatttatcccatggcctctggcttccaaattttctaggcacttccctctggggtaaaggaatcaaaattggcttatttcccttgcaaaccatccttggcgactaagtactgccttgtcttctactgagagatggccatatttttggcacctgcctttccttgtgggaggtgtttcctctgtttacatagcaaaggggctgtaggagagacagacggagctggacttacagcagaaccaagtcatgatagcctgtttctattttgttttcagcatttttccgccagttctggccacctcctttcctctggaacatgctgatttcagcaagtccagctctgtcagctctgccccccgagtctattggtttctgatcatctgataatgctttgcctgcactcaggacctgtctttgtccctcctcttaacatacttgcagctaaaactaaatattgctgcttggggacctccttctagccttaaatttcagctcatcaccttcacctgccttggtcatggctctgctattctccttgatccttggtgagtatctctgcacctgttggtttaggcttcagagttttctggcactttgattaggagaactttctccccgccaacctggaacagatttagatgtttttcaaggatgagcttcttcctcctttttacatttggtaactattctaatccttaaaaagccgcttaatccatacacatttgtaattcactttaacagatttttttctattttcttatatttgtaatgacagagtcatgatagtttatcccatttctctttttacataagtgttcctaaatgtactattagtaagaagacaaatgaatgggcaccgggcagcagcaagtagagccaggaaaggaagtagaactgcaagacaatcacctttcattgatcatattgtctggtttcctctgaaaagtgtttcatataatgtttttctagttttcttcagtttctcattgcttagagtaatctagagattaacctagttaatctggtgattgtggagccaaggagacctggatttcaatcctgccgttttgatttcttagcggtgtgaattcgtaggttaccatacctctctgaaattttgctctctcatctatgaagtgaggataatattatgttcctcagaggtttttaggagtatttttttttataagataactaatataaagcatctaacaatgcctggtaaatccctatgctaatcaatcacatccacttttatgtcttgatgatctagtacatcaccaaagcccacacaatcctctcaactggacacttttgtgttcaatgtaaggtactgaccacatcttaaacatccatgcatcccccacatcactcaacggctagtcctgcccctcatggatatactactgggtcttccaggctcatgtgcacttccacctgcttcatgaagcctttctggcctgtgccttctgcagttacccaccctactgcagagcttccaagtcacttactggctatatcacgtttgcacctgcatatcaggcttgccatgctcactttccttcacatgtacacatgttgggttggggttatgcaatgattcccatatgtataatataaccttgagttttggatagttgcagaaaaggcctcattgagcctgagagtggccacattctgaagattaagggaatgagggtaatgagaggttatttggaaaccaagaaaagaaaatattccaggataaaccactgaactacttgaatctgcctgaaaaactgtaggctggaggtccaaagatatttgcaccttctgaaaaatcctataagatgggggtggtgggtgttttgcagttgaaaatgcataggcctcagggactcctggaggttacagggcccaggactctctacagcattaggagggaccttatggagaaaggagtccaaatatacagagatcctgcaggaagaaacccccatgttttaaagacaggctggtgctggaatctggaggtttggaactacatatagagctacttcctgagctattcatctaaatcagctaaaacagcctgcaagctgataatgaggtttgtatttttaaatggtaggaaaaaagcaaaagagaaatactattttatgacacatgaaaatgacaaaaaatttaaatttcagtgtctaataaaggtttaatggaacatagccgtcctcacttgcatacatatatgtggctgttctcaggctacaatggcagagctgagtggttgcaacagacactgtatggcccacaaaactgaaaatattactgtctggcctcttacagtaagagtttgcttacctggtctaaatgctgtgccgatgaacacaggcatatcctgcccctttgccctaatttctgctctgcccaccatggcatctttacctccaccggccagtgcatcttcccagtggcctccagcactctttcctgttgagccaagaggctgtatcaccacacttttcttcaggcagtaacaaccaatcaatctaattgactagaatagaaaaccaatctatccaccatcacgtgtgaagaaagcaggctgaaccagttagctgtggtggaattggtctctgtgattcctagccagtgtccctgtgtccttggaggatggtcatcccagaagaagaaggtcccaacaggactgacattggaggctctgcatctaccactcttgtctcacacagttctgtgaaggccttctagagttgtgttctttgaataaagccttggaaattgacctcactcatttccttctttcttccccagccatttgcaccagacctggattcctaggtaagatttttgggggtttctgagagggaggcctcaagcttaggagagggaaaattttgaagcttcttgagccacagagaaagacttgttcaaaacaggcccagcagacttcctttctggcttcctacctcacccactcagtcttgtgtgggcagatttccacctccagaatttagaagggtttgggtggtttatcctggcagggggtacctctccccacttggtttctgtggccacttggccagcatccaagtaagagctgggttcatttcaggtctagaatgcacttcactgccttatgggcatacctgaaaaatgaacttccttttggtttcttcctgttggtttccagcatatccaggtccccctgccaggcttaatggtgtctttgtttgaattagaaatgcattgttgcttgcagcacatagcttgaccagcagagcataggctggatttcctgctcggggagtctttgggtaatgcacaaatgataaacccaaggaaagggtgcacagagagaatgagtttatagaagagggaggctatgggttgtggattatcagtttcttgtatattatccttccagtctccccttctgcttgatcatagagactttaccagagaggggcagccagaaacattgctattggtgtggagaatcctataccctgatagatgcaaccttcctgggttctcatcttgacattcagattagcccttctgtttcctcaagctgaatttcttgtttttaaaaaagtaatttttttttatttatttcttctttccctgaatttcttgtttacttattttttgttttttattttttatttatttcttctttcccatggctattttagtcttctaccccatagaaaatgaaaattgattaaaaattgagaattttgcaatcagcaaggaaagaaaatatcctgttaatcctgatagctagtatttcttggagtatgcaataatgccaatccaaactctaatgtcagatacaatgacccccaaattatttacggttcatgctactcatgaagataaaaacgtttctggataactgctcttacattatatttttacccagatctataagccttaaactcagttgtgtgaaaatgaaaacttttcttagttttttacggtttatataaaagccctattttttatggttaacttttaattgctatctctagcctccatttttatattttttcccaaaaaaatttaagcaaaggaaagaaactaaaaaacaaatgcatgaaataaacataagcttcctgatgcagtttaaaattagccagattaggccaggcgtggtggctcacacctgtaatcccagcactttgggaggcgaaggcgggcaggtcacgaggtcaggagattgagaccatcctggctaacacagtgaaatcccgtctctactaaaaatacaaaaaaattagccaggtgtggtggctggcgcctgtaatcccagctacttgggaggctgaggcaggagaatggtgtgaacccaggaggcgaagcttgcagtgagccgaaatcgtgccactgcactccagcctgggcgacagagtgagactctgtctcaaaaaaaaaaaaaaaaaaaaatagctagattagagttttctcactgaactacttctcttggactgattctaaactctggggactttgtgtgcagttgtgacaagttagtctgtgggaaatctggtcctcagcagtcacgttctatccatgcatgcaacctgggtcatcccatgtggcccatgttggcccctattaagctgttcatcttccaataggccatagacttccagtccaaacgtggcctctcctggtgcacaagaactctctcagctaaccgtctctctccatgtaagcatggcaaattcagcctctgctatattgctctgaggctgcaggaggcttggtgggattgccaagcttaatataagcttcttgagggcagaactcatcactgttctctgagttcactaactaacaaacaaacaaaacagaaatgtagtacgcacctaacaaatgtttgctgtctaataggctcttccctggtctccctacacagccatctccactctccttgcatgtcttggtggaaggaagaaaatttctgttagtcttttctttttttctctttttttgagatggagtcttgctctgttgcccaggctggagtgcagtggcatgatctcggctcactacaacctccaaatcctgagtttgagcgatttctggctaatatttgtattcatttatttattttctttagtagagacaggttttcaccatgtggtccaggctggtcttaaactcttgacctcaagaaattcacttgcctcagcctcccaaagtgctaagattacaggcatgagccatcacaccccacctctgttagcttttgtacttccagagttctagtcatgaaactgaatcaagtcctagatttctcacaacttatctggagactccatgaatcctctcttatgcttctagtccctggaattagaccaaactcttggggctctgagactctgactcttccctttccctatgctctgtatttctcctgagatgggcgcttgaacaaggaacaatttcataggaagcagcaagtatgggcatggattggccactgagagtgagagatagttaggctgttcagcccgaattgtacacactctgcctcaatctgacttccatggagagagacagagtcatgaagaggaaaaacgcaacagatattctctttacacctctgttctggcctggagcttccacttttggacaatgtagccataggaccataactttcatgaggatgattttcctcatctgtgaaataatggggtggactttatgatctctttagggccttctgattctgaccgccagagaatctaaaactctgctggatcttcaaccaacctcttttccttaatcttcaatctgaaaatgccagcagtcatgtccaggtatcttgaagtagagtttcttgacagggtaccattaaggctgtagcagaaccagaactcagacacggagttctgaagctcctcttccttcccttttcttctgatcccttatttctagttccccaacactctgcaccatttgaatggtggaagagtcccagattgactgagtacatgcctaaggaccctctgagctcctctcaggcctctagctaacaacccgtctctttgcagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagagtgagtatggcaggggtcccggaccacttgccagctgccatacccctcacggccactcttgttggtcttcattccctaccatagacgttcacacaatggctaattggcccctcaccccccacatctcatactttcccaactgtcagtgctggagataaacaatatcctcacctagaactgcaattcctacttggttgagcaaatgctttcatcttagtttcaatctatatgagaacttgtttctcttatttacacacatgccaacatgcacaccactaaacatttgttgaatagagtatactgtatctggagctgggcatggagttatgggggaagaaatgagctcacaaagtataatgtatgctttttaaaaaatagtttcagttttccaggagtttatcttctaatcaggtagaaaggagatactcataggaaactaacacaatctaatagacaggtggatagatgatagaaagatacatagacaaacggatctgtgctcctttacttccccccacatacttgctttatatgtatgagtagtctcttctcttttgttcattagacagcgatgtgattgaggagctagtccatggctcctctttgtctgcccacagaatttgtttctagggaaacagtcactttttgccttgacattgaagactcagtcctattttttagaaagattgagggttgggagcactaatctgagatatttagttcataacgccaacaatgaaccaaaaagcatttggtgttggatatatcttgtatgttattgtatttatttttaaaagtctatacaagatctcttgtgaggatcaaatgacaagttgaacatgaaaacaatttgaaaaattaaaatgctacagaaatgataatgattcagctttgaatttggaagttacattttcttcattgattccctcattcattctttcagcaggcatctatgaggcagtgttaagcactttagcatgccttgtactgaacaccaagaactgtgagatgtgtccattgggccgcctttactgagaagaccatgttctggcagagaacagacacgctctctttctttcccctcagacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaaggtaatgcctgtgcgtccaaagactaggtttattcatggatttaattatgtggaatctcattcaaacagtatttacaaagagctactaacgcaccaaaggaccattgcaaacttatttaactgggcagataattaattcctttgtttttcaaatggagataataatacccaactttgtatctgaaaatgcttttaatattaagcactatattaacatgaactctcattagtttgaattctatattgtaggaacaaggtacatctttttatgtatctgttaagttcttcaatttttaaaacttcttagaatgtcatttataaatattagatttataaaatagacggggaagtgaaaatatctttgtgagagaagtcgacctggacaacagaggttagaacatgatggagagctacagaaggagctctaatcacagaaatacatgtggagagtttcaaatgtgctgatggggcttggtaagcatgtagatgatcttcttggccagatgcagtggctcatgcctataataccagcactatgggaagccgaggtgggaggagcacttgagcccaagagtttgagactagcctgagcaacatatggaaaaccctgtctcttaaaaaaaaaaaaaaaaaaaaaagctgagctttgtggcatgcacctgtagtcccagctactcgggaggctgaggtgggaggatcactagggccctcgaggttgaggctgcaatgagtggtgatcacaccactacactccagcctgggcaacagagtgagacgatgtctcaaaacaaacatacaaaaaatacaaaatgaaaaaattttaaaaataaatgatcttattttttctcctttcccttcctgtctccaacccctgacttcctcccccatcctgcagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggtgagtcctacagatggagttcataagggctggcaaggaggatgataaaggaagaggaaatgatgggggtgtactctggggaaaagggtattttcacaagcgccatgaagctgctcatagtcatcacctgctctgtacttccagggatatggctggaagtccaggccctgtggtaggttttattcctggggctggtgggtagaggtagggctgacactatatacgtattgatcgtgagaacatacaggtattgaatgtaaaaacaagaggcgttctgaaaattatttcaccaacatttttatattaaacatagtaaacataaagtgagagtcggagaaaataagcaaccttcaaaagcattaaaattgctttcaaatcatatagcagaaccataataaaccatctttactctcaacccaaggttattctcttggatgaccctaaccttgaaactctaagttaaactatcaaagagggttctacctcattccatttgtcatcactcctagattttaaactagtctgggagagtgggactacagtagggagctttttgagaatgcccataagagagttatcagagagaccacaataccagccctgaactgtagaactcttcagaggattgaaggaagaagccctttcccaatttgggttagaaaatgcaagtgcagccgctgcgtggctgactcaaaaaagccacccgtctgaagccccattgtgtaatcaatgtggggctacttggttaaaccactaactctggaactagataagaactgatagttgaccaaggtatgtgggaagcagttagtgcccagagaagaataaatacagctgcaggaggctagggtttgagccaggctgctgctactttgaagctgtgtaatgttagtcacttaactcctcagaacctaagtgtttccatgggtagaaatagaaagacacttgtccggtttacctcaaagactttgtgattgtgtgaggataagatatgttgatagatgtcagtactgtttgtgactcacatggagctagttgagtaagtccctgggatactgcacaaggttctggcctggctcacatcagtgtgggatctgtacatggcttagctctttttcctatgttgagccccagtcttctcccttagctaatgtgagtttcaactgaataattccttcctggactatacccatccttactgcattttcctcttctctttataggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcgaaagtgaaaaatatcattttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctcaacaattgcctctctgtgtgatatgctctttctgcccacagagaagcagctgtgtcagattctctatggcagtttcttaaacagggttaggtagaagagaaccttccagttacaaccatatgtgtaaaaagctgtcctctgggtgtgcaactgtctcccagtctatttctgctccaacctgtgtacccaaagacagttctgctgctcctggacttcaggctaacacacttctgataggccaactctaatgccatgcctttctaatctgacatttttttgctttccttctaaccagtgtgtttatgtttctaacccagaaccacactggtctctggctccttactcaattaattctgtcaaaacagttcaatcatcagggaaagacagagagtgggaggaggggtgcagtgggacaggaggagagtgggagggagagagcccaccactcggctgggagtccggaggcaaaactgtgattccttaagtcactgcctgtcctagaggattcattcttaaagcactaggttttaatgaaggatgaaaaaacactgaagagagaatgaatttctgacattgcaaagctcaaatgatggaataacggggtcctctgaaaagagtccctaaggaaatgcatggaactgatactatttgctgacaaacttgtccattcattaggtttagggcatccttgtcatgtttaccctgcattattcagatatgaaatgtgagacaaattgcctacagaaagagctagactcttgaatactggctatgggatcccatgactgctaatgacactggagtgtgtttctgcatcctaacccgcagttccattgtagctcaattttttaataaatatttaaaaggtagcaggggaagataggtagagaaacctagcttcagagaaggaaagaaaatgctttaccacatggatcagagaaccggaggaagcccttccacagagatatatgagtaagaatgaaacagatgctcagaggggaacatagatgagacacacagaaaccccagaaagtatttttggtttctcatccttgcctcttcctggggtcaaatggcattcctggccttgggttctgtgacaaactgctgtatggtacataataatttttttgaagtttttgattgacttatgttggttttcgtacttccaaccaaaagaaccccagataatatatttattttaaattcataaaatgataattcactaattttttataaggctgagtagctaaacccagttattactaatgaatagactctcattgcatttataacatcatgtttatggatctgaaaagataaggaccagagcctataaacagaggcctatttctatttctattactccaagatattacttttgagtggccctggttgtataaatgcccaataattcttttacaagggtgacatttaaagctcatggcctccacattaaaacacagaacaattaaaggtctagtgaaggtgggttatagaagataggcaaatcagaactgacagctattcatgcttcctctttcctctgttggaaaagctctcttcaactttgttacctgatgaactttcaattattctcaatgtctcatttctctcttaaaatgtaatttaaatcaggttataaccctgccaaagggtctttgagagcttctcattgcacatgagttaaatgtaaacttcttacttagacttaaatgcctgtgcatgatctggtccctgcctactcctccaacctcatctcatgctactcttgtcctctaacaacccattgccgtcacatgggctttctctcctttcctcaaacacatcaaatttactaaactgtggtaagtcttccagaggagaaggtttttgggagaggagctatcagaagctctgtttagacatgttaattctgatgcctattagatctccatgtggagataataagtaaaagtttagaggagtggcctgggcttggatacatgatctgggaaaccattac

SEQ ID NO: 16183 - DNA, 22080 bp, Human
gataccctaaatcatctctctcaaactctaagacacacatctctaggtcaggggcaaaatgctgccagtctccttgccaaaacataacaagagtcacctttgctccagttcccaacaagtccctcatctccatctgagaccaccacagcctggatcttattgtttctgtcactatcagcatttttgtcaaagccattcaacaagtctctaggaagttccaaacgttcccacattttcttgtcttcttctgagccttccaaactgttacctgctacctgttacccagttttaaagttgcttccacattttctggtatcttttcagcaatgccctactcctggtaccaatttactttattagtctgttttcatgctgttgataaagacatacccaagactgggcattttacaaaagaaagaatcttattggacttaatgttccacatggctggggaagcctcacaatcatggtggaaggcaaggaggagcaagtcacatcttacgtagatggcagcaggcaaagagagagcttgctcagggcaactcccattttttaaaaactattttaaaacgatcagatctcatgagacccatttactatcatgagaacagcatgggaaagatctgcccccataattcattcatcttccaccaggtcccttccacaacacgtgggaattatgggagctacaagatgggatttgggtgggaacacagagccaaaccatatcagggcagaaagctgtcctgaaacatggtaactcctgtcgtgagctcttttggttcccaaacactgaagtggggcacctgataaggtttccttgtgttcctctttaccctttaccttaagacctgctcgaagcatcagcataagagagaaactgaaacaatgaacacccacatgtgttagtggctgtcattctagatcctcttggttttttctgatttaccctgctttagtggggtttagacagtttccaaatccaaactttaactctctctatgctgctggtttggattaagacaatcagctttattcttctctgtagatggccttggatcattttcccctattagctgttttgggatccttttccagtcatgaccacattttgcttacagatcagctagttggtaaccacagcactgtctgctaactgataccattcatttgacaattcagagttatgatactttgtagtgcacccactgttcttcacaggaaaaaaaaattgcagtacaaagggtttatcaggccccctatcattccagagtttcagtgctgttccagaatgttcaaggtttcagtcatgatatgaaccaactatccataaataatgcaaaaagcatgagtaatcatgaatttaataatcaaggtaaggcagctcagttattatactcaagagagcaactagtatgaaactctttcaaattatttgaataaggatttacatattcataatgactttctgcctctgtcaagctccaggtgtatcagttattaataactgggtgaatatgtaggtactatttaaacaaaaacaatttcacagtagacccacccctatccaagagatgaagtcaagttctggtagcaatagacatctctaccaagatctcctgctcctgccactctgtgaacaggaaaggagggagaaactttggtgttttgcctttcccaatttatattaagatccttattcaagcggctaccggtttctaatgacctatatgtaagttagctttataagaaagttctgagtttgaaactcctttcagcaagtatttgtaagtcaaaaaagcgaagaagaggcaccatttactgtcatttctccttgtgactgagattacttactacaaagaggaactgaccactttctctgacatctgaaatagaaagctacaaaggctgataggcgtggcttcaaaattgtttcatgattacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggtgagatttctgggaagttctttagagaaagatctaggtatctagttggtaaccacaccatctcagtagagaataattgcctgagaccagaagtgttgttatcaatcatattcagaaaactgagaactgaatgctttaactgtctaggtagcaaatggatatcttttattctaccacaattggggtatgaaccaaaaaaatgtattttgtctacagcaagttttaaaaattaattcttgggtgtcttttggcataaattgatatttagaggagatacttggttttcttggctggaggatgacttggtgactgggtttgggcctaagttaaaagacaagacagtcagataagaaaattattatgaagtaatatttagtaaaaaataaaccaggatataaatctctattatatgattttatctctattttaaaaagcatagacatgtgcacacattaatttctcaattttacaagcatttactcaaaaataatctttacattttcatgaatcagtttcattttatgcttcattttacaacaagtgtaagaagaaataattctctttttcaaatggtctatgctttactcagtcatagataacattttttgtggcaaggtataatgaaaagacagggagaatcaattatatatttcctactttgggatacattttgacttttttatggctttgtacatatgaatgttttctaattactccatgagtacttgagaagagtttataaacgttggattccaaattctatttaagtaagataaagtttcttaagtaagcttgttaattatgtttgaaaaatctaaatctaaatctaagctattttttaccttgttctttcagtaactgagagatgtggtgaaatctccaactctaatagtgattttgttaatttctcattgtagttcttttgatttctaccatatatttttacatagaatatgtatatctaagtatatatgttatgtgtgtgtttagagagaagaaaaaacttctatatgctactttataaagtaataacagattatatttataatataatttaaattattatatctttttccaagttgcatactttaccattatgtagtgaaactatgtactgatacttattgacttaagcctattttaagctacactatttttcctaaaaagtctttctttaagttagagtttgaagaatataacttttccagctctttctcaaacttaagtgaacttatgctttatttgtactttgtcaacaacatatgactggatttatttttaatccaaattgaaaatttttcctcctagttgatgagtttagtccagatatgcaaattctataaaggtatatattttaacttggttttgccatcttactttgtttcaatttatagcacttattctgtgctttcttcttctcctttcttgtcaagtttcttatttttaaaaaatctatattctccttaaagacaagccccttagcaaactctcacatcttctggtcccccaaacatacaacttcacctgttaagagtatgttcatatagttcctgttttcttttatttgactctggctttacttatttttaagatagtaaaaacactaattaaagtatttgcttgatctttcttcccttttggcctccaacatttcttagatttatttcttttcataatgagtagttcttcacaaagagctgtgggtatggatattttcactgccaagcttctgaaagctttgaatataataattgttttcttttaattgtgttaagaaacatgtaacataaaatgtgtcatcttaatcagcttcaagtgtacagttcagtagtattaaatacattcatattgttgtgcaaccaacctccagaacgcctttgcatcttgcaaaactaaaactctaaccgttaaccaacaatttcaccattcccctttcctccagagcttggcaaacatcattctaccttctttccccataaatttaaaaactctaactcttcatatatgtttaatcatacagtaagcgtgtgctttttgtgactggcttttttcatttcatgttctcaaagttcattcatgttgtattgtatcatgtgtcagaatattctttcttcctagggtagaataatattccatttcatgtatttaccataaaatacgtaagaaaccatatttctttttattcattcatccattgaaggacacttgtaatactttcacatttttctgttgtgattaatgctgcaatgaacatatatgtacatgcatttatttgagatcacactttcacttattttgggaatatatctagaagtgaaattactgaatcatatggtaatgttatttttaattttaagagtaagaatcatatttttttcatagcatctgaaccattttacattcctaccaatgatgtacaaggtttcccttttttactcatcctcaccaacactggttattttctgtagttatttttttgacagtaccaaaaaacatcatcctaggagctccgatgttttgtgcatgtatgtttttaattgttatatctcattgtggtttttatgggtttgatttgtatttttctaaagattattgccgttgagcatactcatatgtgcttattggccatttgtatagcacctttgaagaaatgtctattcaagtcctttatcaatttttttttttttttttttgagacggagtttcgccctgtcgcccaggctggagtgcagtggcgcgatctcgactcactgcaagctccgcctcccgggttcacgccattctcctgcctcagcctcccatgtagctgggactacagacacgcgccaccatgcccggctaatttttgtatttttagtagagaaggggtttcaccgtgtttatcaatttttatcacactgtttggattctgttgttgttggagttgatttgtaggagttggctgtatattctggatataaagcactcatcaaatatataaagtgtgaatattttctctcattctctaggttcccttttttactctgttaattgtgtctttgatgtatataaaaattaaatgttgttgtagtctaatttatctattttattgttgttgttgttgcctgtgccatcggtgtcatgtccaagaaacccattgccaaatccaatgtcatggagcctttcccttttgttttattctgagagtttcatagttttaattcctacatttagatatttgatatactttgagttacattttgtatatgatgtaggtaagggttcaactttttgtatacagatgtcacaattgcccaacagcatttttgaaaagactgttctttctgattaaacagccttgacgtccatgtcaaaaatcaataagccatatttctcagggtttatttctatgctatctatcatattccattgttctttatgtctgtctttatgccaataccacactgttttgattattgtgtctttataacaagttttgaaagcaggaagtctgaaacctccatgttcttgttttcaagattaaaaaaggctatttaaagtacctttaaattctacatgaattttaagacaaatttttgtgttcgtgtaaaaaacacttctgggattttgcattacagattacattgcaaattgcattgcatatgcagttccttgggtattgacaccttaacagtatcaagtcttctaacccctggacacagatgccttcccatgtacatttgtgccttctttaattccttcaaagtgttgtataatttaccaccttgattaagtttattcctaagtattttactactttaagctattgtatacagaaaaagaactgtttccttaatttcctttttgttcgttgttagcgtataaaaacacaactgatttgtatgtgttgcctttgattcctgtaactttgctggatttgtttatcaattctaagtatttacatagaatctttgggactttccacatataagatcatatcaccagtaaagagagagaatttaccttttttctttcttatttggatattttatattttctgtttattgcctatttttggtgggggggggggtgggtgttaaaccctcagtactatctcaaacagaagtgaacaaaaaaatcatccttgtctttttcctgatgtttcaggagcaagagaaatgttttcagtctcttaccattgggaataatgttagctatggtgttttcgtatgtagactttactatgttgaagtaattttctcctattcttcgtttactgagtgtttctaacatgaaaggctatttaattttgtcaaatgctttatttattttttgcatcaattgagatgatcattttttttttgtctttcattctggtaatgtggtgtattatcttaattgatttttacaagtgaaaaatgagcatctgtgtatttttcctcatctttcaggaataagagaaatattttcagtcttttaccattaagagtgttaattgattgttgcatggtgagccatcattgcattccagggataaaccttaaatggtcatgatgcataaataaatttaacgtgctatataattatgttcgctagcattttgtaaaaaaaaaatgcatcgacatgcataagggatattgtttagaaaattttatttttctagtgcctctgtctggctttgcattggagtaatgctgagtcatacaatgagtttggaagtgttccctccttttcaaattttgaaagactttgaggaattttggtcttaattcttctttatatatttggtagaatttaccagtaaaaccacttagtctggacttttctttattgagaggtttttgacttctgattcagtctcctgactagtcataatgactgttcggattttctatttctttatgattcaaaatttgcaggttgtatgtttctaataatttatccatttatccatttcatttaggttatcccacttattgatgtataattgttcaaagtattctctttatttctgtgaaatctgttgtaatgttctctttttagtttctgattttattatttgagtctccttctttttcttctatgtcaattcagttaaagttctgtcagtattattcacattttcagaaaaccaactcttttttttattgattttctttattatttttctaatctcaattttacctctaatttttattttttccttccttttgatggcttttggtttagtttgttctacttttttaagttccttatggtgtaaagtcagattattgatttgagagtcttctttgtaaatgtagttgtttaaatctgtaaattaccctcatcaccatattctttgcatttaatgaaatgatatgttgtgtttctatataatttctctaaatatggatttaaatttgacttgtgattctttgtacatgtttcattgtttgtgttgtttattttcacagggtcatgaattttctagttttctttctgttgatttctacttttattccattatgataaaaaaatatactctgtatgatttcaaacgtttaacatttattaacacttgtttggcatcctaatttgtggtatatgttgggacaatgttccatatgttcgtgtgaaaaatgtgtattctactgttgttggctttactgttttggatatatctgttagatataattggtctataagtggtctataatgtttttcaatatttattttttccaaattttcttctgtcagattgttctacctattattgaaagtggaacattaaagtctcttactattaccttagagttgtctatttctcccttcaattctgtaaatgtttcatatattaggagccctgatgttttgtgcatgtatgtttctaattgtcatatcttctaggtgaactggcctttttaacactatgtaatattctttgtctcttataacactttttgactgttatttttattttatctgatcctagtatagcaaactctgctctcttatttaatatttcaatggaatatctcttttattccttcactttctatctttgtccttacatctgtaaaatgagcctcttgtatgcaacatatacttggatcccctgtttttaaattcattgtgatatatatgtatatataattttaatatgctttttgattagtaagtttaaaccatttacatttgaactaattattgataaggaagaacttagaacttattgttgccattttttatttgttttctgtatgtcttaataggtttttgtctcttagtgacttctttttgttgatttttttctgtagtgaaacatttttatgttcttctattcctttgtgtacatcctacagatatctctgtggtcatcatcaggttgcatatgatattctaaagttatagcaatctatttttaactaataacaacttaacttcaatcatatgcaaaatgtttactcctttacagctccccaacacatattttatgttaatattacaaattgcatttatataatatgtaccaattaacattgatttataaattgttttgctttcacattttaaatcctataaaataataaaaaatgattacaaatcaaaatagcaaaagtcatgtttcatgtttatgtatatacttacctttcatcaagaacttacatttttgtatgagtttgagttaccatctagcatccttgtgtttcagcttgaagaaatctctttagtatttcttttaaggtagatatagtggtaatgaaatccttcagcttatgtttatctgggaatgtcttaatttctctcatttatgaatagcaggtttcccagatatagcatttttgatggacagacttttctttaaacacttgaaatgtattgtcccactaccttctggtctacaaagtatttgctgaaaaatgtgctcataatcctattgaagatttcttggatataatgagttgcctttttcttgcgctttttaaatgattttcttttcgtctttgagtgttggtaatttgataataatgtgtcatagtgtaagtttctttgagtttatcatagttgcagcttgtttggtttcttatatctgtacatttagtcttttctcaaatttggaaagttttcagtccttatttactcaataattttgttattcctttctcttttccatcaccttttcagacttacataatgcatatattgtcccacttgatgaactttataagttctgttcactttcctttatatcttttaaaaaagtttgttcttcagccttgataattacacatgacctgtctaaaagctaactgattcttctgcctattggtgtgggctgaggaacccctctagtggattttacaatgcagtcaatgtgtttttcagcttcagaatttatggaattttttctggtaatttctattttttgtctattctcattttttattaatcattttcctgattttatttagttgtctctacctattttcctttaactcatttatcatatttaagagtgctgttttagtctttgacaagaaagtctgagggctgtgtttctttagagaaagtttgtggagattcatttttttctttaaaattgaccatgtttacctgtttctttgtataccttttgttgaaaactggacatttgtaaaaacagccccctctcaaccattgttaactggcaccatattcaggggaggactttcactcttcagctaagtatgaaatataaacgttctctgaggcctatatggacgtgtgtcttgcctgggcttatgtgtgtgcattttttgtaattctctcatatacacactgcttttaatctgtaatttccctaagagccacacctgcctcttttcatgaccttagatgttctactgtattcctctatccataatctcttgccttctggcacccagggagtagcagatcccatgaagctctcacaagctggagcacccaccactactttttgcagcctcaaatctgacatttaaactatgccaccatttccatcaatgctccaagtcatgtgaagcagttactagtccctcaaggaacctacagagaagctataatgttgcaaagcagttccacacttttccttctattccaaaggaagaatgaggaattaggaagtttcctcctgatcacgtcacaccattcaagggagaaagttaaacagggacaaagaaaaacacctagaagttttccactattttgaatgtggcttaatcttggtttggaatttcctttgttgcaaccaattcttaacagctgaaaacattagtttggttcataaattgttctttatttggtgtttccatggtataatgaaagtctggaacgtccttgtctgcaatcttgctaatgtcactctcagtgagaagagaacaattttttaaaccataacattcaaataacattttgaccagatacaaaattttagtttgaaaaatatttttgcttgaaaactgattcacagcacttcacctgaaacccctgggacaactctgatttttaattcatttttttagggggggattttagaaagactacttaatgcatacattgtatgtaggcactgcaagtgtcccagtagaggtaatatcaacatcctaatatcaaatgcattaagagttcttcaacaaatcatgccactattcacattaaagtgagatgaataaggaagattaaaaatagccactgtattagttccttctcacgctgctatgaagaaatacctgagactgggtaatttataaagaaaagagatttgatttactcacagttccgcacggctggggagtcctaaggaaacttacaatcatgatggaaggcacctcttcacagggtggcaggagagagaatgagtgctagcaggggaaatgcctgatgtttataaaaccatagatctcatgagaacttgctcactatcacaagatgatatttcaagatgagatttgggttgggacatagccaaaccatatcagccacgtattacttcacattatatctctaatttgcaagatgattttgctaccacacttccctgctaactctcatcccttcccaagcccccaaaccgcacaaatcttttcatccttcagtatcttcttaggttttaaaattgcagacatataattatggatcagtactatgtaaaaattactttcttaacctgctgcagactgttcaatcagattatttaatctttgtaggtgttctactcagtatttctggaagattttatcattttgcttttaatattctttggctttactatatgtgcccatgtgtgaaatttctctttatctgataggtttaaacacaggaacactcatgttctcccaaaagagaacaatttacagccctaagaatttggacactctaattatataaaagttgcacaaacacatggtcaccaacctaaaggaatacctataaatttaaacagaaaattggaatatacgttaggaactgaatgcccttaggtagtacacaaggggttaaagaggcacacataagtgagagtgggaccacaacagctcgcagaagataaagcctcaattaagcattaaaaactctaaggaagtattcagaggaagaaaactgggaatgctttcccagatagcaggaagggaattagcagtaagaagacctgaaaaagaaagacatattgtgtatttctagagcataaggtataagaaattcaaaagtaacagacacacacaaaaagaaagatacagtttatgcaaggcctttcaagtcatgctgagtagaaatctatactaataaaaatcaaaactcattgaaggatttcaggaaaaatagagtcatgtctttatccataaagaaacctacttggttgtctgacagaaaccttttagtaaaagtaagactagttggaggtaaataattgactgtaaaaaacaaatgtgcaaaaaataaatgctgcaattccacactagagagcagataggaggatggcaaaatgacaattttatagatgcataggacacagagaacaagttctaagccccagggagaaaaagtgctaacgagagctgattagggagagccaagaaggactagagtccattccacaactcagaactgtagtgctgtggcagaaggttattcacataaggtgagtggctgcagcccatttatacttaggccactttggtcatagtggataagggaagaatcaggaaccaagaggtaggcattgagggataggctcaggccccaataaaatatcagaagaggaaccagggactttgacaccacaaaacccatactataaatactgcaacaattacctgtttccaaacatcatttcaccacatacacctctgtcccaacttatcaacattaaaagggaagaacttcactgaacctcctaataaagcaagtcttgatccattgttcacagtgacatatctggtaacttagtccctttttcttatacgcatccaaggacaacattttggcctgggacactcactcacaaaagcatatctcattttttaaaattgtctgcataaatgtgtaatgttgtgtgtcatttttactttataggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaaggtaatagagaaaaccttgcacatagctactctgccttgagtctccccagtcttcagtagaaccccaccttggtcatagctggtacatcccttttccaatttataactcagcagtcatggggatgttggcacctcagagactgaccagttggcaatttagaacattctgtttcatatgaaagagattgatatatttagaagaatgtatttgaggtaaggataaaaaaccaaagacagggatttatgagacggtgagtgtttcagtaaatcaaaaatgtcagaaaatgaaaaaaaaagctactttaaaaaatgtgttttatttgaaatatttatatttaaccaatttatgcagcaatagttctattaagagacgtgtagaatttttccacttaataaatcactgttctttttttaattcaaaagccaatattagcactttgccacattacaattcagatcatatttcctttcaggtcatatttctgtcatttgaacagatattgcacagaacatgaccagcctgtcagcatcatgaaagccttagatatttaaaagaaatggtaggagaacaagactgagaaagggttgattgaggcacatggagttcacaggaaaggaagcatgttctcactgcaaaggggaggagtgagtaaagcactgaggagaatgagacagtgcctatgcctaccatgctgctgttggcctcctaggagccaggctgggttaatgcagtagaggtaacaggcaaatccgaactctcatgcaggagctgacagcaggtaatattgaaactgcctcagctgtcttagataagctattccactctaggcctattgtgccctttttcttttcttttgtcagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcaggtaagcttgagaaagaggagcaggactgaagcctcacagaagatactctgctatggcacgtggctctttactaatatctcaacacagcttagatttaccaaattagtaattatggatcttctttgtgatgagtaaagagttaggtatcgtaaaaatgtaataaaaaatttctgtgacataaatatattatcatctccattataaaaatggggtaataatcatattggatatacatcttgcccatccttacacaaatctagattttctcattccaagtccagtgctcttctcatcacaccacagtggtgataacagtaatgcatctgttgaaatcatccatctcctttttagtgcaacaatctatgcccaatattatctattgtccatatcttcaagtgacagattgtaattccctggggtttccaaggacatcccatccaacataaatagaacttactatgttgtaatgaaaaaatgaaaacttgctctgcttcttttgatactaaactccattaacaggaaaattaaactactttcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccggtacactcttcctggtcctcttctccatttttttttaacccagtcacagtgcattccactgttactattgttactctcatgcataactcttcatattactgatttgctgtgggaaaactgttttccatattatgataacttgtttacattggtgagaagccacatgcaagtaaagtccaattacctacaggtaatcactgtgtgtaaaacaccaggacagaccactaagcatttctggtctgtgcaggtaagtagcctggctcctagtaccagtacatacaagcccatggctcatctttgctccccacacttcctattacagatctgccaacgttctcttcagaaaagtattctgctgcaactcaaataggccaggacactgtggagagaggacatacgagataaacaaacttgtcctttttccattgttgttagcattttagccactgtgaaatgctgtgtatacacagtcgaggacatagctctaaccagaaatcctctacctgagactacttacatgctagccaggccaagtctttccacttgtaaaagcactgtttcttgggaagaaacaaacgagtttggccctcaaaatggcagagtacactagtgatcattagaatttctaatgaatgtttgatcattagaacatctaatgatgtttgaggcttctggtgggcatggttcttcatttttaatgctgtccaagttgttttcactttgttgattgtctttgataatttcagtaggtagaggagatatttggatttgttattatattctaatctttctttaaagtttcttcacaacaatgttttcatcatctgctactctagattgttcatgcagaagatcatgctttgcttcaggaagattattctgagtcaatgagggtgatttaatttccaagcctgttgtctgttaccttaggctttcagtagctaaactttaccagctcatgtgcctttcctttctgttcagtaatccctgtctagcctagcccccagctccaaatatctgtgaaagttgttgggtcgaaagctctgcagagtcactcgtgcagagtgactttgtattcctgctcaaagtttttgttgttgtttgtttgtttgtttgtttgtttgtttgtttttgagacggagtctcgctctatcgcccaggctggagtgcagtggtgcgatctggtctcactgcaagctccgcctcccaggttcatgccattctgctgcctcagcctcccgagtagctgggactacagacgcccgctacaacgcccggctagttttttttgtatttttagtagagatgggggtttcaccatgttagccaggatggtctcgatcttctgacctcgtgatccacccgcctcggcttcccaaagtgctaggattacaggcgtgagccaccgcgcccggcctcctgctcaaagttttaagtttattttcttgtgtctgcccaacacagaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaaggtaaacccttaattttgttttaattttctctaccattacctggaaataaatgtcttaatttgccagacttactgtctgaatattggaacacaagaatttatattgactagagatagtgatgaagttgtcccacaaaataggaaataggactaagtgacctattaactttcttacgccaaaataaatgtagggactttgaaaaaaagttagtaagaaatattggcagtaatgatctgttgtcagccacaatgaactaggacaatacagggtccaaatcaacgggagcaagctaataacatcatctctttcagctccatcccaatgagcactgataattttactgtgagttttgataaatttattttaagtaatgaattgtgctaccaaggttgaattctggttgtgacataattttggagtaataagtggattggctggtatgctcataaatgcaaatacattcaacagctatccatacaatctaaacatttgtgcttagatcagttgcccttctatcttatttatttattcatttatttatgaagatagcattgaacaactgagaaatattgaattccatgatacttaaaggataaggcaatctcttcatactatttacaaaaaaaaaataattccaaggcacagagttttattgatatgtccatgtccaaattcaagatgctagttaggataatgcattccatccctttctccactctaaaacattacacatttctatgaactcaactaacattttatatgattgactgctttataaccctacatacatgtcttccaatatagccccttaaatttacctccacattttctcacactctctttaagagatcttgcttataaatgcaattacagaattgatgagtaatagcttaagtgtgtgaaacactacagagtatgaatggagggagttaggtcaatggggacaagatattggaaaagaataagtaatgaggaaggctgagaaagaatgaatgattgtgttatagaagatttttcctttaaaatttctcataatctgaagtaactcaggagtggaaaaccaaatattgtatgttctcacttgtaaggaggagctaagctatgagtacacaaaggcatacagagtgatctaataaactttcaagactcagaagcgggaggctgggagggaggtgagggatacaaaactatatattgggtacaatgtacactacttgggtaatggctgccctaaaatctcagaattcaccgccatataattaatccatgtaacccaaaaccatttgtaccccaaaagctattgaaatttttaaaaattaaaataataataaagtgaaattcctcataatctactgaatgaataattgtagaaagcatacatttgtttttccacaggaccatgagccaagaagttctataggaatttttgattcctctatatctaggtgctttatttactctcagctgatctgaaggtggtagcaggagaaaaagagggaaatatttattgttgtataattgcagaaagaaaaataccttaagcaggaaaaaaaaatgctggataataaaagatggaccctgtgagatggcaggccaagccacatgtatgatctgtacctgtcattcctgtcgtgcatattgcattaactttgtcatgagactctttctcatctatatgatactaacaatcctctcagaaacaggatgttaatcttcttttgcagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtgggaactggatagaggagaatgagtttgctaaagaggcaaataattttgcttaggctttgggaacaccaggttcctcatgtattactcagagagtccagcgagtggaaggagaacctaaacaatgcccttgcatttgtaactggaagattttcagaaggatattaaggtaaaggcattcatacagctctagaaaggatacaatactagtgttaattgatttaaagatgtgtctagcggcagggaacatagggctcaagagcaagggctctgaataagacagatctgatttgaatcctggatttaagaagcactagttggctgatattggggaaacagtttcattggtcctctaaaataatggaagtctccacttcattgggatggtttaaacattcagacaatgtatacatattaattatctcacaacctggcacatcataataaactgatctgtggtagatagttttatttttaggaaggtaaagcattggagggacttttaggcaaaggaaatgatacatgaaaattccaaaagtgtgacatagcgtaatgagttctgtacaactgaaattcagtagatgcagaagactgtgggacccaaagattaaaaaaaagggactactgaggcccaaagatgaaaaagaaatagaagtgtggctttttcaaaagtaaattaatggaaactttattgttgaaaatacatgaaaaattgaaacaaaattatgcagaagaatgcctgatcactttgatattttagcaaaaaatattccggtgtctatctatggagttgcattacagagcaattaggcttggggcagagatatctattagaagttgtgtgctggattcactcatatccttactgaagagagcttactgttggaaattcaggaattatatgcactgcttgctaaacatgtggtagtttgaaatcagccatgtgaaaatatgtatgccaccagactctgcaaatgttacaaatcgaaacttttaaaaaaaaatgggtagttggttaaccaggataccacagaagtttatttcaaaaatccattcaggaaggaaaaagacaaacagagattagttaatggggggaaaatgagttttttgaaggtagatcttcataactttgtgactaacgagctttcataggggataaggagaataatgtagccaatgggaagaaaagatatggcaggtgaaaggagaactataagcagagcttcatttcaatatctagggtctcattatgtctttcttatctctctttaaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggacattattttcccaaagtcttgtctacgttctgttaagatcaatagtgagctgcttgaggctgagtactttgtgcattgtgaagcacattctagagatggggagagacacatggggccttatccacattggagtctatattgtgatcttcagaggataagtccgcagtaaaggctgtgactaaatttatgtagcccatgcttaaatgaacaaatactgtggcctagggaagtagcagatctagaggaaaggattcctttatgcaactgtgtcctccagaagggggccgttggggtaattggtttctctgaaggggacaacaacggtgatttgcataaaggtaccaatatatgcaagatgctttcccctccttatttggtgtggattatcatatccatcatattccatttttctgacttgtagatacatctacatatgtattcaaaatcagagcaactaaaaacataaaacaaacattgacagttctgaggggagaaatatacagcaatgtaatagtaagagactttagtactcacaataatgaagagattatccaggcagttattcaataagataatagcagacatcaacaactcaatacaccaacggacctaacagatataaacagaacattctacacaacaccatcaaaatacacatttgcctcaagtatgcatggagcattgaccacaacatgtcacattctaggtcacaaaacaagtcttaatgaattccagaagaataaaattataacgagcatcttttctgattattatagaattaacctagatataaataacaaataaacaactggaaaactgacatatatgtgaaaatttaaaaacatgcttctgtatagccaatggatcaaagaagaaattaaaagggtaattaaaaaaatgagacaaatgaaaatgaaaccacaatatactaaaatgtatgagatacagcaaaaggagttctaagaggaaaatttatagttataagcatttaccttaaaaaagaaagctctcgagtaaacaaccaaatgcctcagggaactgaaaaaaagaaaaacaaaggccaaacctacaaagactgaattaagaagaaacagaacacccgaaaaaaacaaatgacaaacaaggagattaaatcagtcatcaagaaacttccaacaacaacaacaaaatgccaaaaacctgatcacttcaagggtgaattctaccaaacatttatggaataattgactccaatttttcacaaattatttcaaaaaaatcaaagaggagggaacactttcacactctttttatatgaagtcagcaataccctgatagtaaggctgcacaagaacactacaagaaaaaaatatatataggccaatatactttatgagcatatgtgaaaaaaatcctcaacactaggaaaccaaatacaatggcacattaagaggattatacgctatgataaagtaggatctatccttgagatataagaatcattcaacatatgaaaatcagccaatctgatacataatgtatgttagcagaatgaaggacaagaaacatatgatcatctcaatcagtgcaaaaaaaagcatttgacaaaattcaacatcctttcatggtaaaacttatagacaaattagataaagaagtaatgtacctcaacacaataaaggccaattatcacaagtacatagctaacatcacactcaatgataaaaagttgaaagtgtttcctctaaaattaggaacaagacaaggatgcccattcttaccacttctattcagcatagtgacagaagtcctagccagagcaatcaggcaagagagagaagtaaaggcatctgaataagagaagaagaaatcaaattatctctctttgctgatgatatgattctatacttagaaaattctagagactatgtcaaaatgctactaaaactgataaaatattttagtaagctttcagggtacaaaattaacatacaaaaatt

SEQ ID NO: 16184 - DNA, 9873 bp, Human
ggagctgggtctggggatgagaaacggctaaccctgggccacagcaagctggacctcatcaccaagtatcatcagttgcacggggccaggcagggaactgagcctgggggtcccaagggtggccatctcaatggtggtaacagtgacctggtcagggatgagaaacggctgaccctgggtcacagcaaactggacctcatcactaagtacaacaagtccaagttcaagcagctccgaagccgctttgagtcctagccaaaggactggcatcgggggtgcactggcaagggcaggcccctcctctgtccaccgagactctggacttgctcaggtcccagactggggaagggaggtgtctagaaacccaggtcagacacactctctgggctcaagattcttgtgtatacacacacacacacacacacacacacacacaccctaactagtatcttcttgaatctaggctgtgtttccagccctgtgctgggcctgtagagctgacaggtgggtcacactcagacctggggacagaggtgaaatgcacaagctgctggagaaggggtcagagccatatcaagttaaaggttaaccagttacagagggtgttagaaaacaaagggcagagagtcctggagaaggtggagtagtcagaaaactttcttagaggagatggaggtggcctttgagccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtgaatcacagcgcctggtgtatcctgaactttgaggagttatgggagggacacgttgggggaatgggaagggcaccattcaggccaattatggggaaacccctggaggagggtgaatgccgaaggaggaattgggggagtccaggggctccaagttaccactgtgacattttgagagaacccggggcttttgcagattctacaaaatgtgggccaagttcatcctgtccaagtgtgcagcagggcccttggcccccatcactatcctggggacagaagttggctgctgagtgagtgatagaggccgtgcgagaggcacatcgtggaagccaaccagcacccacatccttgcccaccctggacccctttccagccttttcctgagcccctgcttcctcagtcctcccctctctccagcacctgcagcctggctgcctttccgtctctggctgcgctctttctccagcctcggtctggccgcacttctgcctcctggaactctctccatgggtagcctcttctagtccacccgtcttcagcccctcatctcattcgtcagcactccactcccctgctgggctccagacatggacttctgtccctcaaggcacagctggactcatccctttccccaaacctgcccttcctccggcttcatttccatcaatacctccatcatcaacccttccgcgagacactcctggcccctcctctccctcatgcctcacaaccgaccagccggaggtctaggtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggtaaggcaggtggaggacgccgagggagggagtggtctccaagcaccattaattacacccccggagggaacccggagtgacctagggattcccagggtatcatctgttatctctgggcactatagaatctctcaggccaagcgtcaggagatcggggcaaccctctagcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatttttgctctttcgcccaggctggagtgcagtggcaagatcacagctgtctgcatcctcaacttcttaggctcaagtgatcctcccacctcagcctaccaggtagctagggccacaggcacgtgccaccacacctggctaatttttacatttttggtagagacgcggcctccctgtgttgcccagcctggccttgatctcctgggctcaagtgatcttcttaccttggtctcttaaagtgttgggattataggcgagagccactatacccagccgaggatttgtatctcatctctccctgccactgactgggcaaggtgctttctctttctaagcatccatttctgtctctgtaaagattagctaagatatgcggtcttcctgctcagttacgttggaatcttaaattccctttaccacatctctaccctaccttcctacctgtcagcactgttaattctggtcgttggtcctttcctttttattattattattatttttttttgagatggagttttcgctcttgttgcccaggctggagtgcaatggcacgatcttggctcactgcaacactctcttcaagtgattctcctgcctcagcctcccaagtagctgggattacaggcgcatcccgccacacccggctaatttttttgtatttttagtagagatggagtttcaccatgttggccaggctggtcttgaactcctgacctcaggtgatcctcccacctcggcctcccaaagtgctgggattacaggcgtgagccactgcgcccggccggtcctttcattaagctggatctgtcttccattactgctgcccattgtttcttagttctgctcattgaggtcacttttagaagtctgtttattttatttttttacttttactttaatttttaaaaatcttaagcctgcttgggaggtcgaggcaggtggatcacctgaggtcagcagttcgagactaacctgaccaacatggagaaaccccgtctctactaaaaatacagaaattagccgggtgtggtggcgcatacctataatcccagctacttgggaggctgaggcgggagaattgcttgaaccctggaggtggagctcaccctgcggtgagctgagattgtgccattgcatttcagcctgggcaataagagtgaaactgtgtctcaaaaaaaaacaaaaaacaaaaaacaacaacaacaaaaacttaagcctagtgacctcaaagtattttcctattcagttaaaatactctgatctctaaccatgcccttaggacttgaagcaagttctgacaacaagggagattttagcttagtccttgtgtattttatgatgggagtgacctggaattcagaaattgattggcgtgtatttgtagattgttcattcttgttgctgtatggtgtgttttgtgtaagtatatcacaacgtattcatccattccatcgacagtgcatttgggcagttttcactttggtctgttaggaatagtgctgctggccgggcatggtggctcacgcctgtaatcccagcactctgggaggccgaggcgggcggatcacgaggtcgggagatcgagaccatcctggttaacacggtgaaaccccgtgtctactaaaaatacaaaaaaattagccaggtgtggtggcgggtgcctgtagtcccagctacttgggaggttgaggcaggagaatggtgtgaaccggggaggtagaacttgcagtgagccgagattgtgccactgcactccagcctgggcaacagaacaagactccgtctcaaaaaaaaaaaaaaaagtaatagtgctgctatgtttttttagtgaacacatgtacatatttctactgggtatatgatacctaagagtggcatggcagagtcacaggttatgtgactatttagtagtagttgcagatgatgccagataattatctaaagtgattgaccaacttacactcctgtctcagtatgagagttcagttgctccatatatctttgccaacacttggaattgatgacttgtaaaaattttagtcattctggctgggggcagtggctcacacctgtaatcgtagcactttgggaggtcgaggtgggcggatcacctgaggttaggagttcgagaccagcctggccaacatagtgagaccccatctctacaaaatcacaaaaagttagccaggtgtggtggcacgcacttgtaattccagctactcaggaggccgaagcaggagaatcacctgaacccaggatgcagaagttgcagtgagctgagatcgcaccactgcgctccagcctgggtgacagagtgagactctgccttaaaaaataataatctagccattctgctatgtgtgtagtgttagctcagttttttttgtttttttgttttttttttttggagacggagtttcgctctgtcacccaggttggagtgcagtggcgcgatctcggctcactgcaagctccgcctcccgggttcacgccattctcctgcctcagcctcccgagtagctgggactacaggcgcccgccaccacgcctggctaattttttgtatttttagtagagacggggtttcaccgtgttagccaggatgatctcgatctcgatctcctgaccttgtgatctgcccacctcagcctcccaaagtgctgggattacaggcgtgagccaacacgcccggcagctcagtttttaagtagcaaaatatacagctaatgccaagagctcagcttccctcccagttggtgatggtgaagtaggcaggatttattgggattcctgggtggtctctggcctgccctgggtgttttccagatcagtgggttggagggctgggctctgggcctaaagctttcctgggaaagctgattgggctgggctgagtggtatcctcagcccctagggctcagcaggcatcttgtgtattcaccctctaatttgggtttctccagggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggtgaggcagcccaacttgacccaagagtcacagggccatcctagtcagtggttagccactgttctttcccaacaggcagcaattaggggtctctcctgtggtttttctatatgggctcttgagtttcaggtactcattggaatagtgataacagaggccttatcaagtgtcagaaagaagctggggagggtatgaatccttcatgattggggagattgaaccatccagtcctgcatcctgggccaggataggtgattgactgttgaacttttgactgtgggtgagaggggaaagaagtgatattgagaccagcctccagctgttcagggcatgcatgaatattaggggcttcacagctgcccttgactctgctctaagctgtacttcctcctttctctgggtgaggctttcatatgaggtacagaggagaaatgaggggctcagggagccaaggcctggatgcttctgggcatggagaaccttggttctggggctgtaagttctgagccctgaacacaatatctttgattgacaggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggtaagcattcctgtcctctgaaccccgtctcccgaggcagatcctttcgcctagtgtttgggagtctgggtcattacctgccacagtttgggactggggctgcaggtcagggaggagcagggtttggggagagtcttcattgaggagggagagaatttggtgccgtgactcacattgagcccatcccttggcaggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacaggtacctggggcctctcctttcttctgctcagggttgggggttaacttgcattttgagagtatggggaaaagatgtcatctagaatgggagcctaccagtttgttctggtagcttctcgagtgtgagagcatatctgtacactgctgagcagataagagccagcatattcaaaaaatatttcttgagcatctgctaatcctcatctttgtggtttttcagggctaggatactagagcagtagctgcttgagcagcttgtcagagctggtcccgggatgagggctgaggcaggcacctcacttgagagtgaggtgggctctgtgaaacagctactgaccgtgcgctttcctttctcttcagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaatgtgatgtttggggccctcagcctgtgtacaatccctgcactctccagttgttccagcattctgggaagatagggtgggatgaacacaacacacacccaacccagttcaccacctccacacacgccattcccttctcctctaccatcaggatgtgaggcttcatcctggggcaagaaacactctccactacagttctccttttttcttttttctttttgaggcagtgtctccctctgtcacccaggctggagtgttgtgacgcaaggatggctcactgtagccttgacctgttgggctcaagcgatcctctcgcctcgtttatttttttgtagaaacgaagtcactgtgttgcccaggctggtttatactcctgaactcaagcgacccaccgcctcggcctcccaaagtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttgggacgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgaggtgggttccgggagacccgcgggtctggctgcgagaggtgagggcagagccggggcggggccctagcggggtgtcccggcgacccagaccttaaagggcttctcttcttgcagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactga

SEQ ID NO: 16185 - DNA, 9157 bp, Human
tgcagtagaatcacaaggtgtgcctgggaagctgaatttctataagctgcactgatattctgttacatagcaagagtttggggacctctagtcttctggctgtgaccatctgattcctcattctttcctccatggctcaggtgtgcagcctgagtgtgggtatgacgattggtgggtgctgaattctcaacccacagacccctgggaaaaatgggtctggaggagggacccacagatcctgaatgagctctctgacctgatgtctaggatgagaggagggggctgaagggcttgcagagcaaaggggactaagtatttagaagtgccctgagtgatgccctgctccttcttaacattcattatttgcaaatatttgagcacctactacatgctaggcttatctaggtgctggaggatacagtagtgaatgaaaatctgtgccctgattaagtttatgttctagtgggcatggcaggcaataaggaaataaataaatgggccaggcatggtggctcacatctgtaatcccagcactttgggaggcagaagtgggtggatcactcaagctcaggagttgaagaccagcctgggcaacatagcgagaccccatctctacaaaaaatacaaaaattagctgggtgtggtggcgcaagcctgtagtcccagctactcgggaggctgaggcgggaggattgcttgaggccgggagatggaggttgcagtgagctgagatcatgccactgcactccagcctgggcaacagagcgagactccatctcaaagaaagagagaaatgaaatatatagcatgttagtgacacgtgctgaggagaaaaacaaaacagggaagggggatagaaactggtatttgctaagtgcaattttagatggggttttctaggaagtgctgtgacgtcatcacttgctttaaaagaggccaggcgcagtagctgactcctgtaatcccagcactttgggagccccaggcaggcggataacctgaggtcaggagttcacgaccagcctggccaacatggtaaaaccccgtctctacaaaaatacaaaaattagccaggcatgatggcgggtgtctgtaatcccaactactcgggaggctgaggcaggagaatcgcttgaacccgggaggcggaggttgcactgagccgagattgcactactgccctccagcctgggcgacacagcaggactctgtctcaaaaaataaaaataaaataaaaataaaaatgctgggcgcagtggctcatgcctgtaatcccagcactttaggaggccggggcgggtggatcacctgagatcgggagttcaagaccagcctgactaacatggagaaaccccgtctctactaaaaatacaaaattagccaggcatggtggtgcatgtctgtaatcccagccactcaggaggctgaggcgggagaatcgcttgaacccgggaggcggaggttgcagtggaccaagatcgcgccattgcactccagcctgggcaacagaatgagactccatctcaaaaaaaaaaaaaaaagaaagaaagaaagaaagaaagaaagaaagaaagaaagaaagaaagaaagaaagaaagaaagaaaaaaactgttatagactgagtgccattttagatggggttttctgggaagtgctgtgacatcatcgcttgctgtaaaagaggccgggcgcggtggctgacgcctgtactcccagcgctttgggaggccgaggcgggaggatcgcttgagcctaggagttcgaagttacaatgagctatgatcaggccactgcactccagcctgggcaatgagaaagaccctgtctcttaaacaacaacaaagtcagaaggagaggctgccatggctacggctccaggtgacgtcacggccagctccgtgacgcgcggccagggcagcccgcggagaccgaggctcctctgtgacgtcagcagccggccgggacacagcgggagggcaggtgcggccgcggggcctgccgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcgggtgcgggcggggtcgaccccgggtgagccagtggagggggcggggcctaaagggcggtgctgggcggggacggggctaagatgatatctgggcacctcctacaaggtgggtcctgtagggtaaagggatggtgctaaatgagatcccttaaggggcggagcctcggtgtcctggacggttatgggaaggggcggggaaaatcttgtggttgggtgccactgagggggcgcggcctcaatgttagcgtgagtggctcccaggacaattgggttccaccaagatctaaggctgggggcgggtcatccgtttgggggagggaccaactcttttttttttttttttgcaacggagtttcgctcctgttgcccatgccatgcaatggcatgatctcggctcaccgcaacctccgcctcccgggttcaaacgattctcccgcctcagcctcccgagtagctgggattacaggcgtgcgccaccatgcccggccaatttttgtgtttttagtagagacggggtttctccgtgttaatcaggctggcctcgaactcccgacctcaggtgatccgcccgcctcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagtacgggccaggccagctgcgatcccctctgaccctcgggttcccctctccgaactccagttctctctgagcccccggcccccgtttgagtatcgagcccctctccgagcctcaactcattcctagcccccatccaattatcctagccgaccctctcttcctgagccccaggcccacccccggcccctcccaagccccttctgaacccggacaccacgcaggctgagccccgcctctccctgccgtgggcccctctctgaccctctgtcctggcctcaggcctgctcttccaggggctgagcgtgttgttatccctggcaggagacgtgctggtcagcatgtacaggtcagaggaagggacgctggcgccccaggaacagctctttggagggggtggggagcagggccggaaccttgctggcgcttgagccgattcagatctgattgagtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcaggtgaggggcagtgaattccctggagcccctgccctgggtgctttggaggcaaacccagcacattttctcctacatcctcggtcctgcagctcctggcattcccctgcagaaccccctaattccccctcagactcccacggtcctccccaggcttaaccccctcaagcctctttccactgtccccctatgccggggaaacccattctcttccttttccttctgagacccctccctctctttctccagcattctggctggggcttctgtacctggtctctcctttggagaatgtgagttggggagactgtcttggggtagggggttggcaggttgtgaacccggagattgtgggggtcccctggactgtcggtctgctggggtgggggtagtgccagaggctacaatccttaagaaagggctggatataaacagacttatgagggattgtgcttgagggtctcttgggggctctgatactgggaggtcaaggaggagtcgaggaaaggggacacagtcttcaaaaaggaagccctggccgtttccaggctgaggtaggagcaaggacgacgggagctgagcggctctgtgttttgtcccttcatccaacaggaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgaggtgagccccggcccaccttggaaacccctgatggatccctgctcccagggtcctgagacttaagctccgcccagagccctgcgggatttctcccggtgcccacgaagtccatcccaaagcaaccagctcccagaggtcccgtccacctgtaaaagcagcccgcaagcctcgcccctccaggcctcgccctccctccttgcagagagtggccaagctcgtgttccagaggctgaatgaggattttgtgcggaagcccgactatgctttgagctctgtgggtaagacccggagacactggaagacagagacgcagacaggaaagaggccaagacactgacacagacagacccatgcacctgaccggccgaagacagagcctcggacagcccccacccgcccccagcccccgcgcccccgcgccccgactcccggcaaggcctgggagcctctgagggttacttctcactgttccaggagcctccatcgacctgcagaagacatcccacgattacgcagacaggaacactgcctacttctggaatcgcttcagcttctggaactacgcacggccgcccacggttatcctggaggtgagtctggaaacatcccgggatgggaccccgggcgggacgctgggaaaagcaccaaaaccccgccctacaggcggagcttggctgagccgagggcgtggaggatggcgtttaactcaaggagagacctggcattgctggggactggggcgggctggaggtggagctctgggcgggtcgatggatggggtcgagctgaggcccgggctggggagcggcagcagtcgctctgtccgacggttccgatggtccctccgcccgcctgcagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttgtgagtgcggacgaggtcaggaggtgggggattttgcctagagagcccaagcagtcttgagaactggtgccgttatctgagtcttcgcttgctcatctataaaatgaagatactactatttgcctctcagagctgctgtaggttatagtcataaccatatccagatattagttattgcttgcaaagcacttactccgtgccaagcagtttacaggcattcttattttgctgttgtttttgagacagtctcgctcttgtcacccaggctgctggagtgcagtggtgccatctcagctcacctgcaacctcagcctctaggattcaagcgattcttgtgcctcatcctcccgagtagctggaattacaggcgtgcgccaccatgctcggctaatttttgtatttttagtagagatggggtttcaccatgttggccaggatggtctcaaactcctgacctcaagtgatccgccttcctcggccttctgaaatgctaggattacaggcatgagccaccgtgcctgctttgcacccacataacaacctatgatgtactgttatctccccctttaaagatgaagaaagtaatgctcagagaggggaagttatttttccaaggtaatacaactaacagttggcaggattaaatttaaaacctggtttcttcccgggaggtggagcttgcagtgagccaagatctcaccactgcactccagcctgggtgacagagcaacactccgtctcaaaataaataaataaataaaacctggtttcttagagcccacattctgaattacagtgtacgaccatcaaaaaatacatgagaacatgcatatagctattgaatacatagaagatcctcagcaaagttttcttctccccgccccccccgccccacctgtccccctcatagttcctcctttcattcttcacccaccagggcctccaggtttatgatgaaactgaagtttccttggggaaattcaccttcgatgttgagaaatcggagattcagactttccacctgcaggtgtgtttgtctctagggtgaaggtgccaagggagtggggcagtgagggatgaatgatccaggaggagggcagcccttggcatgatccatttgtctccccagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaattgagttctgctgaaggatactggatcagtgctttcgggggctctgttgggagagctctggctgccgttgcatctaagtatggaggggctgacttcccaatgcaccctcttttcttggagaagtcttgatcaagatcgtaatagcagctcctgtttatggagtgcctaccacgtacaagaaacagtgctgtggacattacacacattacctaacttcattctcacaaccagaaagggaagctgctcaggtcaggaaacttgttcaatgtcacacagctagtgaaaggcagtgacagagcagtacccaggcccaccttcctccagagccagtcctctaactgcagagctgcaggcagcctgaacccacctttgtgctcaattcccagccccagtgggaaagtccccaactcctgctaggtaccggtggaggggtagctacccaccttctgcaggcacacactcaaaagctaaggagacttgataacctctaggaagcttctgagtcacagagctgatgcaggcctggtagcccctacataggttgtcttactgagacctgagttcccaactctgtgtgaggcacagcatagatgatttagtgttcaccagtccctgccctcaaggagcctgacaggggaaagaagagactccaggaaacaggacaatgcatttacagatccaagaattcttcactctaagggtcgaaagtggaattgcagggaaaaaagatggaggagaaggcaacaaaggattaatgagttctacctaggggtaggaaaggaggaccagcatgagcaaagcaacacgcacaacatgcaccatcttggagggcaatgtgcagtatctggtaaaattttaaatataccctttgatctagcacttccacttttaggaacaaattcttcagaaacattcctgttaagtgcacaaagatacatgtacaaagatgttcattatagcattgtttgaaaaaaactgggattcaaatctccatgaataagagacgggtacgctcctacaaaaaaataagatgtaggcattaacaccttcccaatgtgctcatgctttagaagaatatacagactattaatagtgtttatacttttaagaagtgaaattcggcctggtatggtgtctcatgcctgtagtcccagcactttgggaggctgaggagggtggatcatgaggtcaggagatcaagaccatcctggccaacatggatacaaaaattagctgggcgttgtggcatgtgcctgtagtcccagttacttgggagactgaggcaggaaatcacttgaatcgggaggcagaggttgcagtgggccaagatcgtgccactgcactccagtctggcgacagagtgagactccatctcaaataaaataaataaataaataaataatctgggggatttttttataatttgaagatgaaaaagaccccactgagtgctctcaaggcctatttttatttatcaaagcctaagtttagaattatgaactaatgcagcttttctggagggcagtttcacaacaggaaccaaaagccttacaactttttgtactctttactcacagcaattccatttctaagaatgtatccatagaatacatagatgtattcaaaggtaatatttataaggaaatttaacagtgttgtttataaattggaaacttagtaaccaagtagataaactgttataaaaaataagcagccaatagaaatggtaatataagagaatgtctgaagccactgaaagtaatgatatataggccaggcatggtggctcacgcctgtaatcccagcactttgggaggccgaggtgggcggatcacctgaggttgagagtttgagaccagtctggccaacattgtgaaaccccatctctactaaaaaaatacaaaaaaattagccgggcgtggtggcaggcacctgtagtcccagctactcaggaggctgaggcaggagaattgcttgaacccgggaggtggagcttgc

SEQ ID NO: 16186 - DNA, 8797 bp, Human
gtccttgatgtaacagccaggatcaaacagctgggaagacgagaaaacctttcccaggctaggataacagaggatttggttgaaaatacaggcaattaggtgctacctctgggaaaaggggccaggagaggaaggagacacttttccctgcatgccctgatgtcctatttgaacattttatcatgaacacgaacttcctatttaaaaaacactttttattgaaaagataaatctgtgtgttgtattgtgtcactcagttcaagtacttgaaatttattgaattgtattttctaaaaaatagatagttgagtaaaagcaagctcacattacatagacggatcacagtgcacggctgcggagctgggagcagtggcttcgtttcatgcaggaaagagaacttggttcaggagtgtctacgttgcttaagacaggagagcactaaaaatgaaaccatccagccatcctcccccattttcattttcacaccaaagaatcccaccgcggcagaggaccaccgtctctgtttagacaatcggtgaagaatggatgacctcactttccccaacaggcgggtcctgaaatgttatgcacgaaacaaaacttgagtaaatgcccaacagaggtcactgttttatcgatcttgaagagatctcttcttagcaaagcaaagaaaccgattgtgaaggtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggtgagtagtattctccccctttctgccctgaaccaagtgggcttcagtaatttcagggctccaggagacctggggcccatgcaggtgccccagtgaaacagtggtgaagagactcagtggcaatggggagagcactggcagcacaaggcaaacctctggcacagagagcaaagtcctcactgggaggattcccaaggggtcacttgggagagggcagggcagcagccaacctcctctaagtgggctgaagcaggtgaagaaagtggcagaagccacgcggtggcaaaaaggagtcacacactccacctggagacgccttgaagtaactgcacgaaatttgaggatggccaggcagttctacaacagccgctcacagggagagccagaacacagaagaactcagatgactggtagtattaccttcttcataatcccaggcttggggggctgcgatggagtcagaggaaactcagttcagaacatctttggtttttacaaatacaaattaactggaacgctaaattctagcctgttaatctggtcactgaaaaaaaattttttttttttcaaaaaacatagctttagcttattttttttctctttgtaaaacttcgtgcatgacttcagctttactctttgtcaagacatgccaaagtgctgagtcactaataaaagaaaaaaagaaagtaaaggaagagtggttctgcttcttagcgctagcctcaatgacgacctaagctgcacttttccccctagttgtgtcttgccatgctaaaggacgtcacattgcacaatcttaataaggtttccaatcagccccacccgctctggccccaccctcaccctccaacaaagatttatcaaatgtgggattttcccatgagtctcaatattagagtctcaacccccaataaatataggactggagatgtctgaggctcattctgccctcgagcccaccgggaacgaaagagaagctctatctcccctccaggagcccagctatgaactccttctccacaagtaagtgcaggaaatccttagccctggaactgccagcggcggtcgagccctgtgtgagggaggggtgtgtggcccagggagggctggcgggcggccagcagcagaggcaggctcccagctgtgctgtcagctcacccctgcgctcgctcccctccggcacaggcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggaggtgggtaggcttggcgatggggttgaagggcccggtgcgcatgcgttccccttgcccctgcgtgtggccgggggctgcctgcattaggaggtctttgctgggttctagagcactgtagatttgaggccaacggggccgactagactgacttctgtatttatcctttgctggtgtcaggaagttcctttcctttctggaaaatgcagaatgggtctgaaatccatgcccacctttggcatgagctgagggttattgcttctcagggcttccttttccctttccaaaaaattaggtctgtgaagctcctttttgtcccccgggctttggaaggactagaaaagtgccacctgaaaggcatgttcagcttctcagagcagttgcagtactttttggttatgtaaactcaatggctaggattcctcaaagccattccagctaagattcatacctcagagcccaccaaagtggcaaatcataaataggttaaagcatctccccactttcaatgcaaggtattttggtcctgtttggtagaaagaaaagaacacaggaggggagattgggagcccacactcgaattctggttctgccaaaccagccttgtgatcttgggtaaattccctaccacctctggactccatcagtaaaattgggggtggactaggtgatctcatagatccttcctgctggaacattctatggcttgaattatattctcctaattattgtcaaaattgctgttattaagtatctactgtgtgccaggcactttaaataaatattgtgtctaatcttcaaaacaaatttgcaaggaaggtttttggagataaggaaactgagactcaggattaagtaacacacctaaagtcaaaggtgagcttggaactgaacccaagtgtgcccccactccactggaatttgcttgccaggatgccaatgagttgtagcttcatttttcttagagactttcctggctgtggttgaacaatgaaaaggccctctagtggtgtttgttttagggacacttaggtgataacaattctggtattctttcccagacatgtaacaagagtaacatgtgtgaaagcagcaaagaggcactggcagaaaacaacctgaaccttccaaagatggctgaaaaagatggatgcttccaatctggattcaatgaggtaccaacttgtcgcactcacttttcactattccttaggcaaaacttctccctcttgcatgcagtgcctgtatacatatagatccaggcagcaacaaaaagtgggtaaatgtaaagaatgttatgtaaatttcatgaggaggccaacttcaagcttttttaaaggcagtttattcttggacaggtatggccagagatggtgccactgtggtgagattttaacaactgtcaaatgtttaaaactcccacaggtttaattagttcatcctgggaaaggtactctcagggccttttccctctctggctgcccctggcagggtccaggtctgccctccctccctgcccagctcattctccacagtgagataacctgcactgtcttctgattattttataaaaggaggttccagcccagcattaacaagggcaagagtgcaggaagaacatcaagggggacaatcagagaaggatccccattgccacattctagcatctgttgggctttggataaaactaattacatggggcctctgattgtccagttatttaaaatggtgctgtccaatgtcccaaaacatgctgcctaagaggtacttgaagttctctagaggagcagagggaaaagatgtcgaactgtggcaattttaacttttcaaattgattctatctcctggcgataaccaattttcccaccatctttcctcttaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccagatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccagcgctatgggaggctgaggtgggtggatcatttgaggccaggagtttaagaccagcctggtcaacatggtaaaaccccatctctacttaaaaatacaaaaaagttagccaggcatggtggcatacacctgtaacccagctactcaggaggctgaggcacatgaatcacttgaacccaggaggcagaggttgctgtgcaccactgcactccagcctgggtgacagaacgagaccttgactcaaaaaaaaaaaaaagaagtttgttgctatggaagggtcctactcagagcaggcaccccagttaatctcattcaccccacatttcacatttgaacatcatcccatagcccagagcatccctccactgcaaaggatttattcaacatttaaacaatcctttttactttcattttccttcaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaactttgagtgtgtcacgtgaagcttaatataaacaagtttcttgtcactgccaccaccacgaccaaaaaaagctaatcaatcactatatataatacatatatatactatatataataaatatatatactatatataatacatatatacactatatataatacatatatactatatatacacatatatactatatatacacatatatattatgaatgtatatatatagtgatatatagtatatatactatgtatgtatatatatagtatatatagtatatatactatgtatgtgtatatatagtatatatagtatatatagtatatatactatgtatgtatatatatagtatatatagtatatatactgtgtatgtatatatatagtatatatatactatatatgcatacatagtatatatgcatatatactatatatactatatatttatatatactatatactatatatactatatactgtatatatactatatatgtatgtatacgatatatatatatactatatatgtacacacacacatatatatatacatataagcacctactacatgccaggcatcattaaatgtgttgcatccatcacgtcatttaaccccagcacttgcacactcctttctggttgtggaagactaagtaatttatctaagtcacccagctggaaggtcaggcagggacccagatttgaaatccaagtctacctacctacaggtcccctactcttaacctgtaggtcccactgcctacccaggaactgagggatgatgtagaaaatcccaaaacatgttaatatagggaatacctataaacatgcaatcaaagtctttgggactatacaaccactgtataaagcataacaatgtacaagcttccaaacaataactagaagttctgcctccctcttctgggttcctaaagcactgcacctatctacctgtcaaagcatctaccacattgtaccacaccttaaaatcaatggtttttttcttctcagccagcatgtggatgcctcaataaagcagactcctttcatgacctaaaactaatttcaggggggaaaaaaagacgagctgggcgcagtggctcacgcctataatcccagcactttgggaggctgaggcgggaggatcacttgaggtcagaagaccagcctggccaacatggcaaaaccccgtctctactaaaaatacaaaaattagctgggcgtggtggcgcacctataatcccagctactcaggaagctgagacatgataatcgcttgagcctgggaggtagagcctggggctgcactccatcctgggcaacagagggagattctgtctcaaaaaataataataataatataaataaataaataatttttttaaaaaaagactctttcctatattaatctttgcatcctgtgcccatggccccaaacctgaccaatgaaggccccagtaaatattttttgaacaaaagaaaatatagatgatcaaagataagaaagataagaagacacctcaattcttgtaggcatatagtggtaggggaaatcactaattctgtgtgtttatgtatcttcatcttcaggaaaaatagcaagaattagaaagaaacactcaaaggacttccagagaaggcaatgaatagccagtgcatgtacacctacctccatttcctttgccactggcaataatcttcatctgccctctcccctccccgacctaaagtggtagtgagagaggcaatctggacaacttaacatggcctcgtttatccatctcaacacgacactgggaatttggtgcagatttcccctttctaacccctgcaatataaaagttctgtctccttataaagcttttccccattctacccgctacagacttcttcctccaggggaggagttcttctgggtaagggaaagtccacagaggtcaaaaaccgagaggagctgagccagaaaagagccacatactctgatttctagaaac

SEQ ID NO: 16187 - DNA, 6443 bp, Human
gagggccgcaggccgtagtcgcgctccagctcctggcgcgagatctcgatgttgccggtgtccagaggatccagcccagcaggctcaggaacaccagcagcgcgcccgagtagatgagcaggtccccgaagtcgcggccgcgcacctgcagctgcgcgaacacgccggtcagcagcgccgccatgcccgccacatccagcgccacggccagcagcagcgccatccggcagcggcccaggccggccgcgggtgctggcgcggccgccggcgcggacggtgcacccggcgggctcccctgcgaggcgcacaccgctggcgccgccgccatggccctgcaccgccgccgctggcgcccagagagagcgttccggggtgcggcccggtccggggcggggtcaggggacggcgccaggtgtgccaagctcccgcctggtcacctgaaccgggctgggcgcgaaccggcccggccggggttaccctggtcgtggtttccgtgcaggggctattgctcagaggcctgagctggtggtagccaggcgcacagccacgggtgcctagggcccgtgccacccagggaggtcacatatggccaaaaatcagggcattttagtggtggcagcatgggacactcggagccgggcgtggcgttgtttctgctcagtgtccgcctcccgaagcctgtgcagatcagccagtgcagatcagacaaggcctttagacaccaaggagctctgggacgcgagaaccagtagtcggggtgatctaagaggggaagctccgggctccgcggaagctgagtttccttcactcagcgcgtgtcttctggggtctcctgtgttcagcgaatgaagccacgggcacaaggacggacgagacccatcaggtccagagcgcacccgtggaggaagctgggcgaaccccgactgtcctatggaggatagtcctatggaccagacgaagcccctgccccaaggagtgcccgggtgtaaccgcaagttaaggagccctggggaggtgacacaggcaccctcattccttttgttcagtaggagtctctgaggcctccccagcaccatgccgcgtgggtgaggccgaggacacagagaaatatcaggcaaggctcctgcccccttagggtggccctgacaacggatcataacctcccagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgcccggagaggaagcggaaatgcgtgtacggtattaaaggcgtcgcctcgcccctcgccttcctctttccgtctcaggtcgccgctgcgaagggaggtgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgtaagtggggcccggatgcgtggctcctgcgggaggagggtcctgagtctcttgactctgggtcagagggcgggaccttcgcatgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgt

SEQ ID NO: 16188 - DNA, 62354 bp, Human
gcttcttagttcataatttgagagggctacgttatcagtttgcactggttttagcaagagacctcaaattcatcacattcatgttttatcccacattaagtctgcatcatataaattagaactaccaaatattactgaaagaactcacgtttaagaagcagaaacattatttgttttatatggtgatgttgaaatcggagcagaagtcttcaaatctgaatgtatacaaatgaatctatcaaatttttcctcagtgctttctaaggttgtcaggaaaggctagaggcaaattcgacattttttcatttcccatgactcattccctcccatggagtttcgtgctatatattccctgccttgtctggttttttttgttgttgtttgttgtttttttttttgctgagtctttcaatttgctgtgtcttgaactagcaaaaggaggagaggaagttcctcccaacctttgaaacctcttaatacttgctgagtgatcaagggggcagatgactgctgattggactttaccccatttgaaaaagcttttgctatgatagctcaacaaacctcattttaaggaattaagtatttattttccttaaaacccaaaatcttttggaacattttccagaaagtgaggccaaatttttgtagttaggggtcagtttgggggaacttaattttttaggcccactttaaaattaaataattttgcataatatatttaataaggctaaaaataactttattttagacttatagtgttgtccactatattgcttcatgctgttttttcgaaatactttacaattataaatagacattgttgctctcaccttaaggcagcagtttctgagtgaaattcttcaagaaagtggaggcatcatttcgatatggtaataagctagttattctaacatcaacaagtatgtttcatgatcagcgatatactgataattccccatgtgtgcttttcaaatagtttataaatgcaaaaatattagaagttgcaggatcagggtttgagtcattttttttcatgtttcagccagtcctaaataagagctgtgaacaacaaggctacctggtgattttgttttttatctttttgtatgtgcatgtggtttttctggctttttgttttgttttgtttttgagacagggtcttgctctacctcccaggctggagtgcagtggcgtcatcatagctcactgcagccttgacctcctgagctcaagcaatcctccagcctcagcctcctgagtagctaagactacaggcctgcaccactgcacccggctaattttaaaatttttagtagacggggtctcgctctgttgcacaggctggtctcagactcctgggctcacgtgatcctctcctgtcagcctcccaaagcgctgggattacaggcgtgagccaccgcgcctggcgattttgtttcctctgtactcttcgtagctcacaattacgctaaaagaacctttttcccattgttaattccttccatttccctcccccacccgtcgattccccctatttttaggaaactcgaagatgatgtcccttcaacgttctctcctgtattctcaaatacaggatccagtcctaaatattttttaatacattggctagtttatttctgatggcattaaaagtatctgcacaactgttccctgatttataaagctcacagatgctgtatgacctgtaacattatactagctaatgagctctcccggaacagttgacgtggaaggagtttacttccacttggttgcaaggagaaagatggagaaagcgagagacgattgcaaaaagaaataacttagtccattttctcagtgctgtttgggggctttgtgctaatacttaaattgcagaggagggaggagacgggactgaggatggaggggagcagaggaggcaggggcggagcctcggcgggcgaataaaacccctcgctaaagagaagcacgttaagtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtaggtgagttccattccttcccgcggacccctcctctcccctctggtggtcctcctgtgagatcttaacccttcgaaagcattattgttcttcctattccttagaaaaggattgtcagtcacctgagctgtaactcacctccactggtcaagtttgagaggcataggaaatacatcatacatctcttcctccaaaccaggcaaagattctgcccagtgttcatagaatggagcaaatcgtggtcagaaacccggctgatgattagcattgcctgggaactccttaaaaatacaggtcctggtctcgacacttggaggttctagttcaataggtttaaggagggactgagggacctgaacaagtttttatgcagctattattcccaggctggggatgggcttttaaggtatatttggtagctattttgcagttttatgttaaatgaaactatgggataggtattaaaaatagcaagagcaatgccctgcctttttattttagcgttttccaccttatgcagcacttttactgtgtgaagtagctgtgacagggctgttattcccatttcacagatggggaagttatggaagaaaagaggggacagattgtgcctctcggtaagtggagagtttgcagtttctccagttgcctggtggggtccacctgtttcttaacagccacggaggacccggtgaagctctcagagggaatcaggagtaactagaatgtgtagaatatggagttgaggaggaactgatgggtaaaatatgtgtcctagctgggaggtgctgaaggtggggaacctgggtggccccaagagtgccagtgcaggccactcaaaccccctgaatgtactttgcagggcaggagtcccaaatacagcttcgtctctagacagcacatcctctttccagagaagccttggagatggatggcaggcaatagctcactattcctgccctcacttcagagtgagagattgttctgctatctttggtagggggctttactttcttcccagaaaaaggagtgcaggacggtcaggcatagatatgcttctttgtcatctctccagagttcctttatgagagctcgttgtgtcctggtgcccctgaaccagtttctctggctgacgccatgttctatgcaatagctcagagatattttggcatctgagcaatagtgacactggagagcactcttgaaatcaaataaaatcagtgcagtattcagataatcctcttcacctctacacccagaacttcagtgaccaagctctcttcagtctctaaaatgaaatcccatcccccccccacccccaccaactcctcctacaccctggaatcctattttatgtgattccctgactctgggaagttttccaggccatctacagttataagaaagataatgttataagaaaaactgtagtcatgatctgaatctctctttactttttctcatgacattttttttgcctctcctttactttatctcaattgttcaaaagaaatgagaacagccaagtattcagtatgtatagcacatgccagtttaaggtctataaatagcccgttcaccaatttgactgacagaattaagcattttccccctctaggaaggttctgacttatacacagatgcgcacgcccacaggcacacaagcacaattaaacatccttcctgcctcagcctggctcgcccttcccaatataggttcaggtattctttttttttgttcagacggagtctcgctctgtggcccaggctggagtgcagtggcgtgatctcggctcactgcaagctccgcctcccgggttcacgccattctcctgcctcagcctcccgagtagctgggactacaggcgcccaccaccacgccctgctaattttttttgtatttttagtagagacggggtttcaccgtgttaaccaggatggtctcgatctccaggttcaggtattcaagggtagagggtattttcctatatactgatgtttttgtctcttcctttaacatctttttctaagattatgaagaaatgggagtgttcaggtataataagtacaatttctgtgggtatatgttactactgatttgtccacaaccttatggatggtacttcaatgggagaataatctcaaagctccccatggtggcattacagtaactagaatggcaattctggtgttctgtgatgaaaagagattccaaatatgtgatttcagagaaattgggatatttttgcaaaacatgagaatccttgtagagttaataggcactattctaccccaacttaagctagaaacaaatttcccctttaagatgataacaggggacaaaatccattctgcttcccctcccgagttgctgttgagtcacagatgtgctgaggaactgccctttcctcttctggagaagtttctcagtggatgatcgtgattcaagtgttttcaagaccaaatgcaaaaatagaaatggcattttctgtgtagatttcagggatctggtgtccaatgtcaacactgcagaaaaaaagagaactaaaaggcaaaaaaagggccgggtgcggtggctcacacctgtaatcccagcactttgggaggccaaggcgggcggatcacgaggtcaggagatcaagaccatcctggctaacacggtgaaacctcgtctctactaaaaaatacaaaaaattagccgggcgtcgtggcgcatgcctgtagtcccagctactcgtgaggctgaggcaggagaattgcttgaacccagaaggcagaggttgcagtgagccaaggttgcgccactgcactccagtctgggtgacagagtgagactccatctcaaaaaaaaaaaaaaaaagtcaaaaagagaaaggaagttttctaagtgaatcaggagacatgttatggaaaagtagaatttgtcccatctttctttctttctttcttttttttctgagacagtgtctcgctgtgttgcctaggctggagtgctgtggcgtgctcactgcatcgctgcagcctcaaactcctgggctcaagcgatccttccacctcagcttcctcagtagctgtgaccacaggcatacaccacgacacctagctattttaaattttttcttgtagaaacagggtctcactgtatcgcccaggctggtctccaactcctgggctcaagaaatcctcccacctcggcctatcagtgctgggattacaggcatgagccaccgtgcccggcccccagatcttttttttttttttcagggactgtggcaaagttacatttgccctaaatctatctctctcataccttactgactaagagggataatttaaactacatgttttgtaaaatttcattcacaatcaacatggatgattgaaagcaaggataacagaatggtaggtgttatggaaatatacaatgaattaatagaagacttatgccagagagttccttatatcctgattgggaggatgagatgcatatgtactaaacagagaacattcaaaattaatgacatggtttagttgtgaaagagctaaagtagggcaaagttatgtgaatggtgggaagccaggagagagaggttcttactaagaactagattaagaagcatcttgaaggctttgaggagaagatgaagtaggggagctgattctgggagttttcttaggtaaaagcataatgactaaactgttatttcctagatcaaagattgtgtccgtaaaaaaaaattgaactatgagaaaaattgagccaggtgtggtggtggatacctgtagtcccatctccttgatcattttagcccaggagtttcaagccagcctaggcaacagagcaagacctcatcttcattttttttttttttttttttttttggagacaagatctcactctgttaaccaggctggagtacagtggtgcaatcatagctcactgcagcctcgaaagcaattctcccacctcagcctcccaagtagcttaataatttttaaaattatttttaattttttttagagacagggtctccctatgttgcccaggctatcttgaactcctgggctcaagcaatcctcctgcctcagcctcccgaagtgttggggttacacgtgtgggccaccgtgcccaacaaaaccttgcctcttaaaaaaaaaaagcaagtgtcttatatgtttctgaatctttagtgtttaacagaatgcctgctaaggaatacttactcaaatgattgttgaatttaaccgactctaggacaaaaatatgaataggaaacatttatctgcagggctgctgggaacctggcttgaaaatctttaagctaggagtagttttatcaacctggacaattaggttggcccattttaatcttttaacatcatccttgtcctaacctaatcaggcttttgttctccatgtacttggctaaggaaacctgttggcagcatattaatttagatttcaccatgaacgtggagttccccccaaagtcgaaagagggtgcggaggacagcaaagttcatttattaatgataccagagctactgttaatagctgtgtttattaaacacttagtatatgccaggtactcatccaattacctaacatacctgaacttatttgtcattcacagtaactcatttggtagacactttattacctcttcctccagataggaaataaaggctcaaaggggtaagcaactttgctgaaggtcacacaactaaaaaatattggagctaggattcaaacccagagcttgtctgcatcctgaatcaagcttgtaagcattattcttcactatttctatttttatctcctaaaggagtattttcttttagaatctggacagaggtccttattcatttttatagatgaatgaatacttattgtatagcaattaattttgtgttcccagtgaggaagactcccagtatagcaggggagctgggctgtcagctgggagtggaagaaagtaatattcccggtgcaattgcaggaagacttgggtgagcctgaggggcatctggccagcacagaccatgctcgcattcattcctgcacatgcacacctttcctttatggaccagtgttcttcccagccgtgttagaggtacccacagagttcctggccatttaggtactttataccagtcacgtatctaggtatgtaaccagaatctgtgtcttgaaggcattaaaaggaaaaccttaaacaaattaaatttaacagtgtttaattgagcaaagaacaatttgtgaatcaggcagcctcttgaaccagaactgattcagagtttctggggcagcctcatggtcgaagaagatttatgggcagaaaaaggcaagtgacatacaggaaatagaagcaaggtacagaaacagcttgattagttacagctctacattttccttatttgaacaagggttggacagttggctgcctttgattggctgaaactcagtgaatggtacaaaagtaggttacagtctatttacacatccagttaggttacgtttcactacatatggagaaatctttaagtggaatttaaaatatgtaaggaggcagctttcagctaaacttaacaaaggtgaaaaagctggccagagagctgtaataataaaattaaaaagtatataatgtcagaccattttgttttcagcacaatttatgtttttgggggatcttggtatatttgctacagaacaatactggatgctgatctagctactagaccactatctcccaactaacatgattttttaaaatagtatttattgagctcttactaaatcccaattttttttttttttttttttttgagacagagtcttgctctgtcgcccaggctggagtggagtggggcaatctcggctcactgcaacctctccctcccagattcaagtgattcttctgcctcagcctcctgagtagcagggattacaggcgcgagctaccacgctcagctaatttttgtatttttagtgaagacagggtttcaccatgttggccaggctagtctcgaactcctgacctcaagtgatctgcccgccttggcctcccaaagtgctgggattataggtgtgagccaccgcgcccagcctaaatgccaattcctgagctataagctctttacatatattattttattcaatcttcccaacaatcttaagacagtacttattataattacctgtacgttaaaaatggggaaattgagtcacagagctggtagctaattttcctagggtcacaccactgataactgagatgactccatagccagaacacttagccatttctcatttctaattggtaaccaagacaggaggaggctgatatatattgcatggtggggcagttggccatggaggaagacaaccctgagactggagtccagaaagaccacggatgtctgatactgaaaaaattgggggaaaaaattttaagggtttctgtcaacagagaggtgtggctatgggtataactgtactgaaatggctctggactgacttggaaaaatttcaagtataaaagatctcacacccatgtggtctataccactttagaagattttgcattttagtctctaatatgatgtattagcttctaatcccaaaaatgtctactggatgttgaccagagggagggagtgtgaaaactgcttcttgagtttgtacttcaattaaaaaatacaaatacactcacacaaaacatagagggattacgatttggttcattcaggatgaaaatgtgattaaaaccctcattgttctcaaataaaattctgggacagaagccagctaggaggtatttcaaaacaaacacatcttggtgagtagggaaaggctatatgcccagcaatgtaataataataagtagctgccatttactgagcatacattgctaggtgatggtagagcctagattcccaccaaggtcactaaaatctgaagcaactgggcttaactaaaatgctcctcagtctggagtgcaaggtggccgggaccagggatcctgttggacacttcctgactccaggaaccagagagctaaaggagtaatttggttgaatctgctactgtcagggcgataatacattccctcaaagagcagagttacgcagaatgactgactagcaggagatgcttagagtggaggaaagaaagtaggaacccggcaggtaagaaactatgtccaagagacacaccagacagccattttaaacagtcacagttaaaaacaccctgtaccggccgggtgcggtggctcacgcctgtaatcccagcactttgggaggccaaggtgggtggatcacttgaggtcaggagctcgggaccagcctggccaacatggtgaaaccccatctctactaaaaatacaaaaattagccagatgtggtggcagattcctgtagtcccagctccttcgaaggctgaggcacgagaattgcttgaacccaggagatggaggttgcagtgagccaagttgcactactgcttactccaggactctgtctcaaaacaacaacaaacaaacaaacaaacacaaaacaccactgtacccaaaccaaataaccttctcaagagcggccagcaccatatatacacttttctgagttaaatcagcttattgaagtggggtagaggtgtggggcatcttggctggggcttctcaagttgccaggctactgaggttttctgtctttttgatgggtaatccagcagcacagctgccttcaaagaaatgcctcaggaatgtctgttgttgttttgttgttattgtaggagagggagatggatctagaaaagcaggcacatgcaaatgatcccaggagtatatcccaaactacagaaaataagagccattcaggaacccagggggctagaaactgtttctttccaatgtttaactccccgctgagcatacagagcatggaggaccatgccttctttccccttccagaacgcgtctacagagcaggcccccagatcccttctccctggagatctggaaatggcaaactgcaggctcctctctgctgcaggagtgggagcagctggacataggattcagaattattccacattttaacaaacactcaccgagcacattatattctaggccttgtcctgagcactggtgaattttatttctaggaggcaaaataatccctcaagtctattttaagctgttttatttatagaatgagtgaagtttgagctgaaaagctctattgatcacatctcatccctcatctttgtcacagtcacatgtcttcccattggtttgctccctgctttaaatatcctcagcattagcagtgacatcacttctggggagaaggtttcacaatgtctgaaggtggaccaggcaacctcacactgaactgcacattgcaaaagcagattactcagaaagagtaccactgctgcagaattattacttttctcatctgtctccacgttttaaaggtgcttgtttgtacatttaggaaatgcacaaatacttcagtgctttttaagagtacagttctgcagagagtgtttagtaagcagctgataaagacaggtcaggttgacttaaggtggtatttggaccctgatattgaaagcagaaagtttagagtgaatttttccatgatttgcatcggcatgccatagactgggaggaaccactgattagaaaaagatgggctttagagatagtcttaagtttgcaaaccgcttccctatttacaatctttgtaatcttgagcaagctaattatcagtttacttagctgtgcaatggaagtttcttgtggagtatttaaacaaagctggccaggtggggtggcacatacttgtaattccagcactttgggaggctgaggtgggaggatcacttggatccaggagttcaagaccagcctgggcaacacagtgggaccctgcctctacaaaatatttaaaaattagtcgggtggggtggcacacgcctgtggtcccagcactagggaggctgaggtgggaggattgcttgagcttgggaggcagaggttgcagtgagctgtgattgtgcactccagcctgggtgacagagtgagaccttgtctcaaaaaaaaaagtaaaaatttaaaaaataaaacaaagcccttgcactcctttaactcgaggagagaaagaaatgaatatttattggaagataccagagtgcatcagtatgttgtagaatggggggaaccattgatgattagtggttcccacccccaactcacaaactcaataattttggttctgaaatttcagttggactgatccagtaagaagactgaccatttcaggccaagtctgatctgcttagcaaccagctggttgcttttccttttctctttgctgagctgagtctactcactcatcagcatcagtctgacactcccctctcccaggaagacttttctgaacagcccatgccagtgattttttttccacccattaaaatcttgccatatattgcaatagccctcatgcagcttctgctctgcgtggtggtatcagttctgtgtctgtgcacatgtgtcttccctttccacacagttccttgaaaccaggcactgtgtctcactttcacatcctataacctagtacatggtgagtattgaataatagcagtcagtcaaaaacaaatcattattcaagattgcctcacaacgatgtgaatatacttaacactgctaaactatagacttaaaaatggttaagatggtaaattttgttacgtgtctttaccacaatgaaaattttgttctgtttaaaaatgagttattcccatgaatactacatttttgggcttagctttaaaaaaaaaaatcatccaggctcaaatttgaaagggattagagcttaaccaaaagtaacagtgctgaggttgagaagccctgttctaccttcaaacttcaatgaagcccagatactttgttgtgggaagctatcctgtctattgtaggatgtttagcagtgttactggcctctgcacacgaggtgctggtagctctcccaccctcattgtgacaaccaaaagtgtctccagatacggccagctgtcttcttgaggtggtagacaagttgttctcagttgaaaaccaccaaggaagacaaagcctctcactgtggatgcctggctccccagttgggccgggaatgctggaggcaagatgtgggtccttcatgggcttatttgagggcgcaacactcagccccccaccacccccaggctacgatgcctgtctttcagtagctggtagttggctccatccgtttcattaaaagtccatgtgtgaacaagtgtttcccaattacctcccaaaacaagcatgtacagagtgggcgctcaataaataccttttgagatgcaattacctgctgcccgcccacctgcggcatctacaaattacacctagaccagcagacaaatgactcagagaatgtttcacagtcctggctgtacagtgctgttttggagccaagcctccaaagcaagtccattgaattcttctagggctggtctctgtccctactgctacaaatcctagccattccttacatttgttagcgtttcacaaatcataaagtgcctcacatgtaacctctcccttgattccccacaacaaccctgttgaggtaggcagggcaggaacaattactcccattctgcagatgaagagactgattttcagaaaaattcaggtcacatagcaaagcagggacaaagtttctcctccagctctaagtctagtgcccttttcatgctttcaataagaaatccagaagagcagtgttctgcagtgccttccacatctcaatctgcagaagatgttgactcctcagggcatgtgtcagagtcttgacctgctaccacccctgaggagctgtttgtacagtcccgatgggaaagtgtaaacagggtgagaggcatggtgagcttccaggcctggcgtgaagatcaaagcctgggccccacatgccagacctgctttcacgctgttcccttagtcctgaaaagctctgagatcctctcagccactttgtggaagaaacacaaagcaggttcacctagctttctctggacatcatggaaatggccaaaacctcgaagccccaggaggaggctgtggctagatttcaaggctagcatgagcaaggaaggccaaagccttttggatctgagggtctgttgggcatcagaactctgtaattctatgccttaggaaattctttgatggctgtaacattctcgtgtggacaagcctagatgtgagtaatgctttaatgggagtcacatgggtattggtctacagatgggggagttagtgattattcacggcaaatgtgggttttctcaattccggcaatttttctagtgaagacttgcccattgagacaacatggctcctttttaatgaaatgatttgcttggtttttctttgacagaacaagccaaactgggtttcattgtccaggcatcctagaattcattcttcactaaagaagatctgcgtgataagatgattactttattagttggggaggatagaagcaggactaaaactctaaccttgagtacctcagcaataccagacggatgtgcgtctcattctaagtggctttacagacaatgagtctaagctaaaacattggaggaaaaaacccacagtaatcaactttcttcctatatctcatcaagaaacgtgtgttggccgggcaggatggctcgtgcctgtaatctcagcactttaggaagccaaggcaggaggatcacttgaggccaggcattcgagaccagcctgggcaacatagtgagaccccctccccccatcgaaaaacataaaaattagctttgtatagtggcacacacccatagtcctagctacttgggaggctgaaacaggaggatcacttgagcccaggggtttgaggctgcagtgagctatgatcacaccactgcactccagcttgggtgaaagagtggtgagacccacagccaagcgtgtaatcccagcactttgggaggccgaggcaggcggattgcctgaggtcaggagttcgagaccagcctggccaacatggtgaaaccccatctttactaataatacaaaaattagcctggcatggtggcacacgcctgtaatcccagctactcgggagggtgaggcaggagaatcgcttgaacccatgaggcggaggttgcagtgagctgagatcgcaccactgcacttcagcctgggtgacagagtgagactgtctcaaaacaaaaaaaaagaaagaacgaaagaaacagagacaggaaggaaggaaggaagataggtaggttcatagtcaaagtagaaaagccttttcccagttcgtctttttcaaagccactccaggaaagtctcacttagacagtgtccaagttgaaaagcccaactggaaaagtgtctgttgtgcagtttccagaggggaggcagcatggaatcatggaggaaagtctggaccaggagtccaaggacttagcttctcatccaggccttgctacttatgcagtgcatgactttgataaagtcccttcacctctctgagcctcagtttttgcaatggtaaaataggaatgatatgacctgccctctgcacctaagaaagtacttaggagatcaagtaaggtaatggatatcaatgttttataaatccccactgaaggtggtactgcaatagaaggaaggaatcagatctgtgttccaactcttcaataagtgcctcctgtgaaccattcccattgcctatgaagtacagcatagaagactgaccccagtgtattaggaagaccttttattatcagggaaaagctggaggctgtgacagaagatttagcttccggtccagctacaacaaactcaccctatgatttaggcaaataactgcctttctaggtctcagtttcttcatccataaaatagggataataataccgtcatttttcccacttgaaaaataggaataataattgtcctactttcttcccctataaattggagatggtaggccaggcgcagtggctcacacctgtaatcctagcactttgggaggtcgaggcgggtggatcacttgaggtcaggagatcgagaccagcctggccaacatggtgaaaccccatctctactaaaaatacaaaaatcagccaggtgtggtggcatacacctgtaatcccagctactggggaggttgaggcacgagaatcacttgaacctgggaggcagaggttgcagtgagccaagatcgtgccactgcactccagcctgggcgacaggctgttccctagcacttagtttatactagtgtagctcaatatttttttagcttttatctttgtaattttatttatttatttatttatttgagacagggtcttgctctgtcactagagtgcagtggtgcactcacagctcactgcagtctcgccctcccaggctcaagcagtcctcccacctcagcctctctagtatctgggactataggcgcatgccaccatgtctggctaattaaaaaacaaaaaatttttttgttagagataggatctccctatatcgcccaggctggtgtcgaactcctggactgaagtgatccttctgcctcagcctcccaaagtgctgggattacaggcatgagccaccaatgcctggcctatctttgtaattttaatttggtcaaaaataaggttttgggggcagaaacccaatttttatgaagtgaggactcttattccaatgccaatctactgtgaccctcgcaatcactctggcagctctctgccagagttcttaaaggttggggcctccaagaagcaaaggcaagaagtgggcagttagtgttgcacgtcccatcttccagtggctcctgtggcctagaacaagggaacatactcgaaatgtcagagtgaaaacagaagagaagcacttactgatccctgctgcagtgtttgttttctacgaacccttagtggaacactgacactcttcattcctgagaagatgggatctattaaataacacccatcctcattttccctcttgcaacagccattcttggctctaagaagcacctagctatacactcctcccttttcagtaccttaaagaccaaagtcaaaccttgtttttctgctgctattgattgtttttctaactccttgagctggttttataaccctagctttattgctgtagtcttggctggctttgaaattccctatggatcgctcttttgataacttcctgctaggcaaggaatttactatcatctttcagcactattagcaaacctgtctctagatctctcatttcccagcacttgatattgtccagagaacagcagtttggcaggggaagaatcactggaagggggaacgtgtccaaagtcctggaatactacaagcaggttttgtagtccctgctaacccagtacttctgaatagagcatatggggactgtctgagagaggagggctgaaagatgtcctgttgtcctatcatagaactttacataaacttacaagaagaggaaaagtctgtaaaggattggtggcactcagaatctcctttttctatcttctctttgcctgataattattatcactaatttgatgatgaggaattatttctcttagtttcatttctgtaagcagccctgttctgttgggaaagactgttagcaccaaaattaggaagacatatttgagacaaatatgtgcttccttttcctctgcatctaacttcagcctgtgccctctgatcctatatttcagtctcagggctagattgaggttgagttatggttgagatctgaccatcagtttttaaaagctgagcatagcaccttacaatctccatctcactggttccagactactacagagagatcatggaggcttgagatgtccttagaacacagtcaaatccagctgacctcaggatactctagctctgcctttccacctggatccgtttggtctctgctcctttcctcaggcatttagcagtgcagctgggcagagcatgaagcagcactttcaaagcacccactcaatggaccccgatgacctcttttaccacaagaagtggacagaggaacatttgggaggaagcatgtcaggaacggcctccacactcttactcctcgtctgcgtaacacacaacccagcagctagccattcagtaccggctgcgggcctcacctctcaggagaaaaccagcccctgcacacaagcagaagtggattagtggaaagattgccggattaagtatcaggagactgacttctagatccaattttacccatcagtagctgtggaatttggagaaagccacttaacccctctatgtcttaatctcttagtttgtaaaatagagagggaagtacctgcccctctcctctccctgaattccataaggttgttttgagggtcacatgaaacattggtgggtaatgacctttgaaagaatgcagtactgaggctttgtatgtattgcattcctacacaccacttctaaaccactaggactgtttttatagagttattttatgttcttcaccaagggtggggccgtcatgtctagggtagaagccagcctccaggagtgttttccacacttgtaagtcttgaaaacccccagtcttggggtatgaccgcaatctgtccaaaaaatattgccctttggctcatttttgaagccttccagtggcaggtggtctctgaaaacagcccacttttccagccctgccattttcagagagtcttgaaggccttgtcactttgggtggaccacgtgtcgctcagctggagggtcctgagattcaatacttcaccatcacttactgcgatgtggacctaggcaactcacttggtatctctgagactcagtttcctcctctgtaaaatgtgagaaatatctgattccatagtgtcatcctgaggattaaatgagatgtggaaagtacctgaccaagttcctggtcaataagtgtcagttctctgctcctctttcccctacttcagggagaattattgctaggcacacctgcctgcagatcatttacatatatccaaggcatttcagaatcagatcagaaatgagaccaccctccaaatgccaatcctgccaaccgtcctgtctctactgtctcccctccttacccttggtgcctcatgcagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggtaagaggatctgtggagacctgaatggtctaggggaaaaggaggaagacattcagaaggaggtcagattggaaaaagccaaggccaggggtttccagtctccagtgtgccacggggtgctagtgaatggaatgtctcttctgctttcctgccatggttgctagtgtagccttgtatccccttgaggctcccgataatgatggaggaccaggtttgtagttttgacctctatgttgatcttagtgggaaggagtctatgagtgagagcaaacagaactgtgtaacaacactgaccatagattcccagagaaagcacatcacaaaaacaacgcccttctatcttgacaaatgagagtggccagctaaggtagagtgcaccctcttctcacactaccaaggataatggcctccctctagagctgggccctaatcttaaatttcctcaatttctgcatccctgccattggtaaaccctcaccaatgggccaaaaggtgtggaaggcgcttcccctgcaaacccccacttgatacctctcctgattattgcttacgtaaccacacccttagtatgtcctgtctatcaacattctggggttgcaaattttgtttttccaccattggatgctggtggccacagtgatggagaagagatcatgaaaggagaggagagaaaggaagaacgccaagacttgtgttagtgcttgtggaaatttaactcttcatcattaaaccattttattgtcactgcagagggctgggtgtctcatttgtgggtgggggcagaggctgggctcttcagcatccttgaaaataaaaaagagatgcatgacttgcccgggctctcccctgatggctctgcgtccctgccatgcctttcggcggatgtccctttcctccttcaggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttatgtaagtgtcatctgggtcttggtagcaagacagcctcttttattatatttattattattatttttagaaacagagtcttcactctgtcactcaggctggagcgcagccgcatgatcatagctcactgcagccttgaactcctgggctcaagtgatcctcctgcctcggcctcccaaagtgttgtggttacaggtgtgagccactgcacccagtctgagggacagcctcttttatcctccctggaggtctacatgtctctgactctcctaacttctctccatttttttttttttgaggcagggtctcactctgtcacccaggctggagtgcagtggcgtgatctccactcactgcaacctccatctcccagattcaagtgattctcccacctcagactcccgagttgctgggattgcaggcgtgagccaccatgcccggctaatttttgtattttttgtagagatggggtttcaccctgttggccaggctggttttgaactcctgacctcaagtgatccgcccgccttggcctcccaaagtgctgggattacaggcctgacccacctcaccctgcctccttttcttttccccattacttttctttcaatttcctacaagtgtgttttttatgaatggattctgcatacaattgtctggtgttaaaaaaaaaaaaagaaagaaacttaagtagctccttggaggcactatgattttcactggcagggttcttgacattacgcaaagcactttcacctatattatctgatttgggcctaatgacaagtccatgaggtaagctgggccagtgttaacattttcccagaacagataaggaaacagagagccaggcaaatgacttgcccagggaggcaggccacgtggagtgcaagggctcctgatttcttgtctgtccagtgcactgcactgtgctggctactcccagctgctcctaggaagattactctggcttcttggcagtaggtccacatctacttctacctcaacttgtcaagtcacactcttttaactctcttggagaagggtttgtccatgatccctgcccttgatgagttttctaactaggagaaaagccatatagacagatactgtggttaggattcaattgcagtaaaaattcagagaagggagctaggcatggtggtgtacacctgtagttccagctacctgggaggctgaggtaggagggtcgattgaccctgggagttctgggccacagtgagctatgattacacctatgaatagccactgcactccagcctgggcaacatagtgagatcctgtctctaaaaaaaaaaaagaaattaaaaacaacaataacaataaaattcagagaaggggaaaagatctctgtgggctggaataggttagagaggcttcctagagaagttctgcagagccgtatttctaggaagtctcaaagctttatctctgatattagtcatctcaatggattggggtattttacatctttaatcaaaaactaatttctaaagtaaatacttagatatgtttcaggggctccacctctagggttcactgggtccctgccttcccatagcttctaacacacatacacttagctgagggcagtgatcatcctggccatatgctttcccaggtcctgacacttttccttctgtcctgttacgggatgggggaggaagagatcactcacccacctcagtagcctcttacagggcaggcagctgggacccaagaggcggtctccttggcaagtgagccctctttggcagtgctggtcaaccctgggacagacctccaccacccaggccatttgcaatatggggccaagacatttgtttgggggtgtattccttgtgtttgatcaggcctgctcacagatctggaggcagaggaatgcaggctccaaaaccaggctgcctgcgcctgcatctccagtccaccatttctaactgcagtggtgagtgctgggcaaaatcactcgtccaccctactgtgagatggggagtgtaatcctagctgcctcaagaggtcgtggtcacaaggactgcaagagagaaggaaggggacaccctcagcacagtgttagacacccagcaccccagtcatatcagtcactgggggtgggcaagatgctggggccactttatccttgcatcctagctggatccagagttgagatggggagcggggaagagcgagggcgtgggaatgcaggaagagtgctgtttctgccatcagatcagctaatgggagggtgggaggcaaggccacagaagtgctagctactgctgttttggtgtttctttgcacacagacagcttcctttttcctgctgatgctgctaaagtgtctcagacaagaggccacccttacccttctactagaaatcaagaacccccgaggctgttcagtttgcaccctaggagaggagccaggccacaggttgaagaagttcccaggcagccagaccccatggctttctttgcattccccaaatctgccaagggtttgacctcttgcacaaagaccctccaaagtagtgtagcctttttggcgtcccctcagaccagaaaggtccaaactctcctaggagataagaacgccacctgcctgtagccctgctccagaatgacatgttgcacagtcctctccacagccttcccctcacctagacactgcaaggaccaagccaaggagaaatttagaaactggctgatgacaaaaatgacaagacccccctcctctattcctgtagtcaaagattcaataaagcttatctaagtttggcctctgccttctcagcagaactgcaaggaaattatctccaacttaacagtagccaatcttgtcctctaaagacaggaattttcaatgtccttgaaatatgggttcaaatatttgtctaccttcataagcagaaaaatcttaaatccttcttattcccaagcgtagtcttccttatttcctttaggggaaatggaaaccagctccacacctgtcccgctgcagtgtccctttcctcctagctgtgaaggccatgtggagctgccatccctctgcccggcagggtgcacacgtacatgcattagctataacaaacttcctctctccctttccttatacctgacactcccagctgctttgagtctgtgtacagaggttctgttttccggtttgttgaatactttttttttttaatccacttctataggcccctcaaatcctctcttttttttttgaattttatggcaggccataccagataagcatccaatcctctcatacggtattcagtaaaacaagaaccaagctgtcaggaaggcttggtagatgctttttttttttttttttttagatggagtctcactctgtcacccaggctggagtgtagtggcgccatcttggctcactgcaacctccgcctcccgggttcaagcgattctcctgcctcagccttccaggttgctgggattacaggcataagccaccatgcccagctaattttgtatttttagtagagatggggtttccccaagttggtcagactggtctcaaactcctgacctcaagtgatccacccgcctcagcctcccaaagtgaggccactgcgcccgactggtagacgctatctttcattaaatgctggtactttttattccagcacccctcccacccacccacctacccccaccatcatccagccctcctcatcctcttagcaggggccaggcaagccagctacataaaataagcccagcctgtgtctcttttgagagacgcagtagagagttccggtgtggcgtaaacatatgcacatggggaactctgcttcctgctgtcctgtggcgacatgctgatgactgtgaagcgagaggttttgaggaaaggccaccctctgtggagaggtcattggtgtataatggagggcactggaggacagggcacagggcccagcagggagagcctgtgtggtaaagcccgtggcgagggtttgctgggggagggaggagatgaggccaagtctggttccatggtggggctgttttggaggagaactgatgagaaatgaagttgggaggagccaggtggtgggggtggagaggtggaaagaacctgctgaaactggcttgcctgccggatcctgagcgggtcggggagaggagagggagagggaaggaactgcagacttggatcacacttatgcaactgcagctgccacttcgagttattctattatttaggtcaaagctgattactcactgctgagtcagcagaatatccctagccacccagcagtaaaaaaagaaaagaaaaaaaagagagagagagagagaaagtattttacattttaattaaataaaaagcctttctctcttctccagaacaagtatattagtgggagtggagggagttaggaggggactgggaagtgttagaacttggttttgataccttttgtgatctgcttgtgtgtttttctccttttgtattatttcatgagtaaatgactatattccccatataaaagatccaagtaagatatagagccagcagcgatagccgcccttatcatcagccgctggccagtagctgcagtcctagtggatagttctaaataaagtgcatctattactgtacaactctggctgcatggacctatgtactgacaggttattcctacagcgtgcccttttttttttttttttttaagacggagtctccctccgtcacccaggctggagtgcagtggcgcgatctcggctcactgcaagctctgcctcccgggttcacgccattctcctgcctcagcctcccgagtagctgggactataggcgcccgccaccacgtccggctaattttttgtgtttttagtacagacagcgtttcaccttgttagccagaatggtctcgatctcctgacctcgtgatccacccgccttggcctcccaaagtgctgggattacagctgtgagccacccccacccggcctacagcttgccgttttatcctgtagccacatcttttggctgttacctgggtctctagttgtaaacaaagcatccacaatgatccagaggaagcactgggtccaggggacaccctttcccaggcttccatctgtgcatctgtgcaactctgcattttcctttgggatccgtttgctccccattctcttggagactggatcacctttcattcagtcccctcctggcctccttcctctcatttggggttggagtcatgtccagcacctgaagtggaatcaattctttttattcaagttccccacttctccctgaatgtcttgacctaaagaagttccttctccttcctcaccctcaggagaaagaaatatcctgtatgcatctctcaaggaaaaaatgcttctaatcttgttttctatctttctactgagattcctaagaggctagctttttccagggcttcagatagctcttcttccttgagctatttggaaaggaaaggacttcatgtgttgcttcaaactcctgagttgctttgcaattcctctgcagaaagcctccaactgcctggtgcagaatgctgtcacagagaaactcgtgagttgttttgcaagtctcttgcaaatttaatcaatcccttgacctcagagcattcaatagtctttcctatcatctaaatcccttaacctcagtttattttcccttgagccttcacattctctacccccaaactgctcctccccagacactaaacattttccttcagatacctgggcagcactgccttcttgcccttccctagtccccagagagttcttcgggtatccgatcagcctcgtttatatgaattcagacaaatacagactggcctacatttgattcccatatatccaagactccatttttctctgtacgccttctaactagccagcatttaaaatctaaatgtattgaaaatctcttgatttttactcaatggacagtttgactaacatctcatttttcatttttatgatgcattaagatgaaaattattctgtaagcagattttttttggaaaagagaaagaaactaaaaaaatccatcagctaattaccatactgaactcctacactaaggggagataaggtatgatttatagagtcttagaaaagattagtctagtgaagagaatcgtatgcaaaaacacatcattacaatacaatgtgatggggaaaaaatgtgggcaacacagagaacggggcttcaaagttgggaagacagtgcttggaaaggctcccagcttgagctaaatgttgaaaggtaagtagattttatccaaggaacagggaatcactgaaagattttgagcagaggagtcacatgattaggttcacatttgggaaagaaaagactgaaacttgaagcagagagacaagcaggctaggcatttgtccaggccagagagatggtagcctgaactaagaatgaagtaacaaggatggagagatgacaaaaacaagaaagatttaagagtagaatcagctggacatattgattaattgactactaagggaaggaatcaagtttgtccccaaatcaaaatgaaatacgtttcaacttaaatgttcccagcattgatgacaagcagttagaatgtgttctatgtcggccgggcgcggtggcttacgcctgtaatcccagcactttgggaggctgaggcgggtggatcacgaggtcaggagttcgagaccagcctgcccaatatggtgaaaccccgtcgctactaaaaatacaaaaattagctgggcgtggtggcgggggcctgtagtcccagctgctcaggaggctgaggtaggagaatcacttgaacccaggaggcggaggttgcagtgagccgagattgcgccactgcactccagcctgggcgacagagctagactccatgtctgccttccatgtcctccctagagccccgaggggtgctgagcaggtctctggttagaaccttccccagggtggtgctcccaggatcctgctcaaaattttgcctgctctagagcagtataacttagaaagggattgggactcttgggaaatgttatataaatgcaacactttattcactcaacaaacacttatcagtgcccatgatgggctagttactgttcttggcacgggggagacaacaataaaccgaaagactctcattctcatgtgaagcagcagcagcagatttagccttctttcttaacacatattatactacacccacctgtgtgtcctctattgatgccgcgggtaatacacaatcagtcatacgttattaaatatttgagtgtctgttctgctccaggcactgtggcaggcatggggatacttagtttttgtaccaaggaacccacagtccagtggatgttcctgacaagtatacagggaatttcagttcaaactggagttccagttccccaggaggccagcatccaggcagctcctgcaagaaaagtgaggatgggactggggttgaagaagctcttggagaaagtgacatgtaaattgagactgaaagaccagttggacatagtcaggcaatattcagcacggagggagggtggagtagaatggggtggggagaatgttctagcagaaggaattaacatgtgtcaaggtctgaggacaggaaaaatcacagttgtttgtgggaactacaggttgttcagtatagccacaccatagactaggaggcaagaaatatataatagaagcaaggaccccataatgaaaagcctcatgggccataaagagattgggctttcccttaggaggaatgaggtttgaagggtttcagacagaagaccgacatgatcatatctgtattttaggagagtcatgctgcaaagctaaaggatggattggtgaggggaataagatcagaggcaagaaaagatgattacaattcagttgtaaggattcagattgcagatgactatcatgtgcatcttggggcagtgggagtagagaaaagtagatgcatttggcatttaggaggtagaattggtaggccttggtgattaaggttgaaggagtcaaggactgcatggtcttgttggggatacaggtgaagtaaatcaaggacaacactgggtcgtattgtctgtacgtattgttgtatcatctgaattggtgtggttcagactggtcaagttgacccctctgtccttgtcaccctttctactcactcttcaacacttaagacttgctgggacttgagaaagcatcccctgtgcttttggactcttatgtctacaatggcagagtaagtaagttacctgagaagtcagccttcttcttcgtttcaatgtgcttcaactgctggcccagatcacctcctctttcctgattcccatagtgtctcttctgctcttcagcttctactctcagacagaagttctgctgttcagagagtgtgtgtgcccacaccctggaaatggaggaatgaggggcttgttctgggaatatgtctacttctgattggaagaacagtgaatgagattgaggtttcctgaaacaggaaactgttttggagttcagcttccaccaggtgtggtagagatttgcctactttcttgtaccagcctagaaacttaaattctctggccttttgttgctgactgtcaaggatcactttgtttttctcagaggagccagggcccatggtttaaataaagtcacccattaattgtgtctggtaaacttttaagggttaatgtgacacaccaaatttatatcacatacctaagaacataaaatcagaaggcttatgggagtgaggcccagtggtacttggagctttgggggaaagaaaaaagggcatctctgttataagagttcagcaagttgtgctcactttagcggcacatatactaaaattggagcagtacagagaagattagcatggccccatgtacagatgacatgcaaattcacaaagtgttccttattaaaaagagaaaaatatccgggcgcagtggctcattcctgtaatcccagcactttgggaggccgaggagggcggatcacctgaggtcgggagttcaagaccagcctggccaatgtggagaaaccctgtctctactaaaaatacaaaattagccgggcgtggtgacatatgcctgtaatcccagctactcgggaggctgaggcaggagaatcgcttgaacccgggaggcagaggttgcggtgagccgagatcgtgccattgcactccagcctgggcaacaagagcgaaactccatctcaaaaaaaaaaaagaaaagaaaagaaaaaagagttcagcaagtttaagtacaagctacccttggaattgggttataactgaaccgttttgggggaattttgcagcctgggtccaggtttatagaatttagtgaacaccaacagagcctacaagccttctggtccaagaaccaactaaacctcacaggatccacaccctgtcttccaagactgaaatatgatggagggtcaggctagccctcctgggctcagtgcagactcaacagaacccattctcatccaccttgctccatgtctcgggggacatcagccctgagaattggtgtgtgagatagcaatttttcaggcccaggctgaaaaagtaatgagtaggattaaaatagggttccccagggtggcatggcaggccaccctggatttcttggtgtccagtttttcgcttctccccgatccaggccagctgaggagccatgtttagctcatgctgaagagagaactactcagctcttggaaaatgctgagctgggtattcctgcctcttggctgagctaaatactgggtggtgattcagcagaaaccccagctccagcagctggcgcaggagctaacaggataagaaggaaggggaagagagagccaggaaaggaggaggggaggggatggggcagtatgggcaggagcttagctggaagtgtttggtaaaagctgtgtgcctccaggagcactcacagccctcacagcttctctgcaccctcctcctctgctggtgtgtccttggaagagagaggcccttccggaaggctcagagcacctcctctcctttggagggggttccgagatttctaaaacgttgtaagtgcttcgagatgaaaagggctggagaaggggaaatgttactatcgtgcgataggcaagatctgtttcaaaaccacactccccactgtgcactttatagaagctgggatcaaagcgcagtttatgaggaagggctgctttgatttttttttttttttttttttgtctgttgtgtggctttttgtgggttttttttttttaacgtttttctctttcaccagtcaagttatatgtataactttatcagacaagttatgttacatgtacaataatccaggtgcggaaggactttataatgtgggcccctcacccgctctaaaaaatgtcttgaggtgggggtgggcggggaatagagaaggattctaggagggttctgtgaagctggatccgtgtctgcccactcccccacacctccaggcctctctgggtctttgacgaggaaagactgttccgtgtggcctgcgtgggcagaactggaaccttatcagagccttgggttgtgtgcgttagaggtcaaacaggcctccgtgttttctttgcctatcagcgccttttggcagccggcactgcttacctcctagatctggaaacgcctgcggttggacaggccaagccgaagcggcttttccacaattagaaacacgtgctcagttccttccacaagcgggggaggcggccaaggaactcggtgcagccaatcacagagccgagcgtagccacacccacgcccccacaggcccggcttccctgcccagcggctccaacctccagcctgggcacccagacccagagggctgctgggagggacatgcctcaccccttttgctccagctggaggggagggagtctgtgggagctggccagagcgtggcagaaggcagagaagtgaacgccccagcaaaaggtgaggctgagaagccaacccttctggcaggccatgacccaggtgaaatttatggcgtttcagagggctggggagctccatccagaaaggtgcctgttttgcaggtttggagaggaacagggcgttctgatttctacaaagtggcgtcactgcttcctttttcagcaaccgtctgcttagtacattccatcttgctgttttcagtcctggcctctctctgttctgctcctctcaagccctttttctctcccactcatctgcattgtcctccccttgctctctcccgccctgtggtttcttgtgctctttccctctcttcttcaccatctgtctttatggactttggcaagtctggacatttttccccctttctactgcctgttttcacttatctgaacagacaaggaggagtggcctggttctggaaatgttaaaggaaaaccaagcctttccaagccagtccagtccactcctgagaaaggtgcaagccagcgagaccgagaaatccaaatggagttccgggagtttggagggaacatgtgactgtgacattgattaagggggctggtgggaggggacccaaggtggagatccctgtgggaaatgactttctaaagccctgggagcaatggatgcacctttcttggtttctgaggcataactgtgaaagtcttccccttttgccatattggcatcttccttcctgctgcacagaaagcagtccaggctggggctaaccagtgtcttggtgacagacccagagtcccaagtggcactggcagtagtgaccatgggtaccactgacccaagcaggaggagagatgatgtgggagcggccaagggaaagcagagtgatctgtgtataatgaaggaaggcggggcagaggcagaacaagcaactgggaattgggctgtcccagtctggtctttgctgcgaattagctggggtctaaattcactcacatataaaatgaggttctggggccgccatggtggctcacaactgtaatcctagcactttgggaagccgagtcaggcagatcgctcaagcccaggactgggaagctgcagtgagctatgatcatgccactgcacttcagcctgggcgacagaatgagactcccatctgtaaaagaaaaataaaatgaggttctgggtctctaaggtcattcctgccttctgatcacccatgaggctggacacaagccttgggtggtagggcgcaggcttcaaatatttacctctagggccaagagttgactacaaggagagtcccaactggttcattcttcttagcactgtccttataacaaccaatccagccccgtatccaggtggccctatcccaacctttaccctgtcagaccagaatagtgtggctcatcgagtggcagctggcttagtagaagaaatgagattggttcagggatccatgtgggaatgttcattggctccctgagggaggcacaaaatgaccccctgctggcccagctcaatgagaagccagagtcctgtatccaaagcaagggagcacctgaaaacatcaccgggtgtggcggctcatgcctgtaatcgcagcactttgggaggccaaggcaggtggctcacttgagcccaggagttctagagaccagcctgggcaacctggcataacccgtctctacaaaaaatacaaaaattagctgggcctggtggcacacacctcagctactcaggaggctgaggtgggaggatcacctgagtctggggaggttgagactgcagtgagccatcatcatgccactgcactccagcctggatgacagagtaagaccctgtctcaaaaaaaagaaaacattggtggctcatgcctgtaatcccagcactttgagaggccaaagtgggcagattgctagagctcaggagttcaagaccagcctgggcaacatggcgaaaccccatctctaccaaaaatacaaaaaattagctgggcgtggtggcacatgcctgtggtcccagctactcaggaggctgaggtgggaggactgcttgagcccaggaggcagagattgtagtttgccaacatcaggccactgcattccagcctgggtgacagaatgagactgctctcaaaaaaaagaaaacagttatcaagtagtctctctctgggaataacgtgtactcttagtgagctttttttttctttgcttttgttttgttttgtttttgttttgttttgtttgaggtggaatctctgtcacccaggctggagtgcagtggcacgatcttggctcactgcaacctctgcctcccaggttcaagtgattctcagcctcccgaatagctggcattacaggcatgctaatttttgtgtttttaatagagacagggttttgctatattggccaggctggtcttaaactcctgaactcaagtgatctatccgcctcagcttcccaaagtgctgggattacaggtatgacccactgtgcccagcaagctttttgcttttttttttttttttttttttaagagacagggttacccaggccagcatgcaatggcacaatcacagcttactgcagccttgaattcctgggctcaagtgatcctcccaccccagcctcccttgtagctgggactacaggtatgtgtcaccacatctggctaattttctgttattttttaagagacaggatcttgctgtgttgcccaggctggcctcgaacttctggcctcaattgatcctcccacctcagtctctactgtcactgggattacaggtgtcagtgactgtgcctggctgtactttgtgagctttcctagaggaaggagagacagccacaatatgtaccctctccccacaactctgtctggcatccggggcacttgctggccttgcttcatgggccatcctatgacatattaaacctgatatttactccctagagcagcacggtggcttctatgtgcaccctccttgaattttctgtgtagatgtatctatctgtcgtttccattcagtaagctttagcgcctactgtgtgccagacaggacctcaaggccacaccagccaccaggggattgtttatggctgcgtgtgcaccgctggctgtggacagtctccgtggggcctgaggagtggggcagcacgggcagcaaccgcacagctcttcagctttctgcagggtgttcctccctagcagacagaggcacgtgacttataagacctggtggtattttcttcactagtggaaactgaggcacgggaatatgtttgaccatctgggcttctggtccagtgcgttagcctgtgctccccagccccacagcctgtacctgtgacccactcccaacttccagacagctgggttgaaggaccccagagcaggtcatttgtgaaggagcatcctccagagaaaaagatgaaacagattagaaattgagaagggtcaggggcacgatgtacaatgtggtctgatgcatgatatggtctctaaaatccttcaaaccattcccattccccgccactctgctttgcctgtgagtgtcagcatgatcctgagcaaatcacatgctcttttttactttcttagtctgcagtttcttaagatgaacaataaaaataatcatttaacattttatgcaacaatacacaggatacagagtatcgtcacatgattcaaatggaccataggttttacatggagaaaagggaggctcagagaggttaactgagagtacgtgactaagctgggaagggcaccatggccgctgagttcctcaagttcaaaagttctgtgattctcagattcagacctgccaggtccctctgagagagccgactctgcctccttcccttcatgctgctggtgatcctcctcccaattcttaccacttcacaccttacacaagctcctctgagctccgttcacttgttccacgcccgaaaaagactccagaaacccacatcatccttcacttaccaggtgctactaggtagagttgaggggaagagtgataagatcacagcctcagctctggacgattgcagggacttaaaaccagctccacgactccccaacccatccttaaaaccttctaaatgaagatttatttgtttatgctaatgattcattggtgttctatttcaaaaggcactaaagaaattaattttaaattgtctcttttacctataatctataatactgtcatgcattgcttaatgatggggatacattctgagaaatgtatccttagatgatttagtcattatgcaaacatcatagagtgtactgacatgaaactaggtggcatagtctactacacacctaggctacatggtgtaacctgttgctgctagtctacaaacctatacagcatgttactgtactgagcactgtaggcagttgtatttgtgcattaaacatatctaaacagagaaaagatacagtaaaaatatggtcttataatcttatgggaccaccaaggtataaatagtctgttgttgcccaaaatgtcattatgtagcacatgactgtatattgatttagggttaaaaatgggttgactgagcccggaaggatacaggacaagctcttccaaggtgtttttggtgttgtctaccacaggacagtacacggtggggccactctgtcccctctgatgtgaagagtgtactcagactcaggactcttgggataataatctcgtagctttctatcttgacttcttttatggcctttgattgtggcttctggccagtgaaataaggagaccaacaaaatcatgggggcagaaaataaaggattcatgtctgtgaacatcctggcactccactcgccttgcaagaagttagtgattcttgggccagtgtttgcgtatctgggttgtgtgggtgggcctgaagttgtaaggaatacaggggagactgggggagaacctggattagatgaaggagggatattgtatcttttgccctggatttctctaaaaggaaagaggaaaaacactgctagagttacaaggcaaggctgtttgctactgtattgaattaccaaatggaggaagaggaaataggaacactctagctgtgggatcccaactagggttgggaagctggaagaagtgcgaagcggctatgtggtgtggaactttgctaaccaggtgaacacactagtgacctcaccttcactaccctcttctagagagcgccatcccttccctccatctggtgtcccgcaaggcctgtggacagacactcttttgggctcctggtgtgtgttgcctggctgctgtttaaaagcttttctctttaagggtatgtccctgctgtctggtctttctgtataatgtctgtctggtatccatttcctattgctactgttacaagtaaccacaaacttagtggtttaaaactatgcaaatgtactatcttagtcctgaaagtcagaagtcctaaactctagcgtcagcaggcctgaatttcttcaggaggctctggggagaattccttgccttttctagcttctagggacctcccacattctttggctcatggccccatctttcatcttcaaagccagcagtgtagcatcttcaaatctctctttctctctgtctgatgtttccatgatcacatgtctttttataactctgaccttcttgcctccctcttgaaaggactcctgtgacaacactggtccctctggataatccaggataatctccccatctcaagatccttaacttggctgggcgcggtggctcaggcctgtaatcccagcactttgggaggccgaggtgggtggatcacctgagttcaggaattcgagaccagcctggccaacatggtgaaacccgtctctactaaaaatacaaaaattagccaggcgtggtggcggacacctgtaatcccagctacttgggaggctgaggcaggagaatcgttttaacatgggaggcagaggttgcagagagctgagactgcgccattgcactccagcctgggcaacaagagcgaaactctgtctccaaaaaaaaaatccttaacttaatcacatttgcaaagttccttttgtcatttaaaaaacatagtcacaaatctcagggattagaacgttgatatcttggatggccataattctgccttcaactgccccccatcccaaagagatctgctgtcattgccaaggggaggaagtgaaggagagacttctgtaattcctggagatcaaagtctgggatcagagctgggatggggctgagggcaccttctctgtagggaacccagcgctccacagtgagcaagccagttgcaggtctgcagcgaggactctgaatccctctgccagtcctgcagaaagcattgagcccatctctcctgcttggcagctgggaggccctggactctgggcagtgttccaggttgctagaatctgagttttcctcctcctgcctgactcattatttgtatctcttctgtcaccttgatgttgagttcttcaaactgggtggattaagtaaccagcccctgacttcagcatcttcttgaactcttgtcttcttaatagtctttcatcttattttttacccaggaagcaagaaagaaagaggggaggaaatgcccaaaaaatacatacaagcctggaattccatgagggcctctaaagaagcagtaaccactcccgcaactaggttacaatggacaagaaccagtcttatgactttttattttgtccagttggaccaggattataaatttctccatgttgccagggtctcctcctcctatagaaggcatctctgattcccctgggctgagttagtggttcctcatagatgcccactagcttccgtgaatagctttgccatcacctcgttgttttgtgggcatctcttacttcacccgtcgtccctgttatactgccaacttcctaaaggcagggacttgtgtcttatcaataacctccccaccagctagaatgcctagtacatgtaggccctgcatgaatgacggatgagtagatgggtggatggatagacagatggatggatggatagatgatggatggttggatgggtgggtggatggatggatgatagatggatagatgggtgggtggatggatgcatggatgatggctagatgggtggatgggtgaatggatcggatggatggatggatggatggatggatggatggataaaaagcccctcacatttcaaagctgctatggccaatgatcctcatctacatgtggcttccctgaggtcactgtgtctcaggaatgcggaattcagggtctagccgagaagagagggttctagaatatcatcgtccgcaacagacaagtgccaagcagtagctagccagcagcagggctcctgaccggggcaggagcttggcgagcacccactgacctttcctctctgggtggaggctcaggtttcagcctgctgtgagggaagctgtcttgtggtaccaggagactgataccctctttcccctcagtcacatggtatgatcacccaactgcagggtgaagggccagatctggggcctgcagccattgttccaaggagattaggtgtcacaggcagcctgcctatccccacctcattctcagaatttcttcttgtttctgaaagattactgtgaaggtgaaaggttaaatattagtcaagggctgagttcttgggaagtgatggagataaggttaggcaagacagaagatagccacagataggttattttacaaagcatccctatctctgttaccccaggaagaccacagagctgatagtttgaaggtgtctttctgtgactcagtaaggtccatcttgtaaagagatgatttcatgttttctttcccagcacacagggaggtggtctgcttgggggaggaggaatttctttgagttgtcctgctctgcccttattttcctcaagcactttctgtcatttcctcgccctcccctctcctccccttggagaaggattttcttccctgagatcaagatccagttccttgttgtgtaatccttacctatccctgaggcttatggggtttgtttcctaatcttccttccttccttttatcaatctcctttatccttgagttactgctgtgtctgcctgaattcctgggtgaaggggcgcagccttgtaccttgcatgccttggggcctagggaagaagctgagatcacagacccagttgtttagagtgacttaggttggcttgtcaccaggcacatgatcctgaaatccttattgaattgagtaagacaaaccaaatgtgtatttatcaggatgtcagtccgtctggaacatttgagtatttacaaagtgttctccctgctcgggcacttaaaatccttcctctgacaacatgttttgcttctccttgcatgacatcatcttggataatagctcttccatgaggagtcaggagcttctgctcttgaagtcaagttccctgttgccctttggcaacatgaagccaactagggattgtgtctccttttgatggggttcctggggagcagaagaggttgatgtgcgctgtggaatgtgtagactgagatgatattggaaggctaatgaattgtgatattttaaaattcatttattaaatacttgctgagcatctactatttgcaggcgccaatgataagtcctgagatttaaaaacatgaaaacatttacttgcccttggtgtcttaaaaaaaaaaaaatttttttttcttttttttttgagatgtggtctagctctgtcacccacgctggagaacactggcacaatctcggctcactgcaacctccgcctcccgggtacaagtgattttcctgcctcagcctcctgagtagctgggattacaggcgcgccaccaccacgcccagctaatttttgtatttttggtagagacgggtttcactgtgttagccagactggtctcgaactcctgacctcatgatctgcccaccttgacctcccaaagtgctgggattacaagcgtgagccaccatgcccggccagaagcaggtcattttaatacaaagaaatgcatcccggccgggcggtggctcctgcctgtaatcccagcactttgggaggctgaggatcatgagatcaggagatcgagaccattctggctaacacggtgaaaccctgtctttactaaaaatacaaaaaattagctgggtgtggtggcgggcgcctgtagtcccagctgaggcaggagaatggcgtgaacccaggaggcagagcttgcagtgagccgagatcgcgccactgcactccagcctgagcgacagagtgagactccgtctcagaaaaaaaaaaaaaaagaaaaagaaaaaagaaatacatcccaacattagatataaacaaagtggtctgggattgttctagagagaaggaacaaactttgttcctcgtctacaaaacacagctgatatatcttcccttgcaggcatgttgttaggaataaataacatgctgaattatagagattcacagaacaggtgacatttaagctggatcttgaaagaggagaaggggtttgccaggtggagatggcgcacaaaggaaggttacagacggttaatgtcaggaccatcctaccctaaccaaatgttctcagcatcaaataaggttgggaaatacttggaaagtagaagtaccatataagaatacggtactgataaaacttgatcagccattcaagtgaagtcagagcgaccacaccacccagcttatttttaaaattttttatagagaattacaactccccatgccaccaaagaagatttgtaaatggatggtaaataagcacatgaagagttgctcaacatcattagccattagggaaatgcaaatcaaaaccataatgaaatacaactacatgcctattagccaaaaaaaaaaaaaaaaaaaaaaattgtgtttaaactgacaataccaaatgctgggaaagatacagagcaacaggaactctgacatgagagtaggaatgcaaaatgagacagccactgtggaagacagtttggcagtttcttagaaagttaaacacatttactctatggcccaggatctcattcctggggatttactcaagagcaatgaaaaccccactcaaagatctctacaatccacaaaaagaaaaaagacatctacacaagtatttatcacaactctattcataatagtcccacactgtgagcaacccaaatgtctatggaaaaacaaacagatacctttatatcatagaatgctatttggcaatagaaaggaacaaattgtaatatatgcaacaacatgagtagatctcgaaagcattctgtgaagtgaaagaagccaaacacagaagaccacatattatatgattccatttatgtgacattttgaaaaagacaaagctatagggacagaagtcaaagtaatggttgtagaggtaggggaagaagatttgcctaactgactacaaaggagcatgatgcaaaaggaaactttttagagtgttgggaatgttctatatatgaagtgctgaagtgattaagccattaaatgcatttgtcaaatctcatcaaactgtacactttaaaaaggtgagttttagtaagatgtagattatatctcaataaacctaagtaacataagattcccctaagcctctgttaccccaaaatcaggctcaggaaggtggcttcctgactcccaccagctgctcacagcttctcttgcacaaataataacttgaagacaaagcccatacttgtgccctgatcagatgtgattttacccccaaagccagtgcctacacttccatgcctacttctggcttccagccctcagcagggcatgctgggcccaagctctaatttgggacatataatccccatttgtaacccattaacctagccaaagtctctggtccctggggttgagcttgctggatgtctggctcacctactacaatgtcatcgtcaggatgagggagcagttctgcttgtgtgccttgggcatcatgcagccagatacagcccctgaaggtctgtttgggggtctttcatttcagtgctcctcacatgggtcaactgttccagtgtgcggtgggccacccgggttcaagacatcttcacagctgggaagctcctggccttggccctgattatcatcatggggattgtacagatatgcaaaggtgagtatcgcaggaaaaacaggtactgcccagctttcctccccttgcatgtacacaccctctcagcccagctttggaagtatgccacaccctgagatttccccaattctagccttgagtgacttctcttcttcttcccttgcttgacaaaagggaaggagaaaccattttccccgaggtggctgggagtagggaatgctccctttaggctgcaaaggtcacctctcccatgcttacctcaaggctgtagcacagctaggtaaagaccccacatatcggccgagtgtggtggctcacacctgtaatcccagcacttaggaaggatgaggcaggaggatcacttgagcccaggagtttgagactagcctgaacagcacagtgagatcccatctctacaaaaaaatttaaaaattaatggggcatggtggtgcatggctgtggtctcacttactctggaggctaaggtgggaggatcacctgagcccaggagtttgaggctgtagtgagctatgattgtgccactgcactccagcctgggcgactgagcaagaccttgtctcaaaaacaaataaacaaacaaaaaccccagatctctagattcctattgtctttttgccccaaccccagggaagctccctgcatcttctgttgaatcttgtccacatcttaaagtggaggacagagaaaggtattttatgtttcaaaattacttataatctctgagagagagagctctgcattcccggggcccctgccaacattccccactggatttggccctttccaagcctgaggctatatttggtttccatgggacccatggcaccatgaggctctgcccagcgtcactgcctcacggagaaagtcaggtgacaaacagggaaatttcccacaagccctgaaggcagtgtgggcagcccggacttctactccaggaaacataattaagtttctgctatataatatgcctgattattttaaacagttggattaagttctttaacaggttatatattgctttcaggcatttagacttaaggaaatcactgcgctatcttgtcaaaaatagtgagtccctcctaagctggcctcaattctttctcctggtcacactaatctccttatttcctgtcccaatgctaaactgcagatgaataagtaacatatgatcagttactctctatctcattgaaattttagccagtcagcagatgattccaagggcccacagtctgcagcacactgtgctaggggggctgggaaggcagtttaaacagctctttgcttaaaaattcctgtccttggggaatcttgaaaagagagacggccaggcatggtggcttacgcctgtaatcccagcactttgggaggccaatgcaggcagatcacttgaggtcaggaattcgagaccaacctggccaacatgatgaaaccctgtatctactaaaaatacaaaaaaaattagccaggcatggtggcatatgcctgtaactccagctactcaggaggccaaagcaggagaatcacttgaacctgggaggcggaggttgcagtgagctgagatcgcgccactgcactccagcctgggcgacagagcgagactccgtctcaaaaaaacaaaaaagaaaagagagaccaaacacacacctcagaaagagataggaggatatcaacaaagcaagcagcaaaacaagcttgaactaatatagcattatggaaacttatgtttgagtgtttgttgttctggatgcttgctttttttgtttgtttgtttttttcttttttcttttttggagacagggtcttgctctgtcatccaccctggagtgcagtggcacaatcatagctcactgcagcctcaaactcctgggctcaagtgatcctcccaccttagcctctcaaataggtgagcctataggcatgcaccaccacacccagctaactttttaaattagtggtggagatgggggtctcactatgttgcccaggctggtctcaaacttctggcctcaagcattccttctgccttgacctcccagattgtttggattacaggcctgagccactgtgcccaaccctggatgcttcttcatgaaaatgtagaaacttagagaaagtggtcaggagattaccaatgactccaatcctgtatttccaaagcccaatttaccatgtcctttccttttaaataactttgccttttacaaaaggagcattcagaacggcacttaaaccctcatttggactcgtagtttccggggtctcggaagccctggacctgaaattccctgctccctttatcccaatttatccaatatgttgggttcactggagacaagacagagttggtgtcattgccacagggaggggagagaggtgggccagggcaggccaggggctgctgggcccctgacttgtctcactgagcggcctcctgttgcttgtgtccacaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagtgagttgaaagagcctggctattccctctcccttgaagggccacagcacctgctgctggaaagagggagcaggtgtccattgcccacctcgccttccaaagccccattctaactgtgatttgatctatcctgaagtcgtagttcatttcccaggcacttaaaccatttgccgttcaccccaccaggaggaggaaaggatccagtgactttcccagagcagattagaagctgaaaactgtcctgcagtaacactactgccttagagaatgaattgtgccctgagaggcttctgggaatcttgcttgtttcaggacaggccggtcttggtgtcttgaggcagggggaaaaggtgcattgtggagattcaggtcaagatcaacaggtgtggagcgtatttccaacctgagttgttttattgccttcatttttttaacttattttttcttttgttttgttttgtttttagacagggtctcaccctgtcacccaggctggagtccagcagtgcagtcatagctcactgcagcctcagtcttctgggctcaagcaatcctcccacctcagcctcctaagtatctgggactacaggcacatgccaccatgcccagttaattttttaatttgtaaagaagaggccttgctatgttgccagggctggcctcgaactcctgggctcaaacaatcctccctccttggcctcacaaagggctgggataataggtgtgaaccaccacgctcagcctcatttcctttaaattatcctgcccatattgagacaaagcccacctcccagggaaaggaagcctcacagaaggctgtaaggctacacgcatgcagaaagacagaagacaccccctggactccatggcaaggcgggtgtcccgggtgccagcccttcccctcacctcctctccctctacaggaaccttcccagagccatcttcatctccatcccactggtcacatttgtgtatgtctttgccaatgtcgcttatgtcactgcaatgtccccccaggagctgctggcatccaacgccgtcgctgtggtaagaaatgaaagtcccagagtctcataccaggaatgcagacatagacttgcctgctgtagccccactcacttttccctgatccatggccttgtggaagtggaaatcacccccaagttctcagggcagaaaccacatatgtcattggctggggtatctttaagtgcccaggagcaaacaggtggctgggttgtacctagaacagctacaatggcagaaccgagtcattgccacagagaccgcgtggcctgagaagctataagacatttactatctggccctttacagaaaaagtttgccaactcctagtctcgggcacttaaagctctaaatgtgagagtggtatgaagcagacaggcccctcctcagaaagacataatcttgcacaagacatgccttttctctctgccttctcctccagaagcagaagtcaggtgtgctctttggggaaagagaccatgctggtgcaaggggttgggatccttcacatctaagaaggacctgggaggcaccttgctccctcacctggcatcaggctgggccaccacccagcctgccagtctcttcactggccttatctcaaaagactgtaaagaaagaggtcctcccatctcctggggcagcctgttcttatgaccaacagccttctattctgaacaatctctccttggtaatgtgctgtaaacctggctcagggaatatagaaaaggctggtctcctgcattgtatagtccttaaatacatgaagattcatctatagcttcacagccttttctttctcagactaaggaggggctcattcctattattttacccccaactcatctgttttgatgaattgagaaattctcaccctgtgattctggattaatccctattttgcagttgggagacagaggctcaaaaatcataaactttgctcaaggtctcacagctcctagctggagggcaaggatttgagcctggatctgcctgacagatctgcctgacaagcctgtgcccttccctgtgctggagaaatcatataatgtatgtaaggcctggatcacaccacctggcttccaatgctggcccctccactcgctgggtgtgtaatcttaggcaagctacttaatcactatgtgactcagttcctcacccataaaacaagattagtaagtgttagttcattattattattaccagtgtgtactacctccttcagttaattagcctaaaacatgcattaaccaccctgtgtaggggtccacccttgagagggtgggggcaattaagaagcttggcgagagagaattagcaagggtggagataggagaaacggtttcccagagtgaagtgggagctgaggggtcggggagtggtgacctctcctttgcttatctccttggttcctctcccagacttttggagagaagctcctaggagtcatggcctggatcatgcccatttctgttgccctgtccacatttggaggagttaatgggtctctcttcacctcctctcggtgagtgctgcctgggcccttccccggccaggggccactctgctgtgcactttgctatttgtatatggtgggcttgtctctgtcagcaggggtctgtgtgggcatctggatgttgggcttgcagaggggtgactgctcacatgagggcgtgtgtgtcagtgtggatgctgaggagtgtgtgctgctcacgtggtcacctgcgatgtgtgtggcatacgggtcctaggtgcttcacatgtagtggcctgtctcatttcaaaaggagcagaagacagaggaggccgccagcctgcctgacgccgcccccagtcagtggctgtggttggcagcaaggcagtatcttggctgcagtcctgtacctgtaaacaggctgctgctggctagaaaagaaccccatttggaaagggaccaagagggagacttgtgcctggggcctctgggtctggcctcccatgaatgttctggaactagcctgcaggtgggatggcttcaccctgattgccccaagaatgcagagctcctccctgctcaacagagaggtggctgtagaggcctttttgaggccacccatgagactcaggtggagaatgtgaagtgagagggtggggaaaagtggaaagcaaacatttgtccaaagaaagagccttttatccgtgacccccaccccagagcactctcagaagccagaagtgcgagcgggtccacgagtcccaggtcctgcctccatgcatccagggacccggccctttcttttgctgtcttcagaaggggctgttgaggctagcagatgttgaatgacttccatttgtgtggttcaagggatcctcccaggttcttagaaagcacccgctgccctcagaaagtacagtcctgctccaaagatgagtccgtgagttcagctgcttccaaagccgtcacatcaggaagagttcctgtgaaataacaagggagtgcaatgtttttaggacccagggctggaaagaggtggtgtgggtgtcccctgtaccccgggaccctgtgacgctcacccacagcaacctcgtgtgcatgttacacaggagcagtggccacacggaggccccgccgaggccaagcggtggaggaacagtgacccgtgaggctccctgagatctattggaggagagtgactggctacagtcactttagagtggggtttgtccctcaggcaggcctagcagcggtctgcgtgcatgtggtctagtcgtgtgtgcatgcaggaaacggtggcgcatggtgtgctccacctccgattcagaggccagacctcacccacccaggcctcccctgctcatctttccagttccttcttccttccttctccttccctccttctttatctctctgtcactcctttgtgttctcgggtagggagaggatgatccttcctgaagagtcagagtgtgtggatgtgtgttatgcttaatgtcatcgtctcctccgttatcggctagctgggcaaggactgtctcttgtgaacctgacacttgcaaatgctgttggatctggacaattacacttggtcttgtctgcatgtggaggggggacgtgagtgcaggaccctggctatgtgcacgatgagccccacagagcacctggtgcatgagactgccctgtagaggggcagtagcatgggagaggggacagggatgtgtatggctgcatgaaactagtgacaccggcctagggagttcatgatggttactgcttatgggtacttggggatacagtcagctcccacacttctgattagctgctgctgttcgcttcagtctactccatacacaaattacaaagtaaatgactattctcctctgaactcccagtgtgctgaatatgtgcctttttgttcctatcaagctgtaccctgcctgtcatcccttaggtgggcctttccccagaaaaaagaaaaaagtggtccaatttgcactgacatgtaaattactgttgacagcttctaatattcacttttctcttaggagagtaaaagggaaggagggctgatttttatgttcaagtttcatattcatatgtatataatagatgtacatattttcaagctacagatgatgtttcaatacattgatataatgtgtaaaaatcaaatcagagtaattgagatatcccatctccttcaatattgtcttttctttatgctaggaacattcaaattattctcttaaaatttttcttttttttttaaggcagagtctcgctctgtcgcccaggctggagtgcagtggcgcaatcttggctcactgcacactctgcctcccgggttcacgccattctcctgcctcagcttcccgagtagctgggactacaggcgcctgccaccacgcctggctaatttgttgtatttttagtagagacggggtttcaccatgttagccaggacggtcttgatctcctgacctcgtgatccgcccgcctcagcctcccaaagtgctggaattacaggcgtgagccaccgcacctggcctaaaacttttctttttaaaaataacttttatgtccaggcgcagtggctcacacctataatccccagcactttgggaggctgaggcgggcggatcacaaggtcaggagtttgagaccagcctagccaatataatgaaaccccacctctactaaaaaaaatacaaaaattagctgagcgtggtggcaggtgcctgtactcccagctacccaggaggctgaggcagaagaatcacttgaacccaggaggcggaggttgcagtgagccgagatcgtgacactgcactccagcctgggcaacagagcaagactctgtctcaataaaaataaaaaatattaaaaaaataataacttttagggctgggcgtggtggctcacgcctgtaatcccggtgctttgggaaggcaaggtggaaggattgcttgagcccagtagttccagaccagcctgggcaacaaggcaagaccttgtcactacaaaaaattagcaaagaaaaataagtaaaaaataaaattgatttaaacatcaatatcctagttgtgatattataatataattgtgtagcatgttaccaatggaggaaactgggcaaaagatacataggatctctccttattatttcttacaactgtacttggttgtaagattcactgaatgcaaatctacaattatctcaaaataaaaagtttcattttttaagttaactgagcacggtgatatgtacatgtagtcccagctgctcaggaggctgagactagaggatcactggagcccaggaattggaggctgcagtgagctataatcacgccactctactccagcctgggtgacagagcaagaccccatctctaaaaattggaaaaataaaaagtttaattttttaagttaaaaaatctttattctgattataaatattccatctattttagaattttattcattttttccttttccttatcttttcttttttttttttttttttttttggagacagggtctcactttgtcacccaggctggagtgcagtggtgcaaatacagctcactgcagcctcaacctcccaggctcaagtgatcctcccacctcagccccctcagtagctggaactacaggcacgctctaccacgcctggctaatttttgtattttttgtagagacagggtttcaccatgttgcccaggctgcattttgcgatttttaaaattttttctctaatgtataaggaagaaaattaaaattaaccataatttcaccacccagagacagttagcattttaataaataggcccataaataatcttaaaattaattggcatttgggtgtggtggtgcacacctgtagtcccagctacttggaagactgagacaggaggatcatttgagtttgggaggtcaaggctatagtgagccatcatcgtgctactgcactccagcctgggcaacagagcaagaccatgtctcaaaaaaaaaaaattatttgcattatagttttcagtcctgttttttcatttgatgttatattttgagcatattctcatgtaatcaaattttttcaaaaacattatgactacataatgttcccttttttttttctttgagacagagtttcactctgtcatccaggttggagtgcaagggcatgatctctgctcactgcaacctccaccttccgggttcaggcaattctgcctcaaccttccaagtagctgggattataggcacgtgccaccacatctggctaatttttgtatttttagtagagacgaggtttccccatgttggccaggctggtctcaaactcctgacctcaggtgattcacccacctcagcctcccaaagagctgggattacaggcatgagccactgtgcctagcccataacatttcatcttatgccaaattcattttatcgacctcttacttttaggcacttacgatatttccaattttttctttctctttttttttttttttttttttgagacaggttcttgctctgttgcctagggtggagtgcaatggcacaatcacagctcactgcagcctcagcctcccaggctcatgtgatcctgtcacctcagcctcccgagtaattagaacaacaggcacatgccaccacacctggctaattttatttttattttttgtagagacaagggtccactattttgcccagactggcctcaaacttccgggctcaaatgattctcccgcctcagcctgccaaagtgctgggattgcaggtgttacccaccgtgcccagacaggatataattttttttaactcaatcccacaagacaggatataaatttttaagtacaatttacatacaataaaatatgcaggctgggcgtggtggctcatgcctgtcatcccaacgctttgggagcccgaggtgggaggatcattagagcccagttcgagaccagcctgggcaacatggcaagaccctgcctcaattttttttttaaaaagcagatcataggctgggcatagtggctcatgcctgtaatcccagtactttgggaggccgaggcgggcagatcacctgaggtcgggagttcgagaccagcctgaccaacatggagaaaccccgtctccaccaaaaatacaaaaattagctgggtgtggtggcgcatgcctgtaatcccagctactcgggaggctgaggcagaagaatcgcttgaacctgggaggcggaggttgcggtgaaccaagatcgtgctattgcactccagcctgggcaacaagagtgaaactccgtctcaaaaaaaaaaaaaaagcagatcataaatgttcattttgatgagttttgtgggggtttttttgtttgtgtttgttcatttttgttttttattgttgttttttagaggcagagtctcactatgttgcctaggctggctttgaacttctgggctcaagcaatcttcctgcttcagcctcccaagtagctagaaatataggtgtgtgccactgtgcctggcttccatttgatgaattttgacagttgtcaaaattcaaccactacccaaaacaagatagagaacatttccaccaccaattccctactcccacaaagacaactaactactctctgactaggacaagagtgtttttaggccaggcgcggtggctcacgcctgtagtcccagcactttgggaggccgaggcaagtggatcacgaggtcagcagttcaagaccagcctggccaagatggtgaaaccccgtctctactgaaaatacaaaaattagctgggcatggtggcacacacctgtaatcccaccttctcgggaggctgaggcagagaattgcttaaacctgggaggcggaggttgcagtgagccgagattgcagcactgcactccagcctgggcgacagagtcagactccatctcaaaaaaaaaaaaaaaaaaaaaaatagagtgtttttaaagctttccatatgcagttcagtcccagtgtattagggaatctgcatcctttgaggatgtgaggaatgcttttaaagagatgaagattttaggcaacagacagaggctgctcctgcagccttccaggcattgggaacaccccactgagtgacagtacaattatcagtaaccctgagccacccataccacattcagggtctaacatacccagggttcatccacttttccactggctgcctctggtttgcttgcacctgcatttgtgaacacaggttctgtgactggtggggtggaaagtatgcatgtgaaggcgggtgcctggttggagtggggatgcccctgtgtgggcagaaggtaggcaaggatgaaggagctggggcttggtggtccctgggttatcccaggctgacctgcttttctccctgacaggctgttcttcgctggagcccgagagggccaccttcccagtgtgttggccatgatccacgtgaagcgctgcaccccaatcccagccctgctcttcacagtaagggcccttcctgctgtaactctccacacacctccctctctttgtgcctagtctaagctgggagttcatgcttttcacacacacccctgttacccttgcagtctgctgctaggtctcactggatcttagaggatctggcaaatgatacccatcatctttgttaatatcaagagatatagcaaggaaagatcctgagtcttgaaatacctaaggctctcaggctgacttatttccgttctcccatccttttgggtcagactgaactgactgtctcaggattctacagcctcaaaaaaaatatatctcccttggctctcctcgcacctgttaccacagggttgcagcactggcctctgctcctggctggttggtccctgcaaacacccacttcccccatcaagcttcagggcagcctgccagtctcttgggaaacatcattgaaatgaagttagtgttaacagtacaccaaatacgaaaaataatagaggaagactgataaactggaaactgtgcaaaggaaacttgggacaggaaagagatgggagtaaaatatccccagagtagaatcattttgagagagctataggaaggaacaaagacttgtccccattgagtcttttgagttatttttattttccttctggatcctgaataaaacactaaaaatgactttggtccactggtgaagcagttagcaatcagaataacagagctcttgggagccaagagcattttacagcattgctgtacaatttcagaatgttcagatgcaggatgaaggtcaccttgactggttggttgtcgaaggtggctggagaagacagtactcccagtgggccacacacatttttttgttttgttttgttttgttttttccagttagagctattggtgcagtagtgtgactaaaaggcagatgtagcaagaaccattaaaatcttctcgattattttaaccatcggatctcacaagagaacagaaccttttgttgaccttcacaagttatcagaggggaggagcatggttccaagagagccacagagatgattttgaagttggaaagtagactctgtcaagaaaacctcatagggatgttatgagggttaagtgagttaatctttgtcaaatgctaaacatagagacctggcacacagtaagtgctatgtaaccagttttgaaattaataaagaaaaggaaggaagaaaaatagatgactcagccaggagaaaaggatgagggcaggaatacagccttaatctgttgttaacaatcttccctaagggattttaaaaaaatgaatttagcttgagctataaccaacagaggcatacaaatgagaccggggctgacacagagccaggtaataccagtgtggccagtctagctgcttatgtccagtatccattctaattggctagtgcccgtgccatacgagtggttaaatattttgatcatcacccctgtaataagaaaggatttcctagcaataaagatgttgtaacatattgggttactaggggaggttctaaagtctccatttcgagacatccattatacgatggcatcatctgcctggaggctgggggacagcccctaatctgtaataccagtctctgaatatctttcggatcactgatgagctcctcccactttcccagtgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaaggtgagagaaactccctttggggtcccctccccttcctctatggttctagctgcagttcagatttttaaatcacctctgttcttagctgctgaccacacgtcatcatctctgatggtagcagaccctttggaaagcaagggccatttgtgaatgggaccactatttccattctccactggggatgagatcggagcagactgcagctggggaataagtcagatcaaatgtgactttcatcatgacattcctttgtttcctaccagtctaagccttaaactccagctgacttttcaaggttctcttatctccccaacacttcctccttgtccctccagatagctgggttcactatgtgctatgtctccatcccagaatgacttcctcctcccatctgcccatctacattttaaccattttccaaatgcgcctcaagtacctcctctttcttgaagtcttccagtctactgcaacctcccatgatcctccctttataaactcccacagtcctacacatatagggtgctcagtgaacctaatattgctacaagatataactctgtgataggaattaaagggattgctcagaacaggacatgctagagcattatgagttctcctacgaattagaagaatagagtgtactccagagctatttgaacaatcctattctagaaacagtgactagatgcttctagaagatccttccagctgaaaaatcaaaggctctccaaatctctcagttcctcactggcatttccaccgccattttctactctcacacttagaaaatctgctagagggaagaggaggtagaataaccccatgtccccaccacacacatcccttctgagcgaggaagacaaggaagagaaaggcagccgaatcaggactgcccctggagccctgaagaggatactctcaggaactccccacatgtggcccataaggagctgacatttgccatattgtgcccacataagggccctgcacagaagtgggcaaggaccagggagcctgagtgactcgaatcgtctcctgcctgcaccttgtgcattgccacacctcccctccaccctaggacctcagcagacacacccatgtgccagcaagcttctccatccctgtgggcttctctggctgccacgggcacatggcatgcatgatgaggccttgtctaaccacacccaagagcgaggacatgggcaaggaggatcgtttcctccctaactcctccccatcctcttcctgtctgaccgaccatgttcatcaacatttgtttatatagcccctgccctaccaggggtgagtgtgggaccacagagccgagggaagcccagcctttgcccttgaggatgtgtctctgtgggtgaagaagagagagaatgccccagtccctagtcctgggggccacgtggcctacacagttcatacgcctcatgcctctgctccacagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattggtgagttgttggaggctctggctggcttcagggcctcctgggctggaatgcagtggtcagtgatggggttggggagccaccagggccaggagatctaggctcaccttctcctcagtccacagagccctggaagagtccagagcaggggaagcagatgccttttcccagagacctctgagggtagagaacagctggcatttccacacagaccttagacccgcaagaataggcaacctgggctgggcacagtggctcacgcctgtaatcccagcactttgggaggctgagacagaggatcacttgagcccaggaggttgagaccagcctggtcgacatagcaagactccatctctgttattaaaaattttaaaataaaataggcaacctgtcagccattctgtgagagctgcccgaggctgggtggagaccagaggagaccctggacttaggggtcagtgggcacagggaaggtgggaaggctggggccttcataagcaaagagtagccggcgggagatgcaggaggcagaccaggtggcgaggattctcttcaacgcactgactgctctgaagaggcagaacctggagcaggagagccaggaagggccggggccacttggccaggttggtgggatactcagcattggcctggtttctgtgtgatctcttcctacagagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaagttggtggtgttggtaattaagtaaccttttgagacagagtcaccaggcatttcctcttaggagatcttgccaggttccttccagaatgacattcctaaaagctctcgctctctgtaacttctagctatcctagggactcaatgccagtgcattcaaaccactgactctcattctgaaccaaaaacatcaaaagacaaaagtacaacgaatttacagatctcaattgtttactgtaattctggaatcaggcaacacttcattccataaaatagaatacatattccaatgagttgagcagaagaggttggctttacagacagggagggctgaagaaagctggttagtcacttttcgaagttgcttttcttggccgggcacagcggctcactcccgtaatcccagcacttcgggaggccgaggagggaggatctcttgagcccaggagtttgagaccagcctgggcaacatagcaagacctcgtctctacaaaagataaaattagctgggcatggtggtatgtgcctgtggtcccagctccttgggaggccgaggccgaaaggaggatgggttgagcctgggaggtcgaggctgcagtgagctatgcttgcgctactgccctccagcctgggcggaagagcaagcccctgtctcaaaaacaaaaacaaatttacttttcttgtaaggtggggacagggagacggaacaatagaaaaataactgattagttcatatcaggatccttcaggctgccttgttttgtgtaaagattaaagcagagggaacttcattatcatgtccattgaatattgaaactggcctgttttaattggctgttatgtctctctcctgatttctaggaaggtcagataacaacttagtttagatttggtgatgtggaactttagcatgggtgattctattttgatttttagcctggtctgtggggcctagggcaggagcttagtccaaaaccatggccttctgtaattttttatttaacaacactgtctcactccttcttggagtcatgaagtgttattaagttcctgctctgtgcaccgtactgaaagcctgcagactaactgggaagaagtcaacattgcccagggtgggacatgggcaagggagagatggcatccagccaagttgagggaggcaaaggcagatgtcctcccaaagcctgatcagcaaaggcttctctcatcagcacagcctgagccgagtctgtggagagagtcagggtctgaggagcttgatgggagggcctgggaggtaaggctaggttcactcagctggacagagccatctgagaagaagagttagctctaggaggaagagtaggaggaccactggactaggacaggggaaaaaggaaaaagtcgttaaggtatgtataagtacttcctggcattttgggctaactgctagaggaagttgatgggattagccccagtccttgctttgtgtccctgtctttatgggccgccctcctggctgcgtgtcctgggacagtaccattccagagccagcactgctggcagatgtagggcaagggcgggagtaagggggtggtggaggggcagtggtgttaagacatcacccttcaccatctggaacactgtgaggacacaggcaggcaagatgccgccactcccagtcctggcctgacgccaacactcctgctttgtggctgtcattcttccagacaggctggaagctcgccattcaacagggacgctgagctgggaggcgggccactcaacagctgtgtgtccttgggcaagtcacctcacctgcttagcattttgagaaagaaagagagctggacctaatctcaaacagttcctcaatcttccaactttaggttgtcccaaaaggcagaggctgccagtcttgtccaagcctcacatgtgccctttgggcccctctttcccagcacacacacctttcctttcccttccctggactgccccaggctcctccctgttgccccatttga

SEQ ID NO: 16189 - DNA, 23792 bp, Human
cctccatctcccgggttccagcaattctcctgcctcagcctcctgggtagctgggattacaggcacccgccaccacacccagctaatttttgtatttttagtagagagaagattttaccatgttggccaggctggtctcgaactcctcacctcaggtaatccacccacttgggcctcccaaagtgctaggattacaggcgtgaactatcatgccagggctatatgtctgtgctttctaaacccaataaatgtgatgtaatattaatgctaacagcacacgtgatgggccagaaacatttctataagcccagcggctctgggcataaatttctagggatggtgaaccgaagaaacaaaattgtgtcattgaaatcagcttttcccaaccaccagtgtcttctctctctctctctttctctctcagtgttcacttattaatggctactctgtgccaagcactgttgctaaacacattatgtacaatttctcatttcattggtactgattttgacacttactcatccactgtcttttatcatgatgtgaccatttcctacaaaatgccctatgtagcttccaaccaaaataccacaaagcacaacttcagcagtcctgcctcttgaccttctcccaggctctgctctcgctcatctgttccatcctttgcattggcagaagacccatctttctaaatgcttactctcttggagcatgtaatttctttcctaggaatcaccattctcagctgcctgactccaagaatcgttctcagttttatcttctgatgctcctagacctcagcaccttattccagcctaacacatctggcaactcactgttcccagagctattcaacatgccttccacctcagggctttacttggcctgtaatgccctcttcctctctttctgccaaagtagcttaatgattaggaatataattctgaagtccaaccatgggcaaagccagctcctctgctgacttggtggatgaccttgaactaaatttcttcccttctcagagcctccaatggacagtaaaactaataacaacacctccctaccttagaggttgttgtataattaaatgagataatatacataaagtgcatggtgcagtatctggtacatagtaaagatcaataacctgatgttatcattgttgtcgtcactattattatttcagaccttggtttctccccactctttcatgaagcccttatctaaccactccaggtcaaaatcatctctcttttctttgaattaacttacttttcctatcactgatttgatgactaggatttattgccttaagctttacatcattcctttccgattttatttccccatctcaggtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacagggggtgagtgaggagggtcggggtcaggggcaggagaaactggaaagcggggaaaggaggagcaggaagaggaggggtgggagaagggaagagacggcttgcctaaccgttgctaacagctgccacttttaataggcgctacccggtgtgctaagtgggcgttttacaggtgttaccttgtttatttcagcacactctccacctagggaggtattgataccaccatttgattggtggaaaactgagactcagagaggttaagtgacttacccaagcttacacagctactaagtggcagagctggaaaggttttctgatccagagccagacttctgaacatactgtgcatagtgtctaagggaagggcagagggatgcgggggctggaagagggccagtggggtggtgaggaaggaaagaaaaaggaaagtatatggatactttctaagagaccccagcattgatgggaaggggctgaagctgctccctctctccttgtagctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtgagcaacttcctgtcccggggtggaatggggcccctgggcccagattgaagctcaaaagtaagttctccgcagcagggggagtcttgattgtgactacgcgtgcccctctgcaagtgactggataccagcaacagtgaaggttatctgtgtccatgtatctatttctaggactgcctgaggatgcataacacggcaccagcgcccactgctgcctcaagcatgtgacagtgtggaaataataatcttgttgtcattcttgcatatgtccttgtcctatactcagttgccccaaatacgcagcttgaatgaacccattagccaagggaagacttacttactgaatccttgtcgacatggaaaagaaggggtgttctataatccctgggagtcttcagaggggtatacggtgttacctgttttaatatctaatcatagtttcaaaaggtagcagtagcttgtgtttatggagtactttttaatgcatcaggcacttttctaaacatttcacatttattaatcctcttaatacttaaaactattctatgatatgggtaatatgattactcccactttatagatgaggaaaccgagtcagagcaactatgttcaacttaccgaggtttatgtaaccaacaattagcatggctggacttcagagctgctcagtctaagtccacggtccataggtccagactcttctaagaccaccgccattttaactgctacatattgggcacttatgtgccaagaaggagacgctgatcacattcaattctgcaaaattcctctatgggtgtttttattaactccccttccccccaatttctgttgaggtccttgaggctcaggttagtagagtcactttgcttgaggtcacacatctggttagtgaaagactcaagaatcactcctaggtgtgacagttaactcttaaggtctgtgcgctccaagctgggtcttacaatgtccctccttttcccctgaatttctggatcgccaaataatctggccgtttaacactcctttgagaatatctagctttccccaacttatactcatccaaccgagatggcattcatactacctgccaacagcggttccctaggggggtagaacccaaggctttgaaactagatgacagctgaatctgctcagtgacttggtgattcacttcctcatctgtaaaatgaggttgatgatgcctattttttgatgatcagctgagatgaataacagagagaggagtgcagaggatggtttttactagcgaggcataattttcaaccttcgctgtgtatcggaatcacctgggctgtctgggtctcactcctggaagagatacagactgggttaatctaagggtggtatctgagcatcttcacgaagctttccacatgtgcagcaggaacggagagccactaagagtttcatggccgttgtccagatgtcaattggcaaccttctctctctagttccttcttaatttggtgttttgagaatcctagggcaagaaaagaaaatgggcagttcttgagggctcaccatgtgctagatgtttccagatatgcgagtgcatttaatcctcacaataaccctctgaatggctggcattatcttttttacaggtgaggaaaccagtgcttaaagattaaagtgtttgttcaaagttgcatatctcgtaagtggaggaatcggatccaggtctgacgccaaacccatgctgtttgtaggatgctataaaacttcctaagctaatattttagaactgtttcttctaatttatgcagtggacaggggttccccttgctcactgtctctcctttcctccaaggtcatggatggaaatgtcataactgcaaagagaacagctgcagtttctgccattgccaccaaggtaagatgaatggctggctgtaccattaaggtgagctgtcaagtggggtctggtgtctcaatcttgagagactaaaggagaagtggggaacttattttggtttcctgttggacatagctggaactccagatgtcagatatatcagtaattcacaaaattattagctaccaattagtgtgcatgaccagatttcaagtaccttatgtgcataattctcaatcttcccatcagtcttgaagaatcgaaatgagaaattctctccaccttccaggtcaaggaatatggctcagagagcttctgtgaattgcccaggatcacacagctaataagtgctagagtaagaatttaatacttgacctctctggcttccaggactggcttcttgtccctgtaccacattgcccctggtaagacagtataattgtcccatagaccaaagctagtactacacaagaggctgagtgaactgaacatatccaagccagatccctgtattcattcgacaagtattgactgggcttctataatgtgtcaggcactgttctaaatgttagggaaatggcagtgagaaaaacagaggggcacacacaggggaggtagacaataccaataaaaaggaaaacacaggctgggtacagtggctcacgcctgtaatcccaacattttgggaggctgaggcaggcgtatcacttgaggtcaggagttggagaccagcctggtcaacatggtgaaacctcgtctcttgtaaaaacacaaaaattagctggtcgtggtggtgggcgcctataatctcagctacccgggagagtgaggcaggagaaacgtttgaactcaggaggcggaggttgcaatgagcccagatcgagccactgcactctagcctgggcaacagagtgagtgtcttaaaaaacaaaacaaaaaggaaacaaaacaaaacaaacaaaaacatcttttgagtttaataatgtgttaaatagtaataaataatatgtaattaaataattagtacatattaataaatgattaatagcgtgcttagaatttgctaaaaaataaaaccaacaataatccaaaaagccacataacatgttaggtgaagataaagcagaagtgagagtattggagaagctgtcacattttacattatccaagaaaggcctccctgagaaggtgacatttgagtcaaagctgaaagcagtgagttagcgaaccatgcaaaaacacggaggggcactccaggcagagggaacagtaagcaatgggggtgatgatgttcccaagcaatgtcaaggcatcctataagaaaaacagcatttttaaaagttagagttaagaggatgaggcttaggaaacagggtgtctgtgggaacgattggagtctggagtctttcacattaaatgtggaagtacaaggtcttgggacactggttttcctaagttattataaaggaaacgtggtaacccagggaaagttgcagcagcaaagaccaggtgttcaggttgcatgtcgaggttttctagatacctgctggggagggaagaatgggaggattaatctggtaattgtatgcaaagggagtagaccaacagcacccacctcaatgaactggtttttagttatatccagacctgactcaactgaagtaatcaaggactccttgctatgtttgctggtaatttgggaacagaatgaatcttgtattactgtcatttgcaaagagctttagtctttttcaaactcatttccagccccttgtctggactacgagtttctgtgaggaaggcagagaaggtattaatggcctcattttacgcataaaagaatagaaacttgggtttcctgaagtcatacaaccaggttcctgcgggtccttttgaggccacatggtcttgtcccagataagaagtttccaacagaagcaagctatgcagcagcattagctagggaagtttttaaaaactcaaattcccatgcctactgaatcaaaatcacagagtgaggatcaaccaggtctggaaaccacacttttgtagacccagcctgcaataacactgctttgttgcattaataaaaatctgtgctcccagaagaatcaagaagccttgggttgacacttcaaagtttagacacttcaaagtttaggctgaaacttcacagctttatttccaggggctcagatgaactgtttcaataaggaacaaagggtctattttacttgttgccttgagagtagaatattttcttgtccatcatttctcttttatttagggctcttgttggggagaataagtatatggagctctagggtctgatgaacataatacattttttgtgcttgggtctcacataagcttcattgaagcctctgatatgttttctcaaggtgatagtatatattagggtttagcactgacatacatttattcaacaaatatttgagtgtccaccaaatgcaaggttctacgctcagcatggggtaagcaaaaccagatacagtacttgccctcatgtagtacagggtccagtgggggaggcaagatatagtccaaagatcacatcaataggctgggcgcagtggctcacgcctgcaatcccagcactttgggaggctgaggcaggcagattacctgaggtcaggagttcaagaccagcctgaccaacatggaaaaaccccatctgtactaaaaaaaaaaaaaaaaaaaaaaaaaaaattagctgggcatggtggcaggtgcctgtaatcccagctacttgggaggctgaggcaagggaattgcttgaatcctggaggcggaggttgcagtgagccaagatcacaccactgcactccagcctggacaacgagtgagactcagtctccaaaaaaaaaaaaaaattcacaccaataaatatgaaactacaacgctgacaagtgctgtaagagtgtaaagcagtatgtcttgatctagcctgtggctgtgtctctgtaggggatatttgagctgagattgaaggataatcagttacttgtgagggggagaggggacaaagcagcctagcattgtatggcaaggaattaattcatgcaaaggccctgtggttgaaggaagtacatgagcttgggaagctgcaaggaagccagtatggctggaagacaggaagtgcaggggaacatggcatggtggtatgagagacagctttagagataggagggccagaccatgcaaggccttggcaaatgcaaatgaaacagactttcagactctttaaatgagaaacccagcagattcatatacgtgtacttaataacctgcatgcttaggagaaaagattgaagtgccactaatgctgtttaataaatcttataaacatatgattaaaaatcggctgggtgcagtggcttacacctgtaatcccagcacttttggaggccgaggcaggtggatcacttgaggtcaggagttcgagaccagcctggccaacatggcgaaaccccatctttaccaaaaaaaaaaaaaaaaattagccaagtatggtggcacatacctgtaatcccagctactcgggaggctgaggcatgagaatcgcttgaacccaggaagcagaggttgcagtgagctgagatcacaccgctgcattccagcctgggcgacaaagcgagactgtctcggaaaaaaaaaaaaatttaaaaaatatcaattatcacactattaccagggcaacaaattatcaagtaagacaaccaattagaattacacatttagtttaggaagttgaaggttatttttatgggatactgtaacaatttctgaagctcacctgtactttcaagaatagattcatattaactgagaacagaagaaaatggtaacaattaaggaaaaaaatctaattatccttatcagacagcaacataagatttctagtcttgtggatattatcattttgaaaccttttcaaatcagagatgttaaactatattttatggcacagaatggtatctctccttcggtagctgcaggagataaaattaattcctaatatttcagagatgctgttttgctagtaattagtagttaagaagacttttcactttttaaatattatactccagaattccagtgagtagcattttataaaagaacagaccacagggaactcaaagtttactaaatggaatagagaaaaggcagaagagggttttatttaatacatatggtgtcgagggccaagtgatgtctttcctctatgccagtggttctccactgagcatgagtttgccacctgctccagagacatttaggagtgtgcagacgtttttagttcccacaacttgaaggggtggaaaatgctactaacatctaatggatagaaaccagagatactgttgcacatcctataatacacaggttggtgcccctccccaataaagaattgtccagcccaaatgttagtagtaccgaggttgagaagcccagtgctacctcttgtaggtcatagtaggtatgtaccagttctgtgcaaataagactacctctgtcctcatggggcttaaagacctgtagaagaaaatctacaaacaaataagtgctatggcctggtgcattctatcaaggaggtcagaaaggcttcattggagaggtggcactggacgtgagttgatcacagaatcctgctctcaaacacagacaccctcaggagatgccacaaatgctaattctacattcgtctttagaggaagacagaggcagtgaaaagatcaacagagttggcccagtgaatatagctagaaccctgggaaggaagggctcacagaatccaggcagctcttagaagcagctcagagctctgagaagtgggtatggctgagcatgtacctgagatatgaagaaaggacatgggctttggagtatggaagacgtgactttagagccacactgtgcccttcaatagttgtaagacctggctaggtgcggtggctcacgtctgtaatcccagtactttgggaggccgaggtgcacagatcacctgaggtcaggagtttgagaccagcctggccaacatggtgaaaccccatctctattgaaaatacaaaaattagctgggtgttgtggcgcacacctataatcccagctccacggggggctgaggtaggataatcactggaacccaggaggcagaggttgcaatgagccaagatcgtgccactgcactccagcctaggcgacagagcgagactccgtctcaaaaaaaaagaaaagaaagaaggaaagaaaaagaaataaataaataattttaaaaagtagttgtaagacccagagcaagttcacctttctgttaccagggcaacctcagtctcttcatctgtaagaagaagatagtaggagtccccaactcgtagggccaatgtctagactaaatgagatcatgggggcaaagcattggcatacattagctgttcagtgaagccttcttccttcttttcccacttgatacgggggaaactagacacaaaaggaaattctcttgattgcctgcaagctcttgagggaggcagaagagagggcagaagtcacctgatactcaaaccatcttagttttttacccgtctgctagggtctcccttgacctttgccacttcatttctctcatatagtttctgaaacctcccagcagtgaagtgctgtgcatccttggggctggggtccaggcctacagccattatgagatcttcacagagcagttctcctttaaggaggtaagtccaggggtgggggtgggagagaagagggaagggggtggtccttgacctgtctatactgcttcactgcaccacaggttattctgaaataattaagttgtgagccccatctagaccattcttgtatcttcatgacttcccagaagccctgatggaggggatggaggataagagtcaggggaagatctgattacctgtttccagtcctcagttcagagggcatttgtctgaggatacagcaagcttactcggttaaaagattctattatatctcttgtatacattcagttgtccttttagctcctgtctattatgtttttcttaggagaatccagagtttttaagtattcaaggttgtggatcaagaaactgggtgggatgagacctggagaccaggaggccacagcctctctcttttgcagtctccatactggtccaccttccccccactgcgtctcatgcttccccctgggaatttttgatgctattgttattttatgtgtgtgtatgaaagggatggagcagttttaaagtatgatttaatgatgaaaataaaaccactgccttgagaaatatagactattaggtgagtgcaaaagtaattgcagttttggccatgactttttttttttttttttttttgaaatggagtctcgcgctgtcgcccaggctgcagtgcagtggcataatctcggctcactgcaacctccatctcctgggttcaagtgattcttgggcctcagcctcccaagtagcttggattataggcgcccactaccacacctggctaatttttgtatttttagtagagatggggtttcaccatgttggccaggctagtctggaacttctgacctcaggtgatccacctgccttgtcctcccaaagttctgggattacaggcgtgaaccactgcgcccagttgccattacttttaatacaaggaagaaaacaaaagaaaaatgccctttcatctgttttcaaagacagttaatgttttctgatcttccctcttcagctttttataacatagctttagtcacgttagatatgcaccattttatatcctctcttactgaatgttctaacatcacttttcaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtatgtattatatttccttatgagaaattctgtaggccttattttcagttgacgggtgacaagcccttgacccaaacattgaaacctgtcaagcaagtcggcaagtccccagctcctggtgaggccgctgccccaccctccaaccccagcacctttcaggattccagccgtagctaccattcttggccttttcattggctatgccatttaccttcaaactcgtctgatcttgaatttcctaagtattcttcaccgatcaagttattccatgaaaaacattatcataaataatccttcatatgaatctcccacccattacaactcctttacggggtctcagacataaagtgtgagttccacacagactttgccagttatatttccattttacagatgtggaaactaaggctgaatgacatgaagcaatttcaggaaatagcagagtggagattggttccaagcctacctggctccagaacttgctctgctaatcattatgctattaatatataatagctatgaagttactgaggctgtgcctcttggcctagaagtgaaatacttccactcattttaaaaggggaaagtggtagagaacgctgattttcaaatacctggctaggtgtctaagttaatgctgtacccctgatcaaatgtccattctccatggggaatgatttaggagtgatttagataaccactgacccctatgccagagtagttcaactttccctccgcatccctgggctcagtgtaacataagcagccaaaaaatggcgccaatatccttcttgttactcccaatgaaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatggtaagtagagtggctccataaggcatgatgggtggtggccaggctcctctctagacgggaccagtcgactacatttgcagagccagtttattcatgcagaatgcccaagctatttaagggccttgaaaacatgtgagattgaaaaaaacaatatttggctgggtgcagtggctcatgcctgtaatcccagcactttgggagactgaggcaggtggattgcttgaggccaggagtttaagattaacctggtcaacatggcaaaaccccgtctctactaaaaatacaaaagttagccaggcatggtggcttgcacctgtagtcccagctactcatgaggctgaggcatgagaatggcttgaacccaggaggcagaggttgcagtgagccaagattgtgccactgcactttagcctgggcaacagagagagactctgtcttaaaaaacaaacaaacaatatttgctccaaaaaatgtaaaagggaaattacaaacctgaaactaaagaatatttaatgttctataaaatgtaagttttttttctttttttgggacagggtctcactctgtcgctcaggctggagtgcagtggcgagatctcagctcactgcaacctctgcctcctgggttcaagcgattctcccacttcagcctcccgagtagctgggactacaggcatgtgccaccatgcccagctaattttttgtaatttttggtagagacaaggtttcaccatgttggccaggctggtctcgaactcctggcctcaagcactctacccacttcagcctcccaaagtgctgtgactgattacaagtatgagccactacgcctgaccataacatgtaaaattatggcaaatggtaattcacagctcaattctaaaatgtgatgaaatttaaatcagaaaggccaaatgagtcactttttcttaacactaagaattataaacctttaaatttcttttgtactgtaattttttatgtgacatgtatatgctttttaatatgtgtgataggatgaggggcaggagagggggctctagacatgagggtgcctggggcctctgtagaccttcagatggccctgggtgttatagcaagagctggtctacatctaatactactgcaggtgctgtcatgaattctttgtataattctttgtatattaaatgacattattctatgtataatgtcatttaatacttataaccaacttatgaggcaggaactattatcataaacattttatagggggatgaaccaaggcatggagaaattatataacttttccaaagtcacaagtttttgtttgtttgtttgtttgtttgtttgagatggagtctcactctgtcacccaggctggagtgcagtggcatgatctcagctcactgcaacctccacctcccatgttaagtgactctcctgcctcagcctgccgagtagctgagattacagacacacgccaccatgccagctaatttttttgtatttttagtagagatggggtttcaccacattgtccaggctggtctcgaactcctgacctcaaatgatccacccgcctcagcctcccaaagtgctgggattacaggcgtgagccactgtgccaagcccaaaatcagaggttcttgatggcagagctgggatttgaacggaggcactctatcctcagagtccaagctttaaatgatactcatgattgccttccaacaggaagactggattctggtgagcagagcaggcaaattttagaggatttaaagatggtcttggtgccctgtgttttagtgacaagcacatggtgtgaactcagaagctaagagctttgcacacgtgggcagatgagccggcgagagccaagtcaaatgatgacgcattcaatcatacatgctgactgaatctctaccgtgtgccaggcactattctagatgccagggatgccacaataaccaggcagtcaaggtcactggtttcatggtggttaatttcagtgaggagagatagacaacaaacaaacacatagaggaactagatcgttctggctaaagatgagaccggaaagaacaaggccctgggtgatagaggctggtggtggaggtggaaggtagaagcagagagaggtgttttcaatagggttatctgagaagctctctaagatgtgttttttgagctgtgacctgaatgaggaggaagagcagccatgccaagagctgaaggaaaggcattcagggtagagggcacagcagatgcaaaggccttgagtgtggaagcgaacatggcgtgtttgaggaatggatcaaagtaatttgaaagtctcaggctgcatgggactggtggtcagactgggtccagggaatgggtaagaggtaagtcagggctgagtttatggacaataagaccatttctggaaggacctgggaaatcaaaaggaaccagttcatggtgaaatgggtttccaaggctgcatcttcagaaagatggacttgatttttttttcagcttaaaacaacacattattatcatctcacagttcccgtggttcaggagactgggtgtgggtagctggatcctctgtgcaaagtctcacaaaaaagaaattgggcaacatccgggctgcaatctcatctcatgctcgggggtcctcttccaggctcccatggtgtggcaggattcagttccttacactggaggatggggggagcccctttccttggggccattctcagctcccagagatgacccaaatttcccaccatatggactctccatcctcacatccagccacagacaatctcccttatgttggatccctctctcacttggaatcattctccaggaagggctgacttgattttgagtcaaggcatctcttctgttttcctggcccagggacaaaattggtttatgtgttcacagaggcaacacatacatttaagaaaaatgtgtcacaagcgcagacaacagggaaataccaacaacagattttacttagtttacagctcagcggagggacaggcccagttccaccctgccccatgcctccctcctcctgcccccacaccctgtcaagcctgtctgcgaccctcactcatttagccccatcacaaccaagccagagccttgtttgagtcaggcctctctctctttactgcctggcccacctccatccgcctgagtgacctcacacaaccctttgagaactcgcccggctcataagcagtggttgtgcaggggaaatagtccagtgagaaggagtggcctgagaaacgggggttttgttcccaccagcttatgatttatttacaagcttccttagctagtgcttttgttctatagaactctccgcacaaacaaccttcaagatggacatttttacacaactctctttggaaattagaatgagggagaacagaacgggagggaacaaagggagaaaacggggcggcagtggaagaaggcatataaatgctgtcttatatttgtataaggctttatagcagttttcaaagactagccagccaggggctggatccagccagcagatgtgtttggtttggaccatagagtaatctaaaactcaaggagtgacatatgcaaatagatttcctgtttctcttctaagaaaacaactggggcatatctggtaacagtggatctacattcacacgtggtaatgattagctggagctgaacaatgactgtccccttcggaagggcctgctggcttccccgcccctcagtctccaccacatctaatccagtccctctgaccagctttgttcattttcattacctccctggccttgcaggcatttggtggcagcctctgcattctcctgtgtcctggtgccagggggcgtgacaccttggattcatcattctggtcctggactccatagaggatgtgacagttcagggccaggacggagccagttttctttctgacgagacttctccatgaccctgacactgagtttttgttgttgttgttttttttcttttgtcatgagttaagagagaaccgggggtgaggagagggaaaggggcatagtggcaggcgtctgtggtcccaacagtttgggaggctgaggcgggaggatcacttgagctcaggagtttgaggctgtggtgagtttttgtttgtttgttttttgagatggagtctcactctgtcgcctggtttggagcacagtggcgcagtcttggctcgctgcaacctccaactcccaggttcaagagattctcctgcctcagcctcccaggtagctgggattacaggcgtgtgctaccatgcccagataatttttgtatttcagtagagacagggtttcaccatgttggccaggctggtcttgaactcctgacctcaagtgaaccacccacctcagccttccagagtgttaggattacaggcatgagccactgcacccagcctgtggtgagttctgattgcaccactacactccagcctgggcaacagagtgagaccctctctccaaaaagaaaaaaatagatattaaaagaactggttgagggtgaggaatgggaatgatggagatcaagaggagagtgaggtgtgaataagcaccaagtgatgtctctgtttcgggatttttgtgaggaaggtgttcctgttaagcagaagaggtgtgagcgcctaggtgctctctcagacctggattcacccatcagatccttaaccttggcaaacaccttcacttctttgagcctccattcgtgcatctgttaagtgagaaccagactttgaaatgtacttgcgagaaccataaatagtacgtgcaaaacatcccacagagagtagacaccctgtaaatgaatgctatgtcgtctcaaaatcttttagcaatgaggtgggatatagaatagaaaggcaaaatggtaggtagttttttttgtttgtttgtttgtttttttgagatggagcctcactctgttgcccaggctggagtgcagtggcatgatcttggctcactgcaacctccgcctcccaggtttaagcaattctcatgcctcagcctccagagtagcaaagactacaggtgtgagccaccacgcctggataattttttgtatttttagtagacacagggtttcaccatgttggccaggctagtctcaaactcctggcttcaagtgatctgcctgcctcagcctcccaaagtgctgggattacaggtgtgagccaccacacctggcctatttcttaataagtatttcgtcctactgattgggagagcatggcctggggaatgagggggtattttgaatctgagtgtgttcacgagtcctttgttcacctctctcctgtgctttgggcttcttagcagcctttggcactaatcctgggcttaaggtctgttttgctgtctcttagctgttggagccagcagacctgactggagagaactggatgatgagctcatgaaagaagctgtgctgtacgtggattcccaggaggctgccctgaaggagtctggagatgtcctgctgtcaggggtgaggcccttctgaccccagtcagggctgccacctggctggcctcacctggatcccagggtttcattaacctcccttccagtttggtctgctccagacctcagccaccccacctccttgtaggggaaggagctcctaaacattttgcaaccctctttaattccattccagaaaaatatgggcattatgggtggtgacatgtgtgttcctggaaggagaagctcagtggattttatttttttgctgggctgtcctctaaagaagtgggattggaagcttcttgcagcctggaaaccttcccaatgtggccaacatgataagactgtgttgcccaccttctggcctcattttacggttataatcagcataaaacaagaagggagctgctggcatgcatgttcagataacagcatgtctatttcctcactgacacaatgatcttggcaggacagctccctgagcaccaactcgaatctctgtgtttatggtatcacaaaagcaaatgccaccccaaaaggatttcggggccagcctcctccctaatatcattcagtgtacaaaggatctctctcttttttttttttttttttaatcaaatttatctcttatccaattcaggaattccctgggctggcttcaaaagccaaccctgcacagactttagcttcatgcctgggtcagcgtatgtttgtttcctaggccgagatctttgctgagctgggagaagtgattaagggagtgaaaccagcccactgtgagaagaccacggtgttcaagtctttgggtaagatccattgctccctgggcacaaatccaactagcgcacaaggcaggttcacccattggtggaaagagcaatgagtcaccagactctgcagctgaatcattgtgctccatcattcaggtcaattatttacatggtttagcctagtgctaagcccatgaactctggaactgagcagtcctgggtcagagtcccttccccgccactcagaggcaggtgtccttaggcaagtgatctgacctctgtaggcctcagtttcctcaccacctgttaccattgaggattaggtgggatttgcatataaaatgaatcagttcggtgcagatcttgatgaaattcagaaggtacccttcagaggtggagggggcaggggacaaagatgttaaaagacaggaaccttaagggaaatggcagagacccaacctgaaagagtcagatggaaagtatagcctaagccctgttcattccctccttccctactctcccacttgctgctttgaggagggcttccatggggagccccctaccacctgagttgtatggggtaccttatagaagcccaacaaagggtgggctcccagtggccagtctgtcccttgccccaggtcctcttccaccctatgagattgaaggaaacagaagtacatgggaacaggctgagctcggtggctcacgcctgtaatcccagcactttgggaggccaaggtgggcagatcacttgagctaaggagtttgagaccagcctggccaacatggtgaaactccatctctactaaaaatacaaaaattagccaggcgtggtggtgcacatctgcaatcccagctacttgggaggttgaggcaggagaatcacttgaacccggaaggtggaggttgtagtgagctgacatcatgcactccagcctgggcaacagagcaagactccatctcaaaaaataaataaataaagtacatgggaacagagctgatacacctaaaacactgaaatactcccaaactggttggtaaacagttgctatcctgagcccctcgagagtgccctctgtccccctctcatgaccttccatacttcgtgatcaagcagcaaaagagtaaatgcctggcagagcatcaggagcgctctggccacccagagcccatgccattggttaagtatccatgccttgcaggttggtaaatgtctttaaaatctctcatgcactggaagacaaaggcaatacaattttatctggagcctggttcaaagacatcacatggatccagttttgtctgaaaacttcaaaggtcatggcagatcagaggtcagccagcccctacttaaggagccaaaatgctgcagaaacttgttctgtcctttttggcaatttttgctttcttacttttggggatcagtttattggtgcattgtttcatctaacagatgcgtatcaagcacctaattatctgtgctgggtgcagaggttaaggtatctaccaaaattacaagacaaaggggagatatcaaaggatgcagcattcaaactggaccaagcgtcagaaaactacagtcctggggccagacctgctctgctgcctgcttttgtgtggcctatgagctagaaatggtttttagattttcaaatgaatggggggagaaaatatttcatgatgtctgaaaatgatacaaaattcaagcttcagtcccatcaataatttcactggaacacagcccacagccaggctcttttgtttacctgttggctgtgttttctactctaaaggcagagttgaataattgtaatagagaccctgtggcccacaaagcctaaaggatttactgtctgaccctttttgaaaagtttgttcaggccaggcgtggtggctcatgcctgtaagcccagcactttgggaggccgaggtgggcggatcgcctgaggtcaggagtttgaaactagcctggtcaacatggtgaaaccctgtctctactaaaaatacaaaaaaaaaaaaaattagccaggcatggtggcatgcacctgtaatcccagctactcaggaggctgaggcaggagaatcacttgatcctgggaggcagagtttgcagtgagccaaaatcgcgccactgcacttcagcctgggcaacagagcgagactccatctcgaaaaaaaaaaaaattaaaaaaaaaaatttgctcagccctgagctagatttagaaagatgcacaatttgttggtgggtgtttcttactatcatattctctgcccctttgcagacaattgaagcctgagctcatctctgggtatcagtccctgttattccaataggcattggcaacatggacatgtatcaggaaacttccagccatggggcctgggttgtttcaagaaaagttgttttgaccaaaggcgaaccaaatttctgtctattctaggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtgtttgcttcggtaacttctattactatcacaaggaaactgagagggatcagatgctcccatttactccctgggggagctacactggctataatgaaacttcttttttatgtatttatttagtagttacaactcacatactctaagatccactagtttaaactatacaattcagtagtgtttttttttttttttttttggatggagtttcactcttgttgcccaggctggagtgcgatggcatgatctcggctcactgcaacctctgcctcctgggttcaagtgattctcctgccttagcctcacgagtagctgagattacaggtgccacgccaccacactcagctaatttttgtatttttagtagagacggggtttcaccatgttggccagactggtcttgaactcctgacctcaggtgatctgcccgcctcggcctcccaaagtgctgggattacaggcgtgagccacggctcccggccaagcctggtcatttcttacaagtgaaattctactatatgtagtcttttgtgcctgactccttaatgcttagaggaaaaatggaatttctgtatagatcagggctcctttggtcataagtggtagagactacaactcaaactaccttaagctgaatgaatggagaatgagatttattggctctcgtaattaggaacacacaggtaactggtttcagctacagctgtattcaggggctccaactgtcaccagggcctggtcttcttccccgttggctccattatcaagttctccctggtagtggcaggacattggtcagcagctcctgaattgtattctgtcctctttagcaactgagcataaatattctcttcctttacagttagatgttccagaactgagagttactggaccatctaggtcacatgtctattcctgagcctaacattgtggctgaaagacatggaatagacggggtgaggtggttcatgcctgtaatcccagcattttgggaggctgaagcaggaggattgcttgagcccaggagttcgagaccagcctgggcaacatagcaagaccccatcttttaaagagatggaataccctggccaggctcaagccttgtacctatccctgaaccatcacgttgtccagggggatcagatgctctggttatccaggcctggatcacatgcccacccttgaagtcagaagtgtcatctgcgcatctgcccacatgagctgatggagggaaggtgtctcttaacaaaaagaggactgggtagttgaaaggcaaaatctaaagatgtccactacagtatccatgttaaaagggccattaaggatcagctagtcgatcttcaacttacggatggggaaactgaggtgcagagatactttctccaggccccctgaatcactagcagaaccgtgttgtccttgtcctgccaaaggccctgtccaaatcccactccgaccctagcctcaccccaccccttcgctttttgctactccaaggctggttttcagataagtcagcagcaaagcatggctctgttttcctgaccatactcctcctgggaaggactcatgctccagatggtttagccaaaagtttatcatatttgccagactgtctggacaggggtctttgtgctgaaacaaaatacccacattacccacatgatctgattctgcatatctcaagtgactatggagtctttctgaggaatcctgatggtcactaccctaaaggatatatagagaagagcatggaatgatgagaatattcatatatcttttctttcattcttttcgcaagagcccctatcataaccctgtgctagcttactaagatacaacagaaaagtagtcctcagccccagagaacacagcctcgaagagaagacagatgttaaaaaaaaaaaattacaataatttggtgttacaggaacatggttcagggtccctgcaggaaatgcagatgttccttgacttatgatgcagtcgtgtcccaataaattc

SEQ ID NO: 16190 - DNA, 5195 bp, Human
tgatacagcggaggcagcactctggaactaaccccctctggaacataatcccattggccaaagaaccacaatccctccatccccacagtggccatagcaagccccaccaaaggataagctgagcccagatctgcctacctctacccccacctaatggaatttccctccccaccctggtagccaaatataaaagatagaaactcttgggagctttatggccatgcccattgcctgagaaaccaaaatacttaccctggctatcttagggcaatcttagagcctgctactactaccaccactgctagtggtctcttgaaagcactacctcctggctgaaggccaaccaactcagaccattacagcaattcatgacagaataaccctgatcccaggaagaagataacatctaactccactgcctgcaacatcctgacaaatccaagcttctgagtatgtccatgtgacaacttcactgctagcatgaccagcattcaagaaagccagcacactaaacatatatacaaccaaggactctcacagagtctacttcactttcctcccacatctaccagagcaggtactggtatccaaggctgggagacctgaagattgatcacatcacaggactctgcagacatcctttagcaccagcctggagcctggaagccccactgggtgactagacccagaagagcgataacaatcactgcaatccagctctcaagaagccccaccccaggggaatgggaagagcaccacatcaagggatcaccccatgaaacaaaagaatctgaacagcagaccttgagtttcagacctttccactgaaatagtctacccaaatgataaaatgataaggaaccagaaaagtaattctggtaaaatgaaaaaacaggattccataataccccaaaaaaatcacaacagctccctagcaatggatccaaaccaagaagaaatctctgaattgccagatacagaatttagaatgttgactattaaactattaaaggagataccaaagaaaggtgaaaaccaactcagaaattttttttaaaatgcaggatatggatgaaaaattttacagagaaatagatatcataaagaaaaagcaatcacaacttctggaaataaaagacacacttagagaattacaaaatacaatggaaattttcaacaatagactagaacaaatagaagaaataactttagagctcaaagacaaggcttttacattaacccaaccagagaaagacaaagaaaaaggaattttaaaaaatgaaccaagcctccaagaaatttgggattatgttaaacagccaaacctaagactaattggtgttgccgaggtagaagaaaaatctaaaagtttggaaaacttatttgagggaataattgagaaaaacttccctggccttgctagatatctagacatccaaatacaagaagctcaaagaacacctgggaaattcatcacaaaaagataatcacttaggcacttagtcatcaggttatctaaagtcaagacaaaggaaagaatcttaagagctgtgagacaaaaatcatcagataacctataaaggaaaacttatcagattgacagcagacttcccagcagaaaccttacaggccacagggattaggtcccatcttcagcctcctgcaacaaaataattgtcagccaaggattttgtatccagtgaaactaagcttcacaaataaaggagagagaaagtatttttcagacaaagaaacagagagattttgtcactactaagtcagaactacaagaaatgctaaaaggaattctaaatcttgaaacaaaacctcaaaatacacaaaaatagaacctccttaaagcataaatctcacagggcctaaacacaacagagaaaaaaaaagtattaaggcaacaattaacatgatgaatggaacaatacctcacatctcaatactaacattgaatgtaaatagcctaaatgctccacttagaagatacaggagcagtgtgacgaagaagaggcgagaacgacccccggactgaccaaagcccgcgcgcagctgcatcccgcatccagcacctacatcccgccaccgtcgtggccgtcaccatgcccaagagaaaggctgaaggggatgctaagggagataaagccaaggtgaaggacgaaccgcagagaagatccgcgaggttgtctgccaaacctgctcctccaaagccagagcccaagcctagaaagtcccctgtaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtacatttttgataactgtgtacttctggtgactgtacagtttgaaatactatttttatcaagttttataaaaatgcagaattttgttttactttttttttttttaagctatgttgttagcacacagaacacttcattgttgtttttgggggaaggggcacatgtcactaacagaaagtctccaaagctggatttatgtgaggaaaacacctttcccttctagttttgagagacttcctcttggctcccaggaggagggattccctgactctgacacacatggccaccttggcacaaaagccttgtggtatagaaaaacaaattcgtttttatgtcctcttctccttttccatctttcagcatagacttaactcccttgagccgagacatctgttgggacctgacccccagtcattgattaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacaattgtctgcccatgtcctgcctgaaataccatgattatttatggaaagtatctttaataaagctggatatggtttgaaaaaaaaaaaagaagacacagaatggcagaatgcataagaattcaccaaccaagtttctgctgtcttcaagagatttacctaacacataaaagattcacataaacttaaggtaaaggggtggaaaaaggtagtccacacaaatggaagccaaaagtgagaaggagtagctgttcttatatcagacaaaacaaactgtaaagcaacaacagttaaaaagacaaagatggatattatataatgataaaaggactagtccaacaggaaaatatcataatcctgaatatatatgcagctaacactgacaatcgcaaatttataaaacaattactactagaccaaagaaatgagatggatggcaatgcaataatagtgggggacttcaatactccactgacagcactaaacaggtcaccaagacagaaagtcaacaaataaactatggacttaaactataacctagaacaaatggacttaacagatatttacagaacattctacccaatagctgcaggatatacattcttttttcagcatggattctccgagatggatccattctccaagatggatcatatgatagatcacaaaataagtcttaataaatttaagaaaatagaaattacatcaaatatcctctcagaccacagtagaataaaactggaaattaactccaaaggggtttattctatacattaaactataccctaaactatacaaatagtatagtttattagtttagtttaatatataaatagtataatttatatatataaaatagtatagtttaatatataaatatatatatatatttataaatttagggtttattctataccctaaactatacaaatacaaggaaattatataatctgctcttgaatgatctttgggccaataatgaaatcaaatggaaatttaaaaaattatatgagctgaacaataatagtgacacaacttatcaaaacctctgggatacagcaaaaacagtgctaaaggaaaagtttacagcattaaatacctacatcaaaactctgaaagagcacaaatagacaatctaagctcacaccttgagaatctagagaaataagaacaaaccaaaaccaaacccaaacccagcagaagaaagacataacaaagatcagaacaaaattaaataagaaatacaaaagataaatggaacaaaaaactagctttttgtttgtttgtttgtttgtttgtttttaggagattaagtcttgctctgtctcccaggctggagtgcagtggcgcgatctcagctcactgcaaacttcgcctcctgggttcaagcgattctccttcctcagcctcctgagtagctgggattacaggcacaaaatacaaaaattactaccatgtctggctaatttttgtatttttaatagagatggggtttcaccatgttggtcaggctggtctcaaactcctgacctcatgatccgccctcatcagcctcccaaagggctgggattataggcatgagccaccatgcccagccaaaaactagttcttttaaaatataaacaaaatcaacagaccgttagcaagattaaccaagaaaagaaaagacccaaataaactcaattagaaacgaaaaaggagatattacaactgagaccacagaaatacaaaaagtggtctaagaacatgaatagacaattctcaaaagaagatatacaaatggccaaaaaactatgaaaaatgcttaacatcactaattattaggggaaatgcaaattaaaaaacacgatgagatgccaccttacttctgcgagaatggccatgatttaaaaatcaaaaaataatagatgttggcatggatgtggtgaaaatggaacacttttacactgctggtgggaatgtaaactagtacaaccactatggaatacagtgtggagactccttaaaaagttaaaagtaggactactatttgatccagcaatcccactactggacatctacacagagggaaaaaagtca
